United States Patent 6,812,339 (POLYMORPHISMS IN KNOWN GENES ASSOCIATED WITH HUMAN DISEASE, METHODS OF DETECTION AND USES THEREOF) - sequence listing, part 95

SEQ ID NO: 88776 - DNA, 601 bp, Human
ttcaaatattcagaaaagttgaaaaaattttgcagtgtatatctatatatctgccatctagattctacaaggaacattttgccctgtgtcttttattacgttactccatctgtctgtccatcctttaattcattcaagttgtttcatgtattagcagtttgttcttttcattgctgagtaagattccattatttgaatataccaccatttggatatcctgttgctggacacctgggctatttaattttttttctattgtaagtaaagctgctgtggctgggcatgaaggcttatgcctatwaccctaccacttttggaggctgaggtgggaggatagtttgagctcaggagttgagaccagcctaagcaacatggtgaaaacccatctctacaacaaataaaagaagtagccagacatggtgacacatgcctgtagtcccagctactcgggaagttgagttgggaggattgcttgagcttggggtgtggaggctgcagtgagccatgattacatgactgcactctagcctgggtgacagagggagaccctgtcttaaaaattaaaaataaataaagctgctataaaaattcttacataagt

SEQ ID NO: 88777 - DNA, 601 bp, Human
attacatgactgcactctagcctgggtgacagagggagaccctgtcttaaaaattaaaaataaataaagctgctataaaaattcttacataagtctttttgtgcacaggtggttttatttctcttaggaaatacctaggagtagatttattgggtcataaggtaagtgaatgtgttatgagaaactgctgagcctttttccaaagtggttgtaccattttatacttcatcagcagtgtatgggagttccagttgctccacatcctaccaacttttggtgttgtcagtcttttacatttagytgttgggtgtgcagtggtatctcattatggttttaatttgctttgctctgatgactaatgatgcaaagcatctttttacatgcttattgaccattggtatatattcctttgaagtatatgttcaaattttctgtctttttaaaaattgaattgcttttaaattattaattcatagcccatattttaagttcaatcatgtggaatcatgtgtaggctaagtgttataataataaatctcaacatgtatcatggtataaacatattagaaatttatggccgggtgcagtgactcacacctat

SEQ ID NO: 88778 - DNA, 601 bp, Human
gaatgtgttatgagaaactgctgagcctttttccaaagtggttgtaccattttatacttcatcagcagtgtatgggagttccagttgctccacatcctaccaacttttggtgttgtcagtcttttacatttagttgttgggtgtgcagtggtatctcattatggttttaatttgctttgctctgatgactaatgatgcaaagcatctttttacatgcttattgaccattggtatatattcctttgaagtatatgttcaaattttctgtctttttaaaaattgaattgcttttaaattattrattcatagcccatattttaagttcaatcatgtggaatcatgtgtaggctaagtgttataataataaatctcaacatgtatcatggtataaacatattagaaatttatggccgggtgcagtgactcacacctataatccagcactttgggaggctgaggtgggcggatcacctgaggtcaggagttcaaaactagcctgaccaatatggagaaaccctgtctctactaaaaatacaaaattagctgggcgtggtggcacatgcctgtaatcccagctgcttgggaggctgaggcaggataa

SEQ ID NO: 88779 - DNA, 601 bp, Human
tcagtcttttacatttagttgttgggtgtgcagtggtatctcattatggttttaatttgctttgctctgatgactaatgatgcaaagcatctttttacatgcttattgaccattggtatatattcctttgaagtatatgttcaaattttctgtctttttaaaaattgaattgcttttaaattattaattcatagcccatattttaagttcaatcatgtggaatcatgtgtaggctaagtgttataataataaatctcaacatgtatcatggtataaacatattagaaatttatggccgggygcagtgactcacacctataatccagcactttgggaggctgaggtgggcggatcacctgaggtcaggagttcaaaactagcctgaccaatatggagaaaccctgtctctactaaaaatacaaaattagctgggcgtggtggcacatgcctgtaatcccagctgcttgggaggctgaggcaggataatcacttgaaccctggaggcggaggttgcagtaagccgagatcctgccattgcactccagcctgggcaacaagagtgaaactccatctcaaaaagaaaaaaaaagaaatgtattcc

SEQ ID NO: 88780 - DNA, 601 bp, Human
tcaatcatgtggaatcatgtgtaggctaagtgttataataataaatctcaacatgtatcatggtataaacatattagaaatttatggccgggtgcagtgactcacacctataatccagcactttgggaggctgaggtgggcggatcacctgaggtcaggagttcaaaactagcctgaccaatatggagaaaccctgtctctactaaaaatacaaaattagctgggcgtggtggcacatgcctgtaatcccagctgcttgggaggctgaggcaggataatcacttgaaccctggaggcggargttgcagtaagccgagatcctgccattgcactccagcctgggcaacaagagtgaaactccatctcaaaaagaaaaaaaaagaaatgtattcctttcctacatgaatggcccaaagtggtttgaggttgaaggaggtgggtgggtgctctgcttcccacagttattgagggcaccaggctgaaggaagctcccccttggtcaaacatggcttttatgggcgtcactgtccagcacagaaggctcaagagcgtggagaagggtatatgagtgtgggaaggtttagggtccagggtcactgcc

SEQ ID NO: 88781 - DNA, 601 bp, Human
ggaagctgactctactatattatccaaagcgtacatttcatatttggtgaaaatctgtccagccattttcttgtgatgcggcaatggacatgcaacataatttctttttaaagaatatgtcatttttactttctgacattaagatattctgttagaaaattatgacagtaacagatggtattaaaaaaaaatctccccttgcttggtaaatgcttttatctaagtgggcagctttgtgctaatatgatgtcttccacttcccaattagttgtgatgctttactgatctaggagagctttayggtttgggactactataggcgaacactctgttgcctcctctctcaagaatcagagtgtcctattttggaaacacagtcaaccatgtgaaagcaatttattgggcgtatcttctgtggtcagatttggtttgctgacaggtgaattgggagttttgtaaactttaataagtgagcattgagtcagatgtgttcatgagtatgacctcgatccacttaaaaattcttatttctttttctctcttggcaggagggaggtggttgtgcaggtattcccagccactttgaagggaacttaaatgg

SEQ ID NO: 88782 - DNA, 601 bp, Human
acacagtcaaccatgtgaaagcaatttattgggcgtatcttctgtggtcagatttggtttgctgacaggtgaattgggagttttgtaaactttaataagtgagcattgagtcagatgtgttcatgagtatgacctcgatccacttaaaaattcttatttctttttctctcttggcaggagggaggtggttgtgcaggtattcccagccactttgaagggaacttaaatgggaactttattgctcactgcttagaatgccatgggctcttcttttgagatacttacctttaacccatttcctttttttttttttaagtgcagcttgctgccagtgctcttttcttgggggtaaatgggaaatgttaataagtagcctctgatccctttaaaatgggagaatttgaacatttcaaaccttacctttttatacagttctcttattacctgggagagaggttaagtcttagactatccatttctgtcagtgagttgcctatgcattatagcctgtgagggtctatatttttttagggtaatcctggtaataactgcattgatgttacactgctaacatttgggatggagaaggggtgactgagtg

SEQ ID NO: 88783 - DNA, 601 bp, Human
ggtggaggttacagtgagctgagaccatgccactgcactccagcctgggcaatagagcgagactccatctcaaaaaaaaaaaaaaaaaaaaaaaaaaagaaaaacagtgacataaacaggcaattacaatattttgttatatggggcacaagaagatgcccttggccctgcttcatgagtggtgtggggcagggtagagagagcagttcaggagaggtacgtatggatgtcatgggagctagcagccaggaagatgtaaacatgttaacaaggacctctccagagagaggtcttaaaattrtccagccatagagaagcttttctctctttaaaaatattctggctctaaagttattcattgagttaaaaacaataattgcaagttggaggaaatctctttgcctgtccttacgtgttacatgtaacaagtaaacctgtgccacaacactgacatctctgcaaagttacttaagttttctgagtttgtagtatcgcccattaaatgggattaataatattgatctctggattattgacaggcttaagtgagataacttgcgtggtccattttctagccccaccctctcatttcatctagtaa

SEQ ID NO: 88784 - DNA, 601 bp, Human
acgtatggatgtcatgggagctagcagccaggaagatgtaaacatgttaacaaggacctctccagagagaggtcttaaaattgtccagccatagagaagcttttctctctttaaaaatattctggctctaaagttattcattgagttaaaaacaataattgcaagttggaggaaatctctttgcctgtccttacgtgttacatgtaacaagtaaacctgtgccacaacactgacatctctgcaaagttacttaagttttctgagtttgtagtatcgcccattaaatgggattaataatatygatctctggattattgacaggcttaagtgagataacttgcgtggtccattttctagccccaccctctcatttcatctagtaaatcttcattgcattaattattttcatcttaaatacaccgcatcctgctcctcaccttctaatattaatactctgtctttcagtttagatcagttcctcttatccaatgttgcgctaaacatcccctgaagttgggggatcttttcctttctagtttttgctccctggcttcccttttctgttgctgactgttgaagctttcctgccccactggctttg

SEQ ID NO: 88785 - DNA, 601 bp, Human
aacaaggacctctccagagagaggtcttaaaattgtccagccatagagaagcttttctctctttaaaaatattctggctctaaagttattcattgagttaaaaacaataattgcaagttggaggaaatctctttgcctgtccttacgtgttacatgtaacaagtaaacctgtgccacaacactgacatctctgcaaagttacttaagttttctgagtttgtagtatcgcccattaaatgggattaataatattgatctctggattattgacaggcttaagtgagataacttgcgtggtccrttttctagccccaccctctcatttcatctagtaaatcttcattgcattaattattttcatcttaaatacaccgcatcctgctcctcaccttctaatattaatactctgtctttcagtttagatcagttcctcttatccaatgttgcgctaaacatcccctgaagttgggggatcttttcctttctagtttttgctccctggcttcccttttctgttgctgactgttgaagctttcctgccccactggctttgaaggtaaattgtatatacatgagcttgtggggaaagctgttatataaa

SEQ ID NO: 88786 - DNA, 601 bp, Human
aattgcaagttggaggaaatctctttgcctgtccttacgtgttacatgtaacaagtaaacctgtgccacaacactgacatctctgcaaagttacttaagttttctgagtttgtagtatcgcccattaaatgggattaataatattgatctctggattattgacaggcttaagtgagataacttgcgtggtccattttctagccccaccctctcatttcatctagtaaatcttcattgcattaattattttcatcttaaatacaccgcatcctgctcctcaccttctaatattaatactctrtctttcagtttagatcagttcctcttatccaatgttgcgctaaacatcccctgaagttgggggatcttttcctttctagtttttgctccctggcttcccttttctgttgctgactgttgaagctttcctgccccactggctttgaaggtaaattgtatatacatgagcttgtggggaaagctgttatataaatgaggacaattgatctaactgttagagtggggaaatggaagagattctgaagcctccatttgtaacttaaaaactcaggtttcatttcttaacaggattgatgttaag

SEQ ID NO: 88787 - DNA, 601 bp, Human
attcccactcttaatagtcagtgtcatcaggaaagaccacctcaagctttagtactttattcatttatccaactctgcacctgctgcctttgggtgtggtatttattcttgaccatatcaccctgacccggtaaccagaagggaacatgtgatgtgctctcatctctgccttaggggcagctccctccccacgttaagaatgctggcatgtaaataacactctcatctgtttagcgttccttttactgagcttcttggtatcttttctcatacttgtaccttttatgggatgtcccccccttttttttttttgagacggagtttcgctgctgttgcccaggctggagtgcaatggcacgatctcagctcaccgcaacctccgcctgctgggttcaagcgattctcctgcctcagcctcccgagtagctgggactacagtcacccctccactgcacctggtactaattttgtatttttagtagagacagggtttctccatgttggtcaggctggtctcgaactcctgatctcaggtgatccacctgctgcagcctcccgaagtgttgggattacaggtgtgagccaccgcgcccagcctgga

SEQ ID NO: 88788 - DNA, 601 bp, Human
agtgcaatggcacgatctcagctcaccgcaacctccgcctgctgggttcaagcgattctcctgcctcagcctcccgagtagctgggactacagtcacccctccactgcacctggtactaattttgtatttttagtagagacagggtttctccatgttggtcaggctggtctcgaactcctgatctcaggtgatccacctgctgcagcctcccgaagtgttgggattacaggtgtgagccaccgcgcccagcctggatgtccctttattttttaaaggcttccttaaataccttgtttgtawgttgaaaagagcatttaaagagtgaacagatttggtttgctctggctctctaattattttaactttgttatcacccaatagttctaggttagtggttttcaatcctagcttgaacaggagtcatttaaaaatagcccaggcctcacccagggcacttctatcagacatctctaggggggatggcccaggcatcaggaggctttaaaaagctcctcaggtgattttagtgcattgccaaggttgaaaaccaaggctttaggtttaaactaaaggtgaaattgctctttttctggttcattt

SEQ ID NO: 88789 - DNA, 601 bp, Human
gtatgttgaaaagagcatttaaagagtgaacagatttggtttgctctggctctctaattattttaactttgttatcacccaatagttctaggttagtggttttcaatcctagcttgaacaggagtcatttaaaaatagcccaggcctcacccagggcacttctatcagacatctctaggggggatggcccaggcatcaggaggctttaaaaagctcctcaggtgattttagtgcattgccaaggttgaaaaccaaggctttaggtttaaactaaaggtgaaattgctctttttctggttcrttttctactttagaaagtagaaattttttttctggttcattttctactttaaattaaaaataaacctacagagggtaacacgtattagcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctt

SEQ ID NO: 88790 - DNA, 601 bp, Human
aataaacctacagagggtaacacgtattagcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctttgctccttctgctgcgaggtcatgttctcacagccagtgaagtgacagcatatatgtgytgaatgtgtggcttgcattttacatttagctcttttaattcatgtgttaaccttaggaggtacttattattctattttgcagatgaaaatggagactcataaataagtaacttaccagcagctacatagctggtaattggtagaactggaagttggacccaggctctagtgctggcactcatagtttctccctgctgccatgttggcctcttcctacttggatgaagatataactctagtggcaagggcatttactagtgtgtgagagggtcttgtttattagttttgcaaattgcacgg

SEQ ID NO: 88791 - DNA, 601 bp, Human
gcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctttgctccttctgctgcgaggtcatgttctcacagccagtgaagtgacagcatatatgtgttgaatgtgtggcttgcattttacatttarctcttttaattcatgtgttaaccttaggaggtacttattattctattttgcagatgaaaatggagactcataaataagtaacttaccagcagctacatagctggtaattggtagaactggaagttggacccaggctctagtgctggcactcatagtttctccctgctgccatgttggcctcttcctacttggatgaagatataactctagtggcaagggcatttactagtgtgtgagagggtcttgtttattagttttgcaaattgcacggtctcctttattcaatatcttttttcaaac

SEQ ID NO: 88792 - DNA, 601 bp, Human
catagtttctccctgctgccatgttggcctcttcctacttggatgaagatataactctagtggcaagggcatttactagtgtgtgagagggtcttgtttattagttttgcaaattgcacggtctcctttattcaatatcttttttcaaacagctcacagatcttttgtggttttgtaagtgcctactccccaccgtattgccttctagagaagaggcaggaatttattttaatgtacaggacagacatgcatggggagtaaaactacagactccactctaggtgtgtggaaatactaaaamtagtgcttttctctgtgtgtgaagttggtctgttgagttttgtcatagacagcgttgagttcctctcccaggtggaggtggcgtagctttgcgtcacttacgtgtctctcctgatttccagtgacccggggaagacactgcagaggcagttgtctgtggtcaaaagtattctctgaccatggaactagatgaagctatgagcttccaggatcatgtggggctagaagaatgccgctctaaccctagaggagggacagctgagtgtcttctgatgtaactgaaattggagaatcaggtgga

SEQ ID NO: 88793 - DNA, 601 bp, Human
ggacatttcactgttaagcttgtaggacgcttttgggcacctctctgactgggagctttgcagaacccagtggctttctctggagcaggtgctgagcacattttcaggctccaaaatcatctttctgctcttcagagcaagtttcttagcagattagtgttgagatttgtcaagggtttctggggcatcactaaaagtttcaggcaatggcccatcctgtcagattttagtactttggacacaggaaattaaaaaagagggcagatggtataaacattgcaaagctatgtacccgtgacartgtaaatgaaaggtttgattgtgctaactctcctgcactttctttctgtgttcctgtagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggtaagtgctgtgtttatttgctgtaaaaagattgtttcacagcacctgggtcaagtgttatttcccaaa

SEQ ID NO: 88794 - DNA, 601 bp, Human; identical to SEQ ID NO: 23204

SEQ ID NO: 88795 - DNA, 601 bp, Human; identical to SEQ ID NO: 23205

SEQ ID NO: 88796 - DNA, 601 bp, Human; identical to SEQ ID NO: 23206

SEQ ID NO: 88797 - DNA, 601 bp, Human; identical to SEQ ID NO: 23207

SEQ ID NO: 88798 - DNA, 601 bp, Human; identical to SEQ ID NO: 23208

SEQ ID NO: 88799 - DNA, 601 bp, Human; identical to SEQ ID NO: 23209

SEQ ID NO: 88800 - DNA, 601 bp, Human; identical to SEQ ID NO: 23210

SEQ ID NO: 88801 - DNA, 601 bp, Human; identical to SEQ ID NO: 23211

SEQ ID NO: 88802 - DNA, 601 bp, Human; identical to SEQ ID NO: 23212

SEQ ID NO: 88803 - DNA, 601 bp, Human; identical to SEQ ID NO: 23213

SEQ ID NO: 88804 - DNA, 601 bp, Human; identical to SEQ ID NO: 23214

SEQ ID NO: 88805 - DNA, 601 bp, Human; identical to SEQ ID NO: 23215

SEQ ID NO: 88806 - DNA, 601 bp, Human; identical to SEQ ID NO: 23216

SEQ ID NO: 88807 - DNA, 601 bp, Human; identical to SEQ ID NO: 23217

SEQ ID NO: 88808 - DNA, 601 bp, Human; identical to SEQ ID NO: 23218

SEQ ID NO: 88809 - DNA, 601 bp, Human; identical to SEQ ID NO: 23219

SEQ ID NO: 88810 - DNA, 601 bp, Human; identical to SEQ ID NO: 23220

SEQ ID NO: 88811 - DNA, 601 bp, Human; identical to SEQ ID NO: 23221

SEQ ID NO: 88812 - DNA, 601 bp, Human; identical to SEQ ID NO: 23222

SEQ ID NO: 88813 - DNA, 601 bp, Human; identical to SEQ ID NO: 23223

SEQ ID NO: 88814 - DNA, 601 bp, Human; identical to SEQ ID NO: 23224

SEQ ID NO: 88815 - DNA, 601 bp, Human; identical to SEQ ID NO: 23225

SEQ ID NO: 88816 - DNA, 601 bp, Human; identical to SEQ ID NO: 23226

SEQ ID NO: 88817 - DNA, 601 bp, Human; identical to SEQ ID NO: 23227

SEQ ID NO: 88818 - DNA, 601 bp, Human; identical to SEQ ID NO: 23228

SEQ ID NO: 88819 - DNA, 601 bp, Human; identical to SEQ ID NO: 23229

SEQ ID NO: 88820 - DNA, 601 bp, Human; identical to SEQ ID NO: 23230

SEQ ID NO: 88821 - DNA, 601 bp, Human; identical to SEQ ID NO: 23231

SEQ ID NO: 88822 - DNA, 601 bp, Human; identical to SEQ ID NO: 23232

SEQ ID NO: 88823 - DNA, 601 bp, Human; identical to SEQ ID NO: 23233

SEQ ID NO: 88824 - DNA, 601 bp, Human; identical to SEQ ID NO: 32658

SEQ ID NO: 88825 - DNA, 601 bp, Human; identical to SEQ ID NO: 32659

SEQ ID NO: 88826 - DNA, 601 bp, Human; identical to SEQ ID NO: 32660

SEQ ID NO: 88827 - DNA, 601 bp, Human; identical to SEQ ID NO: 32661

SEQ ID NO: 88828 - DNA, 601 bp, Human; identical to SEQ ID NO: 32662

SEQ ID NO: 88829 - DNA, 601 bp, Human; identical to SEQ ID NO: 32663

SEQ ID NO: 88830 - DNA, 601 bp, Human; identical to SEQ ID NO: 32664

SEQ ID NO: 88831 - DNA, 601 bp, Human; identical to SEQ ID NO: 32665

SEQ ID NO: 88832 - DNA, 601 bp, Human; identical to SEQ ID NO: 32666

SEQ ID NO: 88833 - DNA, 601 bp, Human; identical to SEQ ID NO: 32667

SEQ ID NO: 88834 - DNA, 601 bp, Human; identical to SEQ ID NO: 32668

SEQ ID NO: 88835 - DNA, 601 bp, Human; identical to SEQ ID NO: 32669

SEQ ID NO: 88836 - DNA, 601 bp, Human; identical to SEQ ID NO: 32670

SEQ ID NO: 88837 - DNA, 601 bp, Human; identical to SEQ ID NO: 32671

SEQ ID NO: 88838 - DNA, 601 bp, Human; identical to SEQ ID NO: 32672

SEQ ID NO: 88839 - DNA, 601 bp, Human; identical to SEQ ID NO: 32673

SEQ ID NO: 88840 - DNA, 601 bp, Human; identical to SEQ ID NO: 32674

SEQ ID NO: 88841 - DNA, 601 bp, Human; identical to SEQ ID NO: 32675

SEQ ID NO: 88842 - DNA, 601 bp, Human
gagacggggctggcacggaatggtagcaagtcatctaggctctgaggcatctttttaaccctgaaaacgtccacttggagggcaagagccaaatctaaaaaattattatacacactgtctctcagctcaaatatgtatgctctcactccaagttcagatcacaatttacaattccgcattttgtaattgttaagtgcagtctggcttccccaaagacctcaagctcattctgcccaggattaaatccaagagccttcttagcccagtttctggcatgcaggaagcatacaataatggaagraatgaatgaatgaacaaatgaattaatgaaacccaccttacctgcctctccactagctactgcaagttcaggttgaaaaatatcttcttttcagagcagttgttactgaaagaaaatgagaggaaccctctggtttagacagctagaagtagaaaggagaaagagagagaaaaaaaattcttatcttcagttagagaaatgtttccacaggtccttgataaactagggaaaaagacccccagggctttctgatagcaggcgggtgtccttgatagcgtgacgggtggggcaggcggaact

SEQ ID NO: 88843 - DNA, 601 bp, Human
atattgttccagggagctcacggtcttctcaggttcatctgtggaaccattcgacaaccaaatgttatggggaagccagtctcatgagctccaacacattcttcagtgcaatcagtggcaatccctgcccacttaggacttttcgaatagtgctcatccctgacttctggataaacttctttgcagaagcccatttgactccaaggacagaaaaaaagagtgcaggttgttattatgcaaagccacagcattaaggagctcaatattcttctagatatctggcctcctgtctgagaatccmatacttagagtatagcaggtcccatctccatttgggatggtggtggtggaaaagggggcgtctctgatgagcagagcatctttaatgcctgctcaggccagagcccctttccaaagacttcgagactgccgtgggcctgctgactcctctcacgctttcaagctacagtgcttcccatcacattgcagaaggccgccttgggtcatatctcgcaaaggaagagctattaacaaatattccatttgtatttcctgcgtggccctccatctggaaatatcttttatctggcaacttttgcaa

SEQ ID NO: 88844 - DNA, 601 bp, Human
cctacatgcaaaattttacatattgttccagggagctcacggtcttctcaggttcatctgtggaaccattcgacaaccaaatgttatggggaagccagtctcatgagctccaacacattcttcagtgcaatcagtggcaatccctgcccacttaggacttttcgaatagtgctcatccctgacttctggataaacttctttgcagaagcccatttgactccaaggacagaaaaaaagagtgcaggttgttattatgcaaagccacagcattaaggagctcaatattcttctagatatctgscctcctgtctgagaatccaatacttagagtatagcaggtcccatctccatttgggatggtggtggtggaaaagggggcgtctctgatgagcagagcatctttaatgcctgctcaggccagagcccctttccaaagacttcgagactgccgtgggcctgctgactcctctcacgctttcaagctacagtgcttcccatcacattgcagaaggccgccttgggtcatatctcgcaaaggaagagctattaacaaatattccatttgtatttcctgcgtggccctccatctggaaatatcttt

SEQ ID NO: 88845 - DNA, 601 bp, Human
acacatgatatatatatatcatatatacacatgatatatatatatcatatatacacatgatatatatatcatatatacacatgatatatatatcatatatacacatgatatatatatcatatatacacatgatatatatatcatatatacacatgatatatatatcatacatacacatgatatatatcatatatatcatatatatacatatcatatatatacatgcaaacacatatgattccaccttaaagagaaaggaaattctgacataagctacaacatgaaagaaatttgaagacaytgagtgatataagccagtcctgagaggacaaagactatatatgattctacttttgtgaagtacttaaacaaatacatagagacagaaagtcgaatggtggttgccaggagctagggggaggggatagttattgtttaatggacaaaacatttcagttggaaaacattaaaaagttctagagctatatagtggtgatggtcacccaacaatatttatgtgcttaatgccactgaactgtacccttgggagtggttaaatgttaaattttacgatgtacgtatttaacccccacacgcccca

SEQ ID NO: 88846 - DNA, 601 bp, Human
gaaattctatgtgtgattctgtcattctagcaggtcgagaccaaatttcccatgcttccattaaaggcaccctgtaatcctgctcactccattgatccaactttacatcccacagtcctggaccctgaaccttcccatccagcctgttctcctctctgatcttaaatatcctgcttgtgccatttctgtgcactgtgttactcttttctctctatcggggatgtctgctttctccctgttctaaagctttggtactagaatagtagagtgattaagagtagaggctttgagataaataaamctggcttcaagtctctgctttacaacttactatctgggtcatcttaggaaaatctctgagcttcagtgctttgaatgataaaatacagacaatgataaatgtagggttaggagtagtcattgagataatgtatgcagtgggcagagcacagtgcttggaacatagtaggtgctcagtaaatggcaatgattattgcagttagtacaaattcctctccagtcttctctgcttctccaaatcttgtccaatgtggacccagatcaagctacatctttaccctgaaggtttctctgtcccctg

SEQ ID NO: 88847 - DNA, 601 bp, Human
tgtacaaatggcagcaccattccccttggccaaagcatgcctgcatgatgccctctgggtgaaagtgtagaaggaacttcaaggtcctttgtttttcttgagcatcattactgggagaagaataatggtccagataccatttatatttggaaccaagagtttggtttgggaaagagatcaggctcttggctcccaggaacagagaaacaggtggtgtctggaattaacaaggccactctttgaagcctgactctccactgcagaacctctaccctctacaaggactaaagtgtagaatgcrgtcaatcatatgagtaaaagcaaaggctttggagagagaaaggcttgtgtttgagtcttggctcctttaagtacatggttttaggcaaattatttaacagccctgaacctcagtttcatcatgtgcaaaacagggataacaatatcttcattatggggttgtaggaataaaatgaaatcatgcatgccaaatgctgagcccagtgatcaacatagaataagtgctcaatggatggcagctattattagaattaactaagcaaagagaacctcagaggacaatagtcaaccagggcagggc

SEQ ID NO: 88848 - DNA, 601 bp, Human
tttttgcttattacatttacaattgttttctaagggaacagcagtttcaagtgactaaggttacattcctttgctaaaatggacttctgatagaaatgaaaatgcaaatataattgagaagatcccaacattatgataatttacctctctttttttttcaaccattagaagccaagttgcaacatatgctttgtcacttgtgacattcatatacaaaaatatgacattttgtttctaaatgtggcattcaggaacaaaaataaagacctgtcttaatagggtttcggctcccatggagaatttttttaaactattcggttgtcacaggcatcctgtgctcagactcatttcagaacatttcagggccagctgacagataagttttcacagatgtaaggcctattagtaaccttagtgataaacagattcggttttctatatagtaaagagcccaaaatacatcttttaaaaaatccatttcaaccgagccttaggatgagcatagaagctcagctgtttgctagctgcgtgatctgggggaatttacttcacttctctgaacctcagtttctgtacctatcaaatggaggatggaggcaat

SEQ ID NO: 88849 - DNA, 601 bp, Human
tccttgcaaatcttaaatatcctaaaatctagaaaatgttcaagttttccttcctgaataagaatgctagaagaagaatgaatcaatctacacgatggctctgaccccagatggatcatttttttcccctgtgggcattttctatcctttttgcttattacatttacaattgttttctaagggaacagcagtttcaagtgactaaggttacattcctttgctaaaatggacttctgatagaaatgaaaatgcaaatataattgagaagatcccaacattatgataatttacctctcttttyttttcaaccattagaagccaagttgcaacatatgctttgtcacttgtgacattcatatacaaaaatatgacattttgtttctaaatgtggcattcaggaacaaaaataaagacctgtcttaatagggtttcggctcccatggagaatttttttaaactattcggttgtcacaggcatcctgtgctcagactcatttcagaacatttcagggccagctgacagataagttttcacagatgtaaggcctattagtaaccttagtgataaacagattcggttttctatatagtaaagagccca

SEQ ID NO: 88850 - DNA, 601 bp, Human
gaccttattgtatcctcccttaacaactagtacatgccttatgcagaagagagactcaggaactatgaggtgattgggacatgtaaaacggttcttttaaaagttgagaaaatctctatttgatccctgccagtgggactgaaatttcattccttttccctttcccccaattccttgcaaatcttaaatatcctaaaatctagaaaatgttcaagttttccttcctgaataagaatgctagaagaagaatgaatcaatctacacgatggctctgaccccagatggatcatttttttcccctgtgggcattttctatcctttttgcttattacatttacaattgttttctaagggaacagcagtttcaagtgactaaggttacattcctttgctaaaatggacttctgatagaaatgaaaatgcaaatataattgagaagatcccaacattatgataatttacctctctttttttttcaaccattagaagccaagttgcaacatatgctttgtcacttgtgacattcatatacaaaaatatgacattttgtttctaaatgtggcattcaggaacaaaaataaagacctgtcttaatagggtt

SEQ ID NO: 88851 - DNA, 601 bp, Human
atttagaatcaagtctcaaaatgtgtttttattatgaataattttaaagcaatcatgaccttattgtatcctcccttaacaactagtacatgccttatgcagaagagagactcaggaactatgaggtgattgggacatgtaaaacggttcttttaaaagttgagaaaatctctatttgatccctgccagtgggactgaaatttcattccttttccctttcccccaattccttgcaaatcttaaatatcctaaaatctagaaaatgttcaagttttccttcctgaataagaatgctagaagaagaatgaatcaatctacacgatggctctgaccccagatggatcatttttttcccctgtgggcattttctatcctttttgcttattacatttacaattgttttctaagggaacagcagtttcaagtgactaaggttacattcctttgctaaaatggacttctgatagaaatgaaaatgcaaatataattgagaagatcccaacattatgataatttacctctctttttttttcaaccattagaagccaagttgcaacatatgctttgtcacttgtgacattcatatacaaaaatatgacat

SEQ ID NO: 88852 - DNA, 601 bp, Human
ctggtccctgtgtcccaaggcttgggtccctaatgggtataatcaaaagctgtgtgtgtgtgtgtgtgtgtgtgtgtgtgtgtgtgtgtcccaaaggaagccttaagagcaaatttttgtcctagtggagacttcagtatacaaaaagactttttcggctgtgctcggtggctcatgcttgtgatcccagcactttgggagacccaggctagcctgagcaacacagtgagaccctgtttctacaaaaaataaaaaataaaaataattagctgggcgtggtggtgcttgcctgaaatcctakctactcgggaggcggaggtgggaggattgcttgagcccaggaggttgaggctgcagtgagccatgatcgcaccattgccccccagtctggggaacagagtgagaccctgtctcaaaaaaaaaaaaaaaaaaaaaaagttgggttttttttttccgatagacccttgtttttaatttaaaaaagaaaatacttagaatttaggcaagcctaaactatgtgataaatatgtaacctaccacactactttcatttctaacagaaatgaaaataaatatataggttgtgatgaacagtttacct

SEQ ID NO: 88853 - DNA, 601 bp, Human
atacatttctgttcccattttaagtataaccagagtttactactgcctgcatgctcttgtcattttctggtccctgtgtcccaaggcttgggtccctaatgggtataatcaaaagctgtgtgtgtgtgtgtgtgtgtgtgtgtgtgtgtgtgtgtcccaaaggaagccttaagagcaaatttttgtcctagtggagacttcagtatacaaaaagactttttcggctgtgctcggtggctcatgcttgtgatcccagcactttgggagacccaggctagcctgagcaacacagtgagacccygtttctacaaaaaataaaaaataaaaataattagctgggcgtggtggtgcttgcctgaaatcctagctactcgggaggcggaggtgggaggattgcttgagcccaggaggttgaggctgcagtgagccatgatcgcaccattgccccccagtctggggaacagagtgagaccctgtctcaaaaaaaaaaaaaaaaaaaaaaagttgggttttttttttccgatagacccttgtttttaatttaaaaaagaaaatacttagaatttaggcaagcctaaactatgtgataaatatgtaacct

SEQ ID NO: 88854 - DNA, 601 bp, Human
agagaaagaaggcggacttgatttgggggttcaggcttccccctctcagcctccttctagaaagaggcaggaacgcagaggggaagcgggggaggctagtagtttgcccttccgtggagaaaaacttaggctctcctgggcctcagagttccttgaaaatatctgcgttcagaagctgaaaggcctatttgtgcgtgatgccagtcattaaggcttgtaaagagggaacgtactttcaggatccatggttttatatgatcagtctggatcataggcatacatttctgttcccattttaagkataaccagagtttactactgcctgcatgctcttgtcattttctggtccctgtgtcccaaggcttgggtccctaatgggtataatcaaaagctgtgtgtgtgtgtgtgtgtgtgtgtgtgtgtgtgtgtgtcccaaaggaagccttaagagcaaatttttgtcctagtggagacttcagtatacaaaaagactttttcggctgtgctcggtggctcatgcttgtgatcccagcactttgggagacccaggctagcctgagcaacacagtgagaccctgtttctacaaaaaataaaaaataa

SEQ ID NO: 88855 - DNA, 601 bp, Human
gaaaggaggctgggcaaccactaaatcattcttcagggcttcccctcttccgcctttcccttttggtttaactaaggcagaaagtaacccacgaacagctcgagcaagcaagaaaagacaagaatgtgaaataagcacctacagaaatgcaagtgttcccagtggattttccgcccgtcccaggttcgaggtcccaggtccacggacgccgtgcactgggatgccccggacagcgcggctctgcgggctgcgggctacgggctgcgggccccaggctgcgggctccgggctgcgggctccrggctgcggccgcgctctgcagaggcgatggtggtgcgccagccgggactgcacgggctggggacgcctagagcagagccagggcagctaatcccagagggagggtggctgggagggaccacgcggggccggggctcctctcagtcggctggtggcggaatcccctccctctgcacctttcagaaagcggactcctgcggttaaactgccccccatgtaaagtgccagtagtatcccgaccagagaaagtgctttttcaatggtcaagaacaggatcagagagattattttgccctgggtc

SEQ ID NO: 88856 - DNA, 601 bp, Human; identical to SEQ ID NO: 32676

SEQ ID NO: 88857 - DNA, 601 bp, Human; identical to SEQ ID NO: 32677

SEQ ID NO: 88858 - DNA, 601 bp, Human; identical to SEQ ID NO: 32678

SEQ ID NO: 88859 - DNA, 601 bp, Human; identical to SEQ ID NO: 32679

SEQ ID NO: 88860 - DNA, 601 bp, Human; identical to SEQ ID NO: 32680

SEQ ID NO: 88861 - DNA, 601 bp, Human; identical to SEQ ID NO: 32681

SEQ ID NO: 88862 - DNA, 601 bp, Human; identical to SEQ ID NO: 32682

SEQ ID NO: 88863 - DNA, 601 bp, Human; identical to SEQ ID NO: 32683

SEQ ID NO: 88864 - DNA, 601 bp, Human; identical to SEQ ID NO: 32684

SEQ ID NO: 88865 - DNA, 601 bp, Human; identical to SEQ ID NO: 32685

SEQ ID NO: 88866 - DNA, 601 bp, Human; identical to SEQ ID NO: 32686

SEQ ID NO: 88867 - DNA, 601 bp, Human; identical to SEQ ID NO: 32687

SEQ ID NO: 88868 - DNA, 601 bp, Human; identical to SEQ ID NO: 32688

SEQ ID NO: 88869 - DNA, 601 bp, Human
caaaggttgggacccatgtggtcatgccctgggctctttcaaagcactgcctctagaccagacaacgctattggcttcctgactaccaaaccaataattacaaaagacctctccattatgtacaacccagaccaaagttaaagaaaataacaagaagtgctttggggggtggggggaaaggtagcttgaaagatctttttttttacatagaaatgagattttgaataattcttcaaatccaaaaccactaggcaatggtgtataccaagagaatggtacgcacgctttcaatctctcaatwacttccttggaaaggtaaggggtcaggcaggtaacatgagaaaagtagtctcagaacagactgtgcccaacctgaaaggcatatgccctatctcaggagatggccattcctcagccccagttaacccctgccctgctggactaagaggtatggcctagtaactacaggcatggatcccagagccaggatgcttggtttgaaagcctagctttgccactcactggctgtaaaatcttgggcaattcacctactctttctgtgcctcagtttctatacctgtaaaatgaggctaagagtcac

SEQ ID NO: 88870 - DNA, 601 bp, Human
aggctcaattcaatatcccaaaggttgggacccatgtggtcatgccctgggctctttcaaagcactgcctctagaccagacaacgctattggcttcctgactaccaaaccaataattacaaaagacctctccattatgtacaacccagaccaaagttaaagaaaataacaagaagtgctttggggggtggggggaaaggtagcttgaaagatctttttttttacatagaaatgagattttgaataattcttcaaatccaaaaccactaggcaatggtgtataccaagagaatggtacgcaygctttcaatctctcaataacttccttggaaaggtaaggggtcaggcaggtaacatgagaaaagtagtctcagaacagactgtgcccaacctgaaaggcatatgccctatctcaggagatggccattcctcagccccagttaacccctgccctgctggactaagaggtatggcctagtaactacaggcatggatcccagagccaggatgcttggtttgaaagcctagctttgccactcactggctgtaaaatcttgggcaattcacctactctttctgtgcctcagtttctatacctgtaa

SEQ ID NO: 88871 - DNA, 601 bp, Human
caattcaaaaggcatccttagctcatcactgtttgcatctgctatgaaataaatatcagccccactcctagagggacaagaccagtcgctgtttcagtaaagagcgtaagttaagtcgcaaccctaaacagccacacctgaaggctgcaaaagaaaacataaattccagggcctgctataagctcagctacatttgccactacaaagcacatacccaaggctcaattcaatatcccaaaggttgggacccatgtggtcatgccctgggctctttcaaagcactgcctctagaccagacaaygctattggcttcctgactaccaaaccaataattacaaaagacctctccattatgtacaacccagaccaaagttaaagaaaataacaagaagtgctttggggggtggggggaaaggtagcttgaaagatctttttttttacatagaaatgagattttgaataattcttcaaatccaaaaccactaggcaatggtgtataccaagagaatggtacgcacgctttcaatctctcaataacttccttggaaaggtaaggggtcaggcaggtaacatgagaaaagtagtctcagaacagactgtg

SEQ ID NO: 88872 - DNA, 601 bp, Human
cacatctccactcaaagaataacttctttctgtaatagttgctgtccttcttaaggcattgcctcttaaattctttaagattctttaagaatttaagattcttacattattttttcttcagagacactaggttatcttgctttctttgaatgaaattattgaagacacttactggagcaaaaaaaaaaaacaaaacaaaaataaaaagcaaaggaaggatccatgaaattttaaggaaatgtggattaattgcaaaatatggataatacaaaacacagtacaattagatgacaaaaaaaamctaaaaactcagtaacagcataaaatcaaaacttctctaagttccagttttttcatctctaaaatgagataatattccctaggggattttcaaggatgaaatgaagtcatatatatatagccacataagcttggctgatcctatttatatttgtttatggtgatatggaacactgtagatatatgtcaattgcctcactcttaccaaattctatacttggtggagaaagcttttataatcaaaagagaatgaaatgccatgggaattgggattccctaaggattgaagggcttccaaagg

SEQ ID NO: 88873 - DNA, 601 bp, Human
ttgaatggcacatctccactcaaagaataacttctttctgtaatagttgctgtccttcttaaggcattgcctcttaaattctttaagattctttaagaatttaagattcttacattattttttcttcagagacactaggttatcttgctttctttgaatgaaattattgaagacacttactggagcaaaaaaaaaaaacaaaacaaaaataaaaagcaaaggaaggatccatgaaattttaaggaaatgtggattaattgcaaaatatggataatacaaaacacagtacaattagatgacaaaaaaaacctaaaaactcagtaacagcataaaatcaaaacttctctaagttccagttttttcatctctaaaatgagataatattccctaggggattttcaaggatgaaatgaagtcatatatatatagccacataagcttggctgatcctatttatatttgtttatggtgatatggaacactgtagatatatgtcaattgcctcactcttaccaaattctatacttggtggagaaagcttttataatcaaaagagaatgaaatgccatgggaattgggattccctaaggattgaagggct

SEQ ID NO: 88874 - DNA, 601 bp, Human
gtttgacatctacaaataggtttgacaatcattttcaattaactaaacttattctcacttttttatggtgacattttcttttgaatggcacatctccactcaaagaataacttctttctgtaatagttgctgtccttcttaaggcattgcctcttaaattctttaagattctttaagaatttaagattcttacattattttttcttcagagacactaggttatcttgctttctttgaatgaaattattgaagacacttactggagcaaaaaaaaaaaacaaaacaaaaataaaaagcaaargaaggatccatgaaattttaaggaaatgtggattaattgcaaaatatggataatacaaaacacagtacaattagatgacaaaaaaaacctaaaaactcagtaacagcataaaatcaaaacttctctaagttccagttttttcatctctaaaatgagataatattccctaggggattttcaaggatgaaatgaagtcatatatatatagccacataagcttggctgatcctatttatatttgtttatggtgatatggaacactgtagatatatgtcaattgcctcactcttaccaaattct

SEQ ID NO: 88875 - DNA, 601 bp, Human
gcacaccactatgcccagcccaactgtccttttaagtaaagattgagattaaacacaatctgcagcagttagctttccatgatatctaagagagaagaatgattttcttcttttctctgttttcttttacctatctcccttcatgtactactacttcttccatttgaaattatcttgtttgacatctacaaataggtttgacaatcattttcaattaactaaacttattctcacttttttatggtgacattttcttttgaatggcacatctccactcaaagaataacttctttctgtaatrgttgctgtccttcttaaggcattgcctcttaaattctttaagattctttaagaatttaagattcttacattattttttcttcagagacactaggttatcttgctttctttgaatgaaattattgaagacacttactggagcaaaaaaaaaaaacaaaacaaaaataaaaagcaaaggaaggatccatgaaattttaaggaaatgtggattaattgcaaaatatggataatacaaaacacagtacaattagatgacaaaaaaaacctaaaaactcagtaacagcataaaatcaaaacttct

SEQ ID NO: 88876 - DNA, 601 bp, Human
tggttattcacaggcattgttatagctagctcactgcagcccccaactcccacgctcaagagatcctctcgcctcagcctcccgaatagctaggactacaggtgcacaccactatgcccagcccaactgtccttttaagtaaagattgagattaaacacaatctgcagcagttagctttccatgatatctaagagagaagaatgattttcttcttttctctgttttcttttacctatctcccttcatgtactactacttcttccatttgaaattatcttgtttgacatctacaaataggtytgacaatcattttcaattaactaaacttattctcacttttttatggtgacattttcttttgaatggcacatctccactcaaagaataacttctttctgtaatagttgctgtccttcttaaggcattgcctcttaaattctttaagattctttaagaatttaagattcttacattattttttcttcagagacactaggttatcttgctttctttgaatgaaattattgaagacacttactggagcaaaaaaaaaaaacaaaacaaaaataaaaagcaaaggaaggatccatgaaattttaa

SEQ ID NO: 88877 - DNA, 601 bp, Human
tattcttagaaattagcccaatatttattcttcacaccttttctagaccatatgttgcatataaatagaaaaaatgatagctgaaccaattccccaggtaccatcagccactttagaatgtctgagatgtgtgttgttggttgataaccatccatttcactcttgaacaagtttgtttaattgggttttgttcatgttgatgtccatccactttcctaagaaatctatcagattccaactgttctttcttaattaatttttttagagacaggatcttgctatgttgcccaggttgaagtgyagtggttattcacaggcattgttatagctagctcactgcagcccccaactcccacgctcaagagatcctctcgcctcagcctcccgaatagctaggactacaggtgcacaccactatgcccagcccaactgtccttttaagtaaagattgagattaaacacaatctgcagcagttagctttccatgatatctaagagagaagaatgattttcttcttttctctgttttcttttacctatctcccttcatgtactactacttcttccatttgaaattatcttgtttgacatctacaaatag

SEQ ID NO: 88878 - DNA, 601 bp, Human
taatctattcttagaaattagcccaatatttattcttcacaccttttctagaccatatgttgcatataaatagaaaaaatgatagctgaaccaattccccaggtaccatcagccactttagaatgtctgagatgtgtgttgttggttgataaccatccatttcactcttgaacaagtttgtttaattgggttttgttcatgttgatgtccatccactttcctaagaaatctatcagattccaactgttctttcttaattaatttttttagagacaggatcttgctatgttgcccaggttgragtgtagtggttattcacaggcattgttatagctagctcactgcagcccccaactcccacgctcaagagatcctctcgcctcagcctcccgaatagctaggactacaggtgcacaccactatgcccagcccaactgtccttttaagtaaagattgagattaaacacaatctgcagcagttagctttccatgatatctaagagagaagaatgattttcttcttttctctgttttcttttacctatctcccttcatgtactactacttcttccatttgaaattatcttgtttgacatctaca

SEQ ID NO: 88879 - DNA, 601 bp, Human
cccacattcaggactgaatgattcatttgcccagctgctgggcatgttgataagtgacagctcttaactatattccccccaaccccaagccttgccctgtaccgagggccatgtcccgttccagcacagccccattcaatggctggttaatgcaggagtagaaaggccaaatctctttcctcaattcaggatcattctgaagggccatccctgttccagagctccttgtgggtgggcaggctttggtgcgactgtttcaacctctccctctgcctaccctggcttccctcattccttcatraggatttacgctgaaagctcctcccaataaattccatgcacacaagtctccatctcagaatctgcttcctgggaccaaccaatgacacctcaaccccagtgtatcaatacctgtgaaaagaatctaaagttcaatgctctcagactaatagataatgagttctacatttgaaatgttagcaattaattatgacctaaaaatcaataatccttcaaatgctaagattctatgatgattttataaatatctgctgattgatgggattgagttccagaaaaatcctgggaaaatagattcagt

SEQ ID NO: 88880 - DNA, 601 bp, Human
tagcattttattacagatgatagctttgtggacgcctggatattctgatcacaagcaaccagactcattattttattatctttctaacatttgaatttggaaacagtggtggatgctgtgacatgctacccagatccctttccccccacattcaggactgaatgattcatttgcccagctgctgggcatgttgataagtgacagctcttaactatattccccccaaccccaagccttgccctgtaccgagggccatgtcccgttccagcacagccccattcaatggctggttaatgcaggrgtagaaaggccaaatctctttcctcaattcaggatcattctgaagggccatccctgttccagagctccttgtgggtgggcaggctttggtgcgactgtttcaacctctccctctgcctaccctggcttccctcattccttcataaggatttacgctgaaagctcctcccaataaattccatgcacacaagtctccatctcagaatctgcttcctgggaccaaccaatgacacctcaaccccagtgtatcaatacctgtgaaaagaatctaaagttcaatgctctcagactaatagataat

SEQ ID NO: 88881 - DNA, 601 bp, Human
tgactacctgaaattttgtatcacttgaccagcaaggtatagcattttattacagatgatagctttgtggacgcctggatattctgatcacaagcaaccagactcattattttattatctttctaacatttgaatttggaaacagtggtggatgctgtgacatgctacccagatccctttccccccacattcaggactgaatgattcatttgcccagctgctgggcatgttgataagtgacagctcttaactatattccccccaaccccaagccttgccctgtaccgagggccatgtcccrttccagcacagccccattcaatggctggttaatgcaggagtagaaaggccaaatctctttcctcaattcaggatcattctgaagggccatccctgttccagagctccttgtgggtgggcaggctttggtgcgactgtttcaacctctccctctgcctaccctggcttccctcattccttcataaggatttacgctgaaagctcctcccaataaattccatgcacacaagtctccatctcagaatctgcttcctgggaccaaccaatgacacctcaaccccagtgtatcaatacctgtgaa

SEQ ID NO: 88882 - DNA, 601 bp, Human
tcattttttggtggtgagaatacttaaaatctactgttctcccaattttcaagtacacagtcaattgctgtcaactatagtcaccatgctgaacaatagatcacttaatgttattcctcctgactacctgaaattttgtatcacttgaccagcaaggtatagcattttattacagatgatagctttgtggacgcctggatattctgatcacaagcaaccagactcattattttattatctttctaacatttgaatttggaaacagtggtggatgctgtgacatgctacccagatccctttycccccacattcaggactgaatgattcatttgcccagctgctgggcatgttgataagtgacagctcttaactatattccccccaaccccaagccttgccctgtaccgagggccatgtcccgttccagcacagccccattcaatggctggttaatgcaggagtagaaaggccaaatctctttcctcaattcaggatcattctgaagggccatccctgttccagagctccttgtgggtgggcaggctttggtgcgactgtttcaacctctccctctgcctaccctggcttccctcattccttc

SEQ ID NO: 88883 - DNA, 601 bp, Human
gatcatgccactgcactccagcctaagtgacagagcaaggctctgtctcaaaaacaaataaataaataaacaaataaataaacctaaggaagatgatgaccttgaattctccccagcctgcccatcagaatccactttccctgtcttaaagggcagacaaaaaaaaatgactatttctggagaacaggattggggccggagatagtcttttacttttttactgtatgccattttgtaatatttgaggtttttattttttaagatagagctttatttagttccttatttatttctaacaaataaaatagtatgtatttgtggtatacaacatgatgctttgatatacacatacactgtggaataaaataaatcaagctaattaatgtatccattattttacatacttatcattttttggtggtgagaatacttaaaatctactgttctcccaattttcaagtacacagtcaattgctgtcaactatagtcaccatgctgaacaatagatcacttaatgttattcctcctgactacctgaaattttgtatcacttgaccagcaaggtatagcattttattacagatgatagctttgtggacgc

SEQ ID NO: 88884 - DNA, 601 bp, Human
aaatacaaaaattagccaggcatcgtggtgcgtacctgtaaacccagctactcaagaggctgaggcaggagaatcactggaacccaggaggtggaagctgcagtgagccgagatcatgccactgcactccagcctaagtgacagagcaaggctctgtctcaaaaacaaataaataaataaacaaataaataaacctaaggaagatgatgaccttgaattctccccagcctgcccatcagaatccactttccctgtcttaaagggcagacaaaaaaaaatgactatttctggagaacaggaktggggccggagatagtcttttacttttttactgtatgccattttgtaatatttgaggtttttattttttaagatagagctttatttagttccttatttatttctaacaaaaaaaatagtatgtatttgtggtatacaacatgatgctttgatatacacatacactgtggaataaaataaatcaagctaattaatgtatccattattttacatacttatcattttttggtggtgagaatacttaaaatctactgttctcccaattttcaagtacacagtcaattgctgtcaactatagtca

SEQ ID NO: 88885 - DNA, 601 bp, Human
aatgtaactaatttctctctctatagcaggactttcagataaccatctttccattggacatggcacccttggaaggactggaatgaagagaagggcttctctcttatgtacttggtgactatgtgagacacagctaaagctgaggaagatggctaggcatggtggttcacgcctataatctcagcactttgggaggcctaggcggatggattacctgaggtcaggagttcaagaccagcctggccaatatggtgaaatcctatctctactaaaaatacaaaaattagccaggcatcgtggygcgtacctgtaaacccagctactcaagaggctgaggcaggagaatcactggaacccaggaggtggaagctgcagtgagccgagatcatgccactgcactccagcctaagtgacagagcaaggctctgtctcaaaaacaaataaataaataaacaaataaataaacctaaggaagatgatgaccttgaattctccccagcctgcccatcagaatccactttccctgtcttaaagggcagacaaaaaaaaatgactatttctggagaacaggattggggccggagatagtcttttacttttt

SEQ ID NO: 88886 - DNA, 601 bp, Human
taacacttgcaggagtgtgaaaatggctgctgtcaacactgaaaatgtcaataatagctatactcttgttcccaatatatttatttattattccttctgaccccttccattatactcaccactctagatagaaattagattaatgtaactaatttctctctctatagcaggactttcagataaccatctttccattggacatggcacccttggaaggactggaatgaagagaagggcttctctcttatgtacttggtgactatgtgagacacagctaaagctgaggaagatggctaggcayggtggttcacgcctataatctcagcactttgggaggcctaggcggatggattacctgaggtcaggagttcaagaccagcctggccaatatggtgaaatcctatctctactaaaaatacaaaaattagccaggcatcgtggtgcgtacctgtaaacccagctactcaagaggctgaggcaggagaatcactggaacccaggaggtggaagctgcagtgagccgagatcatgccactgcactccagcctaagtgacagagcaaggctctgtctcaaaaacaaataaataaataaacaaataa

SEQ ID NO: 88887 - DNA, 601 bp, Human
tcttgaatcaacagaacaatgcagtggatattccagaaaggatttacctaattcattgttcacttttccccaggtaaggactccatgggaaataacacttgcaggagtgtgaaaatggctgctgtcaacactgaaaatgtcaataatagctatactcttgttcccaatatatttatttattattccttctgaccccttccattatactcaccactctagatagaaattagattaatgtaactaatttctctctctatagcaggactttcagataaccatctttccattggacatggcaccyttggaaggactggaatgaagagaagggcttctctcttatgtacttggtgactatgtgagacacagctaaagctgaggaagatggctaggcatggtggttcacgcctataatctcagcactttgggaggcctaggcggatggattacctgaggtcaggagttcaagaccagcctggccaatatggtgaaatcctatctctactaaaaatacaaaaattagccaggcatcgtggtgcgtacctgtaaacccagctactcaagaggctgaggcaggagaatcactggaacccaggaggtggaa

SEQ ID NO: 88888 - DNA, 601 bp, Human
aatatcgatctgccatggtaaataacagatttgtaactattaaaaacaggtaaggaaagaaaagcaaggcaatttccaatgagatttggttggcttgctctaccttctgttgctctacaattgagtcactggaattaatttgttgtgctgataaaaacacaaacacaatgataatcaatgtcttggtctcagaaagcagagtcaactgatgcaagaaaataagggaaaacactcacgaagatataatttgcaagaccttgggttgtgtgtacaaaagtgttctttcacctctgaacatatmttaatatttgccagtggaatagaacagagaaatgtcaacatatacgtacctttggcttgaagttgacagactacctgacttcttgaatcaacagaacaatgcagtggatattccagaaaggatttacctaattcattgttcacttttccccaggtaaggactccatgggaaataacacttgcaggagtgtgaaaatggctgctgtcaacactgaaaatgtcaataatagctatactcttgttcccaatatatttatttattattccttctgaccccttccattatactcaccactctaga

SEQ ID NO: 88889 - DNA, 601 bp, Human
taagggttttgcttttattgttaataaagccatgtttttgtgtgatggggaaggagccactggtccagaggacaaaagggtaaaagtttttgttaaaaataatttatctgacagtgaatagtgaatcattcacactcttttatttggctgttacattctatgtgcaaaaatgtatttcctaaatgtagattgaatgtaatcagtgacatctttacccataaactggaaatatgcataatatcgatctgccatggtaaataacagatttgtaactattaaaaacaggtaaggaaagaaaagmaaggcaatttccaatgagatttggttggcttgctctaccttctgttgctctacaattgagtcactggaattaatttgttgtgctgataaaaacacaaacacaatgataatcaatgtcttggtctcagaaagcagagtcaactgatgcaagaaaataagggaaaacactcacgaagatataatttgcaagaccttgggttgtgtgtacaaaagtgttctttcacctctgaacatatcttaatatttgccagtggaatagaacagagaaatgtcaacatatacgtacctttggcttgaagtt

SEQ ID NO: 88890 - DNA, 601 bp, Human
tttttattcccagtttcaggtatgccgggtatatttaagggttttgcttttattgttaataaagccatgtttttgtgtgatggggaaggagccactggtccagaggacaaaagggtaaaagtttttgttaaaaataatttatctgacagtgaatagtgaatcattcacactcttttatttggctgttacattctatgtgcaaaaatgtatttcctaaatgtagattgaatgtaatcagtgacatctttacccataaactggaaatatgcataatatcgatctgccatggtaaataacagayttgtaactattaaaaacaggtaaggaaagaaaagcaaggcaatttccaatgagatttggttggcttgctctaccttctgttgctctacaattgagtcactggaattaatttgttgtgctgataaaaacacaaacacaatgataatcaatgtcttggtctcagaaagcagagtcaactgatgcaagaaaataagggaaaacactcacgaagatataatttgcaagaccttgggttgtgtgtacaaaagtgttctttcacctctgaacatatcttaatatttgccagtggaatagaacagag

SEQ ID NO: 88891 - DNA, 601 bp, Human
gtccaattaaacctctttttattcccagtttcaggtatgccgggtatatttaagggttttgcttttattgttaataaagccatgtttttgtgtgatggggaaggagccactggtccagaggacaaaagggtaaaagtttttgttaaaaataatttatctgacagtgaatagtgaatcattcacactcttttatttggctgttacattctatgtgcaaaaatgtatttcctaaatgtagattgaatgtaatcagtgacatctttacccataaactggaaatatgcataatatcgatctgccrtggtaaataacagatttgtaactattaaaaacaggtaaggaaagaaaagcaaggcaatttccaatgagatttggttggcttgctctaccttctgttgctctacaattgagtcactggaattaatttgttgtgctgataaaaacacaaacacaatgataatcaatgtcttggtctcagaaagcagagtcaactgatgcaagaaaataagggaaaacactcacgaagatataatttgcaagaccttgggttgtgtgtacaaaagtgttctttcacctctgaacatatcttaatatttgccag

SEQ ID NO: 88892 - DNA, 601 bp, Human
ctcacaagatctgatgggtttatcaggggtttccacttttgcttcttcatcatttttctcttgctgccgccatgtaagaaatgcctttcacctctcgccatgaatcggaggcctcctcagccatgtggaactgtaagtccaattaaacctctttttattcccagtttcaggtatgccgggtatatttaagggttttgcttttattgttaataaagccatgtttttgtgtgatggggaaggagccactggtccagaggacaaaagggtaaaagtttttgttaaaaataatttatctgacagygaatagtgaatcattcacactcttttatttggctgttacattctatgtgcaaaaatgtatttcctaaatgtagattgaatgtaatcagtgacatctttacccataaactggaaatatgcataatatcgatctgccatggtaaataacagatttgtaactattaaaaacaggtaaggaaagaaaagcaaggcaatttccaatgagatttggttggcttgctctaccttctgttgctctacaattgagtcactggaattaatttgttgtgctgataaaaacacaaacacaatgataatcaat

SEQ ID NO: 88893 - DNA, 601 bp, Human
gtcatgactctaactgcccagtgaacatctctactgatattccactcgccacaaatgctaagccagtatgctgaaccaaattcactgtcttcttcaaatttaatttctctcctgaattcctttttctgcacttacctcgcccccatttgcttaatctagaaggctgagagatggctttaagcccttccacctgctcacacctacttgcacttggtcaccaagtccttctaaatatccttggaatctggtaacctatgctcatttctataccttaattcaggtcataatctcccacctaaaytattgctgccatcttctaactagtctcagtgcctcatcccccttgatatggtttggctgtgtccccacccaaatctcaacttgaattgtatctcccagaattcccatgtgctgtgggagggacccagagggaggtaattgaatcatggggccagtctttcccatggtattctcgtggtagtgaataagtctcacaagatctgatgggtttatcaggggtttccacttttgcttcttcatcatttttctcttgctgccgccatgtaagaaatgcctttcacctctcgccatgaatcggagg

SEQ ID NO: 88894 - DNA, 601 bp, Human
ggcctgtcatgactctaactgcccagtgaacatctctactgatattccactcgccacaaatgctaagccagtatgctgaaccaaattcactgtcttcttcaaatttaatttctctcctgaattcctttttctgcacttacctcgcccccatttgcttaatctagaaggctgagagatggctttaagcccttccacctgctcacacctacttgcacttggtcaccaagtccttctaaatatccttggaatctggtaacctatgctcatttctataccttaattcaggtcataatctcccacmtaaactattgctgccatcttctaactagtctcagtgcctcatcccccttgatatggtttggctgtgtccccacccaaatctcaacttgaattgtatctcccagaattcccatgtgctgtgggagggacccagagggaggtaattgaatcatggggccagtctttcccatggtattctcgtggtagtgaataagtctcacaagatctgatgggtttatcaggggtttccacttttgcttcttcatcatttttctcttgctgccgccatgtaagaaatgcctttcacctctcgccatgaatc

SEQ ID NO: 88895 - DNA, 601 bp, Human
gtccttccacgatttgacctctccatagcatgcagcactgtcggccacttcaagtcacctgctcactcttgactcccttccttacttctcagcaccctgcaccccgcaccccgtgaatcacctccctctgcccatcttcagatactagagcttcccaggatgcttctcttagcccagttcttttctctagcttcatgctgtgtgcgggtgagctcccttacatctgtaatacaaatagcactccataaaggccccggcctgtcatgactctaactgcccagtgaacatctctactgatatyccactcgccacaaatgctaagccagtatgctgaaccaaattcactgtcttcttcaaatttaatttctctcctgaattcctttttctgcacttacctcgcccccatttgcttaatctagaaggctgagagatggctttaagcccttccacctgctcacacctacttgcacttggtcaccaagtccttctaaatatccttggaatctggtaacctatgctcatttctataccttaattcaggtcataatctcccacctaaactattgctgccatcttctaactagtctcagtgcctcatccc

SEQ ID NO: 88896 - DNA, 601 bp, Human
attttcacaaactatgcaagagcataaatgatgaagggttaagggaagaaagagaagaattccaactagggagacttagaaaggacttaaaaggtaaatcttaaaaaaaaaaaaaacagcaagcactactaaaatacatccaactctagcttgctgactaatgaggctatagaagtaaggacaagctggctgccccatctgtcactctacagatgaccagggttgatcatgtggacttgaccatctaggcaggcagccatttcctccctgtcccttctgagtagtgctcccctatactgtrggatcagtctcacagaggcaccctgctcttcctgcaggaacccccaaagtgagcaatgaattagcctcaggttctaactctttccttcatcagtatcttccacggataattcaagacctcctcttcattaatcaagcccttcccttagcagatgaacaggcttatagcacacctggcctaaaactaaaacaacccaacatataatcctgctcttgccttatctgctttcctagtaccatctacctcttgactaccatttatggaaaaaaataatttgcattcattttctctccacccatt

SEQ ID NO: 88897 - DNA, 601 bp, Human
tacatttgggagttatcaggatacatgtgctatgcaaatatccaggaagtgatttaaagggaatgcagagcccaagaggagattgggattaaaactgggtccaataaaattttcacaaactatgcaagagcataaatgatgaagggttaagggaagaaagagaagaattccaactagggagacttagaaaggacttaaaaggtaaatcttaaaaaaaaaaaaaacagcaagcactactaaaatacatccaactctagcttgctgactaatgaggctatagaagtaaggacaagctggctgmcccatctgtcactctacagatgaccagggttgatcatgtggacttgaccatctaggcaggcagccatttcctccctgtcccttctgagtagtgctcccctatactgtgggatcagtctcacagaggcaccctgctcttcctgcaggaacccccaaagtgagcaatgaattagcctcaggttctaactctttccttcatcagtatcttccacggataattcaagacctcctcttcattaatcaagcccttcccttagcagatgaacaggcttatagcacacctggcctaaaactaaaacaa

SEQ ID NO: 88898 - DNA, 601 bp, Human
gcaagaccgtgggatatctgaggaactgaggtagaaattagtaagcttgtaggttgaggctgaaggaagaaaaaaaaggcagggttaataccaacatttctggctttgaatctctaaacagatagaatttactgagatggggaaacttgggagtgggtacagatgagtttgtagggaaaaaaaaatcaagagttccattgtactatgataatttccagacatctatgcattgcacaaatggagacatcagttaggttgtaggatatatgaatctagaacctagaaaaaaggcctgaaatasaaacatacatttgggagttatcaggatacatgtgctatgcaaatatccaggaagtgatttaaagggaatgcagagcccaagaggagattgggattaaaactgggtccaataaaattttcacaaactatgcaagagcataaatgatgaagggttaagggaagaaagagaagaattccaactagggagacttagaaaggacttaaaaggtaaatcttaaaaaaaaaaaaaacagcaagcactactaaaatacatccaactctagcttgctgactaatgaggctatagaagtaaggacaagct

SEQ ID NO: 88899 - DNA, 601 bp, Human
ggtagggtagaaagtggttctggaaaagagaatgcaaatgtgggcaagaccgtgggatatctgaggaactgaggtagaaattagtaagcttgtaggttgaggctgaaggaagaaaaaaaaggcagggttaataccaacatttctggctttgaatctctaaacagatagaatttactgagatggggaaacttgggagtgggtacagatgagtttgtagggaaaaaaaaatcaagagttccattgtactatgataatttccagacatctatgcattgcacaaatggagacatcagttaggttrtaggatatatgaatctagaacctagaaaaaaggcctgaaatagaaacatacatttgggagttatcaggatacatgtgctatgcaaatatccaggaagtgatttaaagggaatgcagagcccaagaggagattgggattaaaactgggtccaataaaattttcacaaactatgcaagagcataaatgatgaagggttaagggaagaaagagaagaattccaactagggagacttagaaaggacttaaaaggtaaatcttaaaaaaaaaaaaaacagcaagcactactaaaatacatccaac

SEQ ID NO: 88900 - DNA, 601 bp, Human
aggaggacatgatgatgaactagtcttcaaagtgcttactttgtagatacaaacagacagataaataaaatatgtaaaagttgtaattgatgcagtgaaggaagcaaacaaggggaatgaggtaggactaggaaagagagacctattttaggtggaatgggaagagaaggcctctctgggaaatattattcaagctgaggaccaaagcatgctccaggatcagagggtgccagtcatctgtggaatggtggtagggtagaaagtggttctggaaaagagaatgcaaatgtgggcaagaccrtgggatatctgaggaactgaggtagaaattagtaagcttgtaggttgaggctgaaggaagaaaaaaaaggcagggttaataccaacatttctggctttgaatctctaaacagatagaatttactgagatggggaaacttgggagtgggtacagatgagtttgtagggaaaaaaaaatcaagagttccattgtactatgataatttccagacatctatgcattgcacaaatggagacatcagttaggttgtaggatatatgaatctagaacctagaaaaaaggcctgaaatagaaacatac

SEQ ID NO: 88901 - DNA, 601 bp, Human
gaatggggatgttcaattgaccaccagaaccttaccaagatgaccatgacccaacaagcaaaaggaaatgttttctcaaccttggatctgttgcctcccacacctgttcccttctgtcgtctctatgcccttgcatatctcttttgcgaggtagacaattcaattatactaacattcatcgtgataatgataataagatgaggcacaaagaaattaatgtaaccctgatcctcagagagataccaggatagtgaacagacagacaagaaaacacttagcacactctgttatgatgagttgytatgagagaggtctgaacaaagtgtaataaggacagactccctggaagaggcacaactcaaacatcacctcttctgagaagccttccctccttctccaggctgacaaggatgagaattcagccaacaaatgcttactgagtgcactgcattaggatctaggaggacatgatgatgaactagtcttcaaagtgcttactttgtagatacaaacagacagataaataaaatatgtaaaagttgtaattgatgcagtgaaggaagcaaacaaggggaatgaggtaggactaggaaagagagac

SEQ ID NO: 88902 - DNA, 601 bp, Human
ccccgctgatgactcccaggggaagccaagaggacaaagacaaggatgaggacgaggacccaggacccgctggtgaatggcaactgctgtcaactcactttcaacctcagccagttgtcccaggtgtagccttggcctccagagagctggtccccggttgttactccaggtcacttggaatgtaaacaaagtggttgggcttcccttcttggaaaccaagacaacagctggtgcggggcctgggaaagaggtaatttgccctctcgctcttccttcaaagcagcaggaaaatcaccatggytcagaggtgtggctccacagtgctccctgctgggcaaattgttcccggtctgtctgaccactggacaatcacgtgtgaattttgtgttgagatctagagtttacttgccttgaaccccattgacagtcttcagagggagagagaaagcaaataaagtaaaaatgaaatctgtatatgcttggttctcgcaactaacaatggcttccctgtcagagcagacgagaaaacccagcatctcggctttgactctactttcacttcaaaaacagcagtttgagtgccctggctctgaatctagga

SEQ ID NO: 88903 - DNA, 601 bp, Human
ataacccagaaaaaaccaggctgaacatacccaagctccggaaccagcaaatcttgttcgaaccccgctgatgactcccaggggaagccaagaggacaaagacaaggatgaggacgaggacccaggacccgctggtgaatggcaactgctgtcaactcactttcaacctcagccagttgtcccaggtgtagccttggcctccagagagctggtccccggttgttactccaggtcacttggaatgtaaacaaagtggttgggcttcccttcttggaaaccaagacaacagctggtgcggggyctgggaaagaggtaatttgccctctcgctcttccttcaaagcagcaggaaaatcaccatggttcagaggtgtggctccacagtgctccctgctgggcaaattgttcccggtctgtctgaccactggacaatcacgtgtgaattttgtgttgagatctagagtttacttgccttgaaccccattgacagtcttcagagggagagagaaagcaaataaagtaaaaatgaaatctgtatatgcttggttctcgcaactaacaatggcttccctgtcagagcagacgagaaaacccagcatctc

SEQ ID NO: 88904 - DNA, 601 bp, Human
ggtgaaaagtgtcaaactctgtaaaatatttgaaaagatttattctgagccaaatacgagtgactatggcccgtgacataaccccaggagatcctgagaacatgtgcccaagggggttgggctatggctttgtttgtttacacactttatacattttggggagacataaaacatcaatcaatacatgtaagatgcacatcggtttggttccaaaaggcaggacaactggaagcaaggaggtgggtgggcggggcttctatgtgataggtaggttcaaggattttctgattggtaattggtkgaaaaagtttatttaaagacctggaatcaatagaagggagtgtctgggttaagataaggggttgtggggaccaaggtccttattatgcagattaagtctccaggtagcaggcttcagagagaatggactgtaagtgtttcttatcagacttaaaaatgtgtcagactcttagttctctcctggatcagaaaaaaagacctggaaaaggaacaggattttctacagaagggagattttccccacaagagacagcttttgcagggcatttcaaaatatgttgaaaatatatttgagggtaaa

SEQ ID NO: 88905 - DNA, 601 bp, Human
atacctaggaatccaacttacaagggatgtgaaggacctcttcaaggagaactacaaaccactgctcaaagaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaacagcccacatcgccaagtcaatcctaagccaaaagaacaaagcyggaggcatcacgctacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagattta

SEQ ID NO: 88906 - DNA, 601 bp, Human
atgaactttggcctttagaaaaacgaccaaatgacccagccaaaacaggccaagtaggctgaccccttctgtttcctagagaattcactccattgtaccaccttcagtttctcctagtcagctgcaaggccaccatcccaccagttaaggatgggatggaaccccaggtaagcaaacctgtaggtctgacctagtcagtgggagtggccagtgccaaatggcctggaggcttggagaggcacagtactgggtgctgagtcccatttctgttgtactgttaagccgttgggcacgacatggmagctgaaagatgaggaaaggtcaaggcacaataaagacaactgttcttctgtggcagacagagaatacagctgcaggtatgttgccttctagaaaagcatttctctccttggtaggtctggaaggcaagtgtcctcggagatctgtatgccctgtgtgctaagcgtgggtcaatgctcaaaggatcccagagacccccgaggagagcgtcttccccactggtgctcctggccatgctatccatagtgattaactcagacttcaggaacaccccccaatgaacaacaatgggctctccctg

SEQ ID NO: 88907 - DNA, 601 bp, Human
atgttgcagcaaaggcctgaggtccacactctgtctcccacgtgccttcagccacgtgtggagggatcaaagacacatcaaaacgggtctccaaagcctcaacctgctgctcagtcaccaccgggatctgccccattgctctgggtggctgtgatgttggtgtccacagatggggggacacaccaatttggcagcctgagcctgctggagtgaaaggccgcttttcaaaaatatggaagtgcaaatagctcatttaactcccctgatgaaaaaaaaatccctaactttggtcaaaagagcrtgaactttggcctttagaaaaacgaccaaatgacccagccaaaacaggccaagtaggctgaccccttctgtttcctagagaattcactccattgtaccaccttcagtttctcctagtcagctgcaaggccaccatcccaccagttaaggatgggatggaaccccaggtaagcaaacctgtaggtctgacctagtcagtgggagtggccagtgccaaatggcctggaggcttggagaggcacagtactgggtgctgagtcccatttctgttgtactgttaagccgttgggcacgacatgga

SEQ ID NO: 88908 - DNA, 601 bp, Human
agggtctaactttttttttaagtaaactcctcctacccacccaccagctacaggcagcaggggagtcctggttttctcatgatgttgcagcaaaggcctgaggtccacactctgtctcccacgtgccttcagccacgtgtggagggatcaaagacacatcaaaacgggtctccaaagcctcaacctgctgctcagtcaccaccgggatctgccccattgctctgggtggctgtgatgttggtgtccacagatggggggacacaccaatttggcagcctgagcctgctggagtgaaaggccrcttttcaaaaatatggaagtgcaaatagctcatttaactcccctgatgaaaaaaaaatccctaactttggtcaaaagagcatgaactttggcctttagaaaaacgaccaaatgacccagccaaaacaggccaagtaggctgaccccttctgtttcctagagaattcactccattgtaccaccttcagtttctcctagtcagctgcaaggccaccatcccaccagttaaggatgggatggaaccccaggtaagcaaacctgtaggtctgacctagtcagtgggagtggccagtgccaaatg

SEQ ID NO: 88909 - DNA, 601 bp, Human
gtgtgtgtgtgtgttttgaatattattctcacagggtatttggaattctttttgcttacacatacttttaagtgtttgtacaattaaaaaaatgcattgcttgcgtaagtttttgtttcctggtttaaggtgcacatttttggttttattttctaagtacattgctgagctttcgctgatttctacataggaagacacagagaatgtgaactcacccagatacagaggaaaatcagggtctttcaggactcggacggggagggcatccagcaaaagtagggctgcagcgcccccatgtgtscagggcggtggaagtcaccaggagtaggcggaggaagccggcttctgacatttgggggaaggggacctgccttctctattgcgaatactattgggaattcccagagtcaatcagcagttaaatgcttactgagtttcttattcatactccatcttgccagaccagaaatctgagagagctggagctcccaaggcccaccctttggctgcctaaattaagactcccggggttcccacactctttttcccaatggcagtggagggtcttgggaaaactgtctggagggaatgccccgagtcc

SEQ ID NO: 88910 - DNA, 601 bp, Human
ctgcttttgtgatgcaatggcagagttgactcattatgatacagactgtatggctcacaaagcctacaatatgcactatctggctctttgcagaaaaactttgtgaacccctaaaagagcattgggtgcttataatctgccagtcacaattctgtgagagttttatgaccctgttttaccaatgaggctctgggcgattaagtaatttgcctgaggccacccacctgggcaagaagtcacagagctgggatttgaaccattgccagtctgaccacaaagcctgtgctatcatctctacccygtgtgtaccttcccatacaccctccaaaacccttcttacctaggtacagcgctgaattctaccactgtagcagggagaaccaatcagcccacctgaccgtcaaccagtctagaaggaaatgggaacaggtttggttggggaagaagggatctcctcagggaatttaaaggttgttaactgctgttttagttttaggacaaattacctgccttctaactgccatgcaaacaaataccgctcaggtgtgaccaaaatttaagcatcttaagtctccgctctcttcagttaggaattttcatt

SEQ ID NO: 88911 - DNA, 601 bp, Human
aaaaaaatatttgtggaagagtcaataaaagaatcaataagagaatgaagtgctttaaagcaatacctctttaacttttatttcatatattcaaatattccaagcaaaaaaatgactcaatgcttaaatcactgggtgaattggcccagtttcccattcacatgcccaggtagagagcccagcaggtgaggaaggagctcaaggctgagttcacagagttcctcattctcgttccaaaactacttctcaggtttttggtcttttttttgttttgtttttaactattagtattttcttctttttctccttctccttcttcttcttcttattattatttttcttttggtgagacagagcttcactcttgtcaccctggctggagtgcaatggcatgatcgtggctcactgcaacctctgcctcccgggttcaagcgattctcctgcctcagcctccggagtagctgggattacaggcacgagccactatgtctggctaatttttgtatttttagtagagacagagttcaccatgttgtccaggctggtcttgaactcctgaactcaggtgatccacccatctcagcctcccaaagtgctgaga

SEQ ID NO: 88912 - DNA, 601 bp, Human
gagggaaaaaaaatatttgtggaagagtcaataaaagaatcaataagagaatgaagtgctttaaagcaatacctctttaacttttatttcatatattcaaatattccaagcaaaaaaatgactcaatgcttaaatcactgggtgaattggcccagtttcccattcacatgcccaggtagagagcccagcaggtgaggaaggagctcaaggctgagttcacagagttcctcattctcgttccaaaactacttctcaggtttttggtcttttttttgttttgtttttaactattagtatttttttcttcttctccttctccttcttcttcttcttattattatttttcttttggtgagacagagcttcactcttgtcaccctggctggagtgcaatggcatgatcgtggctcactgcaacctctgcctcccgggttcaagcgattctcctgcctcagcctccggagtagctgggattacaggcacgagccactatgtctggctaatttttgtatttttagtagagacagagttcaccatgttgtccaggctggtcttgaactcctgaactcaggtgatccacccatctcagcctcccaaagtg

SEQ ID NO: 88913 - DNA, 601 bp, Human
aagctcattaataattcacttctgaataaatgacaggaaagtatttggttgccatggtaacaactgcaaggcctatttgttttttgttcttttttaaaataatgtctgggccatttttttgtgaatgttgaattactgacagaaaccatacatgtataagacagagatatgaatgggtagggaaacaatatcttaaaaatgcagtcggtaagccattaagcatcaggaccttaaaataagggaaccaaaatgcctttctcagcttcccactgcacctttctggaaggaggaggaagtgacaaaaaaaaacaaaaacaaacaaaatcatttctagactcaattagctatgtgatgaaaacttattcataccaaaaattcatatataaaagcatttttcacacttgaacttttttcttaattaacatatattcttgcaactaatcgttactacaaccttatgaggtcagcgttatcatactcattttatggatggggaagctgagtcttagagaacatggcctaagcctcatagtcttgaagtggtagaggcagaatttatacccaagtctgcctgaatccaaagactgtgttcattctacgt

SEQ ID NO: 88914 - DNA, 601 bp, Human
tgttttctgactatgtcccagacaaagctcattaataattcacttctgaataaatgacaggaaagtatttggttgccatggtaacaactgcaaggcctatttgttttttgttcttttttaaaataatgtctgggccatttttttgtgaatgttgaattactgacagaaaccatacatgtataagacagagatatgaatgggtagggaaacaatatcttaaaaatgcagtcggtaagccattaagcatcaggaccttaaaataagggaaccaaaatgcctttctcagcttcccactgcaccyttctggaaggaggaggaagtgacaaaaaaaaacaaaaacaaacaaaatcatttctagactcaattagctatgtgatgaaaacttattcataccaaaaattcatatataaaagcatttttcacacttgaacttttttcttaattaacatatattcttgcaactaatcgttactacaaccttatgaggtcagcgttatcatactcattttatggatggggaagctgagtcttagagaacatggcctaagcctcatagtcttgaagtggtagaggcagaatttatacccaagtctgcctgaat

SEQ ID NO: 88915 - DNA, 601 bp, Human
tccatggaatatctaaattcttaggcctatcttgtcttctctcattcctcactcttttattgtgccagaaaaaaaaagatgtcatttaaaataaatatggtttccagatacctgtagacgttgacaccctcagtcactgctgtaatgaaattcagggatgtcagtgtacatcaacaatcaactgaagaaaggtgccgatgaaaaggcatcaatatgttactactcagatggctatttcaagcatcttcttttgaaagaaatcaaaagaacatcaatttttatttttgaaaattcaaaaaayccatcagtttaaaaggttgtattttgaaatcataacaaatttcaggtgattcaaccttcaagcaatattgatatatggtttagggataaatcattttaaaagcaatagctaacatactaaggggcttaatgtgtgtcaggaacttcttcatatagttcctatgcatttatcctcacaaccacccctaaataatgtggtcctactattaaacccattttacaaacatggaaactgggacttagaaagcttaaatacattccttaaaattaccttgtctgagaagcttggtgactaacctgc

SEQ ID NO: 88916 - DNA, 601 bp, Human
ttttaacattcctcctaaggctgggtgcggtggctcacgcctataatcccagcactttgggaggccgaggtgggtggatcacttgagctcaggagttcaagcccagcctggccaacatggtgaaaccctgtctctactaaaaatacaaaaattagctgggcgtggtggcaggtgcctgtagccccagctacatgggaggctgaggcaggagaatcacttgaacccaggaggcagaggttgcagtgagctgcgatcacgccactgcactccagcttgggcaacagagcgagactcagtctcaaaaaaaaaaaaaagtcctcctaaagggtaggtgaatgatctagatcatgctttagacctttaaggtattattgtttccagctctctaggagtgaaaaaagcttaaatgtttcttttgaatctgaatctgaaaactgatcctgcttttcctacctgcacgctccaaaagttaaaagcctacaccatctaagaaaattatcagacatatagaaaaaaatacatatgcaaagatgttcacaacagtgttatgacagaggaattttaggcatgtccaagagtaagggatcagttaagtcaattg

SEQ ID NO: 88917 - DNA, 601 bp, Human
cagcgaggcccccaaactgctcttgtttgcctcagaagacaggcgggaaattccaacctgatcctactttgtacttcaggaaaacaaaggggagtacgtatttcttgtaagtgtcatattgcaccttttaatttattgtctttcccagaaacacacaactatgatgatttcatgttctgcaacaatgagtactgatctcttatcacatagtccccttccactgagtgaagtgacaatgaagaaaatgatgatgaaattgtaaaaatacagtaccctgcacaaagccaacaaacagtaactrtatctgtacttacatgattggttagattcccacaacaaccttatgaagcaggtatgataacatgcccattttacagatgaagatactgaggcttagaaaaatggaacaacttgtgcaagatgacacagaaactaagaaatgaaatcaaactcagctccatgttcctacaaggcccgtggtaaccactctgcattgctgtctcttcactgaatcacccaccacttgttggacctttacttaccatttgtttcatactgtgctttccctgtggtccttgtcaacctgtcgatattttcacta

SEQ ID NO: 88918 - DNA, 601 bp, Human
cattttctctgaggatgctgtaagtcttgagctgccaaacccatcattgcctgaaaggacaacaacccagaagaaaacccaaccaaaagatggggagagtagcaaagtctagatagcctttcagccctctgtctgctgtatccaaagcctgctgaatccctagacatcccagttaccttacccataaagatcaccccttctttctctttgagtttgagtcccaccaagaacagcccgaaaaatcttcaatagctgtcaatttttaaaaacatcagagggacactgaagtacaagccacagmctgtccactcatgcctaccctgctggttcagaggacaccagccccctcagcgaggcccccaaactgctcttgtttgcctcagaagacaggcgggaaattccaacctgatcctactttgtacttcaggaaaacaaaggggagtacgtatttcttgtaagtgtcatattgcaccttttaatttattgtctttcccagaaacacacaactatgatgatttcatgttctgcaacaatgagtactgatctcttatcacatagtccccttccactgagtgaagtgacaatgaagaaaatgatgatg

SEQ ID NO: 88919 - DNA, 601 bp, Human
aaaagagaaggaaaagaaaagaaaactccttgacaaactaagttggagtgaagtattacagagctcaggtataagttactcaattatgagatttttttaagagtttgcagtagccacatatattttcctcctttcatccctttgtttcttttctcttattttcatcattcgggcagctttttgggcagccaccttttccatgtcatcccatcgtgtgattgtcatcacacggtgatccagactgggcaatcagagcaatcctttcctacagtggtcagcccaagaatgggtgtggctgaarcccagccaatgagactcttctctgggcctcttcctagaagtatcagaaaagaggcactttccattgctgaaatcattttctctgaggatgctgtaagtcttgagctgccaaacccatcattgcctgaaaggacaacaacccagaagaaaacccaaccaaaagatggggagagtagcaaagtctagatagcctttcagccctctgtctgctgtatccaaagcctgctgaatccctagacatcccagttaccttacccataaagatcaccccttctttctctttgagtttgagtcccaccaa

SEQ ID NO: 88920 - DNA, 601 bp, Human
tgttttgagtgcctctgggtatttttagaatctgtagggagaagctgagctgcactggatgactgttatgctcccagtgacaccctgggcttaaagaaacaggattcacagcgactgctaaagtttcaggcaatagaagacaacatctgacaaaattacacgtagtggggatggaggtagaagaaaagagaaggaaaagaaaagaaaactccttgacaaactaagttggagtgaagtattacagagctcaggtataagttactcaattatgagatttttttaagagtttgcagtagccacrtatattttcctcctttcatccctttgtttcttttctcttattttcatcattcgggcagctttttgggcagccaccttttccatgtcatcccatcgtgtgattgtcatcacacggtgatccagactgggcaatcagagcaatcctttcctacagtggtcagcccaagaatgggtgtggctgaagcccagccaatgagactcttctctgggcctcttcctagaagtatcagaaaagaggcactttccattgctgaaatcattttctctgaggatgctgtaagtcttgagctgccaaacccat

SEQ ID NO: 88921 - DNA, 601 bp, Human
ctgtgaaatgaaacacctccttgacataagaacaccctgatgctctgggtggttcgactccacctaaagattccatggaaaaggccttggcttttgctttgcttctgaaaaataagccaggttgtagccctggtcattgtgagcactaaccttctccaaatgtggtccttgggcctcttcatggatgcatatgtgcgagttattctaggtgatctcttgttaaagagttttattttaaatcccagctaatctgtgcgactccctggattggtctgatctctcgatacatcttagttcaggyctacagcgagctgcaaaaagacagtgcaaacacttttgctgtttgtctccctctttccctttcttccaatcaattctgttccatcaggaacccctcatctcttctgcataaagaggtatataaataaaaacaaaataaataaataaaagggctgcgtgagttgctgattctccctatagtgacagcgctaaggcagtttaaagaggggagtgtgtgggtgtctgcacgggcagtgcctcagtgcttcgctgtttgttttgagtgcctctgggtatttttagaatctgtagggagaagctg

SEQ ID NO: 88922 - DNA, 601 bp, Human
gcctcccatcccaaaagcccttccacagttactaactccaaattctgaacgggaaaagcaatatgcaaatttagaaaaaggcagaacccccagatcctaaagcccaggctcaaatcacagtggcttgatgcctttgcaaagcattactttagggactgattattctgaaacgttgtttgggtgatgatacccaagacaccagggccctgcctcctgggaagacagcagtattagcttgtggctgcatagtagacatcgttcatcaaaaacagaagaaataccaagaaaaaatattgatgcyagctggtctgaagcagtttaaaattgtcacaaacctgcactgatttgttagcatctttatctctgaaagcgctcacccttattcacatcagcaatttgtgtctttaggaataactgaaaattttcatgaaaactaagaaccacctagtataagattaagaacctttccaatgcattggagacaagaaggacagggtgaaaaaataagtctgcctgtaactgaagctctcaattggattgataagtcttgtgccttgaacttactgctcacaaaagcaacaagagtgtgacaggcaagagt

SEQ ID NO: 88923 - DNA, 601 bp, Human
attcagaccctgaacagaaagaaacgtttttgttttgttttctcattttacatactgacatgttctagcttatctagaaaattgcaagcattctttttctttatcccagtgttggcttttctttaagaaacacagattcacaacctatttcactaactggccattgataaataaaaatacttgcacatggcaaatggaagcaacattgtgcaggaacttggaggttcctttagtagtttcagccagaagaataaagccatacagaaccacacaagctcccagaaatccaaacccagctgaytggttttacacttggaaacataatcagcaccaccactgcctcccatcccaaaagcccttccacagttactaactccaaattctgaacgggaaaagcaatatgcaaatttagaaaaaggcagaacccccagatcctaaagcccaggctcaaatcacagtggcttgatgcctttgcaaagcattactttagggactgattattctgaaacgttgtttgggtgatgatacccaagacaccagggccctgcctcctgggaagacagcagtattagcttgtggctgcatagtagacatcgttcat

SEQ ID NO: 88924 - DNA, 601 bp, Human
ataactgaggctcagaaaggctaaggaacttgtccagcaccagagagctaagtggctatgtcagaacttaagcccacacatccctgatggccgaggtctgtgctctcttcattcattctatttccaaggaagactcgcaagatgaaaaaaaatcatcaagtagataccaagaaaggaacctcccaacaacccctaaaaagtaagctgcaaagataggcctgaataggcatattcatgctgattattccattgactttgcctgtcgtatttgtcaaatccagataattcagaccctgaacaraaagaaacgtttttgttttgttttctcattttacatactgacatgttctagcttatctagaaaattgcaagcattctttttctttatcccagtgttggcttttctttaagaaacacagattcacaacctatttcactaactggccattgataaataaaaatacttgcacatggcaaatggaagcaacattgtgcaggaacttggaggttcctttagtagtttcagccagaagaataaagccatacagaaccacacaagctcccagaaatccaaacccagctgattggttttacacttgga

SEQ ID NO: 88925 - DNA, 601 bp, Human
atggaaaccacgtgtctcaagagactgtaggcatctttttccttttcaaactttcttgtttcaaccaatattggactggctatctctgtcaaatcatccctggtttgttctcaactcagagagtgggctgcaggtcagccagatgaatgccacagagcatgcactgtgtaacagatgctctacacccgtcattccatctgttcgttaccaaagggggatgatgatcaactctattttcgtgagataactgaggctcagaaaggctaaggaacttgtccagcaccagagagctaagtggctrtgtcagaacttaagcccacacatccctgatggccgaggtctgtgctctcttcattcattctatttccaaggaagactcgcaagatgaaaaaaaatcatcaagtagataccaagaaaggaacctcccaacaacccctaaaaagtaagctgcaaagataggcctgaataggcatattcatgctgattattccattgactttgcctgtcgtatttgtcaaatccagataattcagaccctgaacagaaagaaacgtttttgttttgttttctcattttacatactgacatgttctagcttatc

SEQ ID NO: 88926 - DNA, 601 bp, Human
tgcaagcccaggcagcctggctggggcatctggcttctgcccactgctcacagcatgatcagagattcaggcctatgtacaacccagggatccacatttcagaagcacgacacaccagggcagggcatgagccatgtgtggggcactggggcaccttctctcagagatggtgacttgataaagcctggaggagcaaggcccagtcacaggaagaggcaagggcgtgtgagatggtggccacccctgctcctgctcactgtcccttctgcaggagcagctgccctttcagctcctttctccrttcaacaccttctttcagacctcaagacccatgaccaagtgctgctgtttccatagccaggttgggccccctcatgaatgggacaaacccggtagggatgccagtcatgatcttctgcccctagactgtgccaaacaacaggtcccaggaaccaagcaaagggctggggagcagctggtctagggaggggctgaggtcaggctgtgggtgagagcagaaggtagaaacaagggtgagagaagcagaaacaaaggttgaggtacaaggtgaaactaagtgggaacgcaggaaagaccccag

SEQ ID NO: 88927 - DNA, 601 bp, Human
gtgaggttggtatttttaaggatcttcattttacaggtggggaaactgaggcacagaggatttgggtaacttgctcgaacttgtttagcacatggtagtttgggatgcaagcccaggcagcctggctggggcatctggcttctgcccactgctcacagcatgatcagagattcaggcctatgtacaacccagggatccacatttcagaagcacgacacaccagggcagggcatgagccatgtgtggggcactggggcaccttctctcagagatggtgacttgataaagcctggaggagcarggcccagtcacaggaagaggcaagggcgtgtgagatggtggccacccctgctcctgctcactgtcccttctgcaggagcagctgccctttcagctcctttctccattcaacaccttctttcagacctcaagacccatgaccaagtgctgctgtttccatagccaggttgggccccctcatgaatgggacaaacccggtagggatgccagtcatgatcttctgcccctagactgtgccaaacaacaggtcccaggaaccaagcaaagggctggggagcagctggtctagggaggggctgag

SEQ ID NO: 88928 - DNA, 601 bp, Human
atgactttggtgaccaatggccactgggcagtctacaacagtggagcaaagtgaagctgatgggtcccctgagaattgaaacctgaacctgtgacttcgtttcccttagtaccaccaggggtgggaacacacccatgatgccttgagatctttgcaaagggagactctgtgacctcatttaatgtttttaggagtaggcaacatctgcaacgatacttgagagactttcacagttttgtttctttgctgaacagtcagaagtacaattagctgaattaacaggctgacttcttgctactcagagtgcacccaagcaaccatccacttcacctaggagccccatacaaatgcagaaccccaggccccaaccagacctgcagaatgagaaaccacatttccatcagaatcctaggtgattcttaaacacatgagagtttcagtaagaagcactattctacctgatcttgaaattcactcaaccaggctacaggtctaaaattgtttcagttggaaaagcaaatgcaaaacaaaatgatagtagcctgagagttctggagccactaatactcctggacaatgcatgaagaagccttggggtctg

SEQ ID NO: 88929 - DNA, 601 bp, Human
gcttatttggataaatcattccatttctgccagggtacagacagtcccaaagggtggcatcttcctctctcattcatggggtgagttttgagctgttttcttgcagagacaatgggtggagttgactcatctgtgttcactttggtccagcacctgtaggccaggtggctaccctcagtgagaaccctttgcctcattcatcctaaagcaacctactttgtctcacccactgttgaaactctgaatgcaagccccatttccttgtttcccattgtttcatttgcctcttgtttatgagctyccctcatgactttgatacagcaccaacttggctccaatccacattccctcccttcctagtgacataggcaagtatccaccatggtccagctggaccctcagaacctcctctctcaggttttactgattgttctcactcttcatctccctgccaccatctgtcaactacaatgactttggtgaccaatggccactgggcagtctacaacagtggagcaaagtgaagctgatgggtcccctgagaattgaaacctgaacctgtgacttcgtttcccttagtaccaccaggggtgggaacaca

SEQ ID NO: 88930 - DNA, 601 bp, Human
atgcaagaatacatgaaatatatgaaaacttgccttgcttatttggataaatcattccatttctgccagggtacagacagtcccaaagggtggcatcttcctctctcattcatggggtgagttttgagctgttttcttgcagagacaatgggtggagttgactcatctgtgttcactttggtccagcacctgtaggccaggtggctaccctcagtgagaaccctttgcctcattcatcctaaagcaacctactttgtctcacccactgttgaaactctgaatgcaagccccatttccttgyttcccattgtttcatttgcctcttgtttatgagcttccctcatgactttgatacagcaccaacttggctccaatccacattccctcccttcctagtgacataggcaagtatccaccatggtccagctggaccctcagaacctcctctctcaggttttactgattgttctcactcttcatctccctgccaccatctgtcaactacaatgactttggtgaccaatggccactgggcagtctacaacagtggagcaaagtgaagctgatgggtcccctgagaattgaaacctgaacctgtgac

SEQ ID NO: 88931 - DNA, 601 bp, Human
gaagaactggatggcagaaagtgaaatccccattgctgagtatccctccccagcattgcagcagccaggtagaatttccatgacctcccaggccaagaagaacatgagctgcacatgctgagtggcccaggaaaagaaaagatggctaagatatatgcaagaatacatgaaatatatgaaaacttgccttgcttatttggataaatcattccatttctgccagggtacagacagtcccaaagggtggcatcttcctctctcattcatggggtgagttttgagctgttttcttgcagagacratgggtggagttgactcatctgtgttcactttggtccagcacctgtaggccaggtggctaccctcagtgagaaccctttgcctcattcatcctaaagcaacctactttgtctcacccactgttgaaactctgaatgcaagccccatttccttgtttcccattgtttcatttgcctcttgtttatgagcttccctcatgactttgatacagcaccaacttggctccaatccacattccctcccttcctagtgacataggcaagtatccaccatggtccagctggaccctcagaacctcctc

SEQ ID NO: 88932 - DNA, 601 bp, Human
tcaaattatctcttctgaaataactacctaagttacttcagctctcaagtgaacaaggacagtggtgactttgggcaactgtgcctcaccaagagaaaagaagactggggtcttagcaaatactcagcagcctgacagagggtacatatgggttggaggagaagcccaaagaacagagtgagtgttataaggtgtactctggtttcatgagaggtagagagcagctcccacccagagctaagagcagagaggagggctcagtgcggggaatgagagcaggtgcatctttccatcttatgtragaggctgtctcactggaggcagtgtctgaaagaagaactggatggcagaaagtgaaatccccattgctgagtatccctccccagcattgcagcagccaggtagaatttccatgacctcccaggccaagaagaacatgagctgcacatgctgagtggcccaggaaaagaaaagatggctaagatatatgcaagaatacatgaaatatatgaaaacttgccttgcttatttggataaatcattccatttctgccagggtacagacagtcccaaagggtggcatcttcctctctcattcatg

SEQ ID NO: 88933 - DNA, 601 bp, Human
tgttgatgcttaccaaagcattgtcccacacatgagatcgtcacacctaccagagaatgacacagccacatacacatccctaaaaagaacttagaatttctacttcaagattcaatacatttattctgaatttttattgactgcctcttaagctctgccttgcaagtgacacaaagctgaccttgccctctaagaactgatcatcatcgtcagcccagatgacaaggtgtatgtattcaggcaggagctggggcaggatagcatggcagtaactcaaatatataactaatgctaacaaaartcataatataaggatccctagccagtcaagtaagaaacagtccatataggaataaagtatctggttgtcagaaatcaagaatttgggataaggtaaagtaaaacttaccagactcacaaaattgggtgggggtgaagagggaggatgattcaggcagaacagtgtgggcaaaggcatgaagggaaaagtatacgtgaccctccaataggctgtagcacagttgtcagtaacaataattgttaatacttataatgcacttaaaccatcagccaggcaagggctttatacacagcatccaat

SEQ ID NO: 88934 - DNA, 601 bp, Human
tccaggttccttaccagatgccttgaggctctctcccactccccagctgaagcaaaacaaaatatgtaaagaatgaatggaaactcatgctggaggttggaaataaaaagccatggggccttggggataaagaagctaaatggtctgacattttgttgatgcttaccaaagcattgtcccacacatgagatcgtcacacctaccagagaatgacacagccacatacacatccctaaaaagaacttagaatttctacttcaagattcaatacatttattctgaatttttattgactgcctcytaagctctgccttgcaagtgacacaaagctgaccttgccctctaagaactgatcatcatcgtcagcccagatgacaaggtgtatgtattcaggcaggagctggggcaggatagcatggcagtaactcaaatatataactaatgctaacaaaaatcataatataaggatccctagccagtcaagtaagaaacagtccatataggaataaagtatctggttgtcagaaatcaagaatttgggataaggtaaagtaaaacttaccagactcacaaaattgggtgggggtgaagagggaggatg

SEQ ID NO: 88935 - DNA, 601 bp, Human
gagctctgattgtgttgtaggtttccatcctcatactagaatcagcttaccaagctccaggttccttaccagatgccttgaggctctctcccactccccagctgaagcaaaacaaaatatgtaaagaatgaatggaaactcatgctggaggttggaaataaaaagccatggggccttggggataaagaagctaaatggtctgacattttgttgatgcttaccaaagcattgtcccacacatgagatcgtcacacctaccagagaatgacacagccacatacacatccctaaaaagaacttrgaatttctacttcaagattcaatacatttattctgaatttttattgactgcctcttaagctctgccttgcaagtgacacaaagctgaccttgccctctaagaactgatcatcatcgtcagcccagatgacaaggtgtatgtattcaggcaggagctggggcaggatagcatggcagtaactcaaatatataactaatgctaacaaaaatcataatataaggatccctagccagtcaagtaagaaacagtccatataggaataaagtatctggttgtcagaaatcaagaatttgggataag

SEQ ID NO: 88936 - DNA, 601 bp, Human
ctctgtccttgacgtttattatgatccacgtgctaccatcagctgaaaactgctcacaggctatcacagcatttctcatgcttgagtcattcatgttcagcctccgctatttttgccctatgtgaacgccacctctagtattatttctgtaatagtgttgaacactgactgattctttgtactccagtaagtgtattctaagacaaaattttagatcactaccatcaataaaaatccagtatcacctgccataaatagagggtggaagtgaaaatgaatatgacataaaaccattttttaytgaattctagctagatattattgtctgctaagcctctgctatctgctctgtttgttaaaaatggaggttaaaaagtattagacggtgttgaaggcacagcaccacctaatcaaagtttaatccttgtcatactcagaaagattgaaaaagaatttaaaaaggaataattttctcaccccatgataggacataacttaatccctcatcaatgcacccccaatcatctcatgtgccccctaaaatcatctttcaattcatcagaacattcatttcacactttgagtaaagctatatgatttc

SEQ ID NO: 88937 - DNA, 601 bp, Human
tcccaaatgatactcatctaagggtaaaaatcatatagcataaccctgtcatctccttgagtttggagacagttgtttacttccttctctttgtggagtttctttgtaatgcatggtgctttgtgcagtgccagggcattggtgagcacctacaataactggtagatttgaccctgagctatctgggttttaccatgggccagttcatgcctggtggctgttgtgggaaaaagagactcaagatgaggaacttgacccagaaatggatgaaataattattcacactgcagttgctctcagycagggtgaccttgggggaaatgccttctgcatctggaccctcatgtgtctaacacaggatctgatcctgagcttaagttccgtccccagcactcagcttctatggttcaatgaagaccaaagcaaactccattttcccgaacccctgctttacccatcagccttcagaacaggctaaattcatacccaaaatgtcagaggaaagactgtttcatctagttcataagcagctcatttcttttctcctattaagagatcagaagagagagttacatttttccttcactctgtccttgacgtt

SEQ ID NO: 88938 - DNA, 601 bp, Human
ggaaatcactgaaacatgggagtggttgttattgaagcagaacctggtcaaagctgactaatacagggcttctcactcctgggaggaccttcctaactgactctatcatagcagacttgctacttacctcccaaatgatactcatctaagggtaaaaatcatatagcataaccctgtcatctccttgagtttggagacagttgtttacttccttctctttgtggagtttctttgtaatgcatggtgctttgtgcagtgccagggcattggtgagcacctacaataactggtagatttgacyctgagctatctgggttttaccatgggccagttcatgcctggtggctgttgtgggaaaaagagactcaagatgaggaacttgacccagaaatggatgaaataattattcacactgcagttgctctcagccagggtgaccttgggggaaatgccttctgcatctggaccctcatgtgtctaacacaggatctgatcctgagcttaagttccgtccccagcactcagcttctatggttcaatgaagaccaaagcaaactccattttcccgaacccctgctttacccatcagccttcagaacag

SEQ ID NO: 88939 - DNA, 601 bp, Human
atctctttgtctgagtgctttctcggaagctagaaggctactctctgtgtgtacacacgggctggaagtgctaggaaattaaaactcctcaggagtagccttcaacccatgtctggaaggtttggttgtgtaaatataccagctcccttgttcctcaggagggtaattctaaggcacatgatttgccctgttttccagaatttctccatgggactgaactggagttgtccacagtggtagctagcttgataacacatgttctcctgactgccttccttgtctcatttctccattccctgaytgatgtttcctatatctccctaataatctgtatgagtttgaagccgtgttgtaaaatctgctcctaggaacccaaaccaacacaaaacagaagtaacacatgccacttccaagtagaagcattaggaagttccccatggttctgctattgctcttttcccctctggtttaagagaggtgtggccctggctgctgcttcagcccgggtcctaggtgaagaaggtacagtaaatgcatgcagttgccctgcaaccaatgtgtaacagacacaaaatcaaattttgttgttggaaatcactga

SEQ ID NO: 88940 - DNA, 601 bp, Human
acagtcctccacggcaaagaattagccagccccaaatgtcaatagtgctgaggtcaaaacaccctggtctggatggtagctctcagttaaccatctattacatgtactgtgtcaactagagtttattatacttatgaatcagggttcagggcctgttttggttctcaagtattgctgcacctctgtgggaggattacacttctctatccctgaagacgtcctttgccacgtgaattcctttggataaagaaatgtgagcatgtctcagatgctctcagtgccccactcacgtccctcctcyctgtccctctaatgcactccagccaacttgtaactgctagcatctatctctttgtctgagtgctttctcggaagctagaaggctactctctgtgtgtacacacgggctggaagtgctaggaaattaaaactcctcaggagtagccttcaacccatgtctggaaggtttggttgtgtaaatataccagctcccttgttcctcaggagggtaattctaaggcacatgatttgccctgttttccagaatttctccatgggactgaactggagttgtccacagtggtagctagcttgataacac

SEQ ID NO: 88941 - DNA, 601 bp, Human
ctacaggggtgacttttcccctaggaacacgtggcaacacctggagacatgtttggttgtcacaattatgaggtgaggggagggaggctatgggcaccaagtgggtagaggacaggaatgctgctaaacatgctataatgcataaaacagtcctccacggcaaagaattagccagccccaaatgtcaatagtgctgaggtcaaaacaccctggtctggatggtagctctcagttaaccatctattacatgtactgtgtcaactagagtttattatacttatgaatcagggttcagggcctrttttggttctcaagtattgctgcacctctgtgggaggattacacttctctatccctgaagacgtcctttgccacgtgaattcctttggataaagaaatgtgagcatgtctcagatgctctcagtgccccactcacgtccctcctctctgtccctctaatgcactccagccaacttgtaactgctagcatctatctctttgtctgagtgctttctcggaagctagaaggctactctctgtgtgtacacacgggctggaagtgctaggaaattaaaactcctcaggagtagccttcaaccca

SEQ ID NO: 88942 - DNA, 601 bp, Human
ttcatcctttaaaaccccgctctgctgtctctgtctctgcaaagacttccctgaccatccccagcctgcaacaaaagtgatgtttaccactcctgaactatttctgttttctttacataattcaaattgttgttacccagggtggactggccattacagtttatatgtctgtctgtctgtctctcccatcaggctgtgcacacctccatcgaggcatccacaatttatttcagttccttgggaattagcaatgcatatatggtctacatcagtggctctctacaggggtgacttttccccyaggaacacgtggcaacacctggagacatgtttggttgtcacaattatgaggtgaggggagggaggctatgggcaccaagtgggtagaggacaggaatgctgctaaacatgctataatgcataaaacagtcctccacggcaaagaattagccagccccaaatgtcaatagtgctgaggtcaaaacaccctggtctggatggtagctctcagttaaccatctattacatgtactgtgtcaactagagtttattatacttatgaatcagggttcagggcctgttttggttctcaagtattgct

SEQ ID NO: 88943 - DNA, 601 bp, Human
agcttgggacacagctaaagttgctacagatgcctcttctcggttgccaaaggttttgtaacttacaaaatagggagctcattggagggtttcaaacctcatttggggtacaggaccagagaatgccttcagatctctccaggctgtcaaattccaggatacaagttcccccagggacatctctaacacatctggcttggtctcaaaatgacagaggaactagcacttagagcactttctgtcagccagttgctttatactgagttcttccagcaactctctgcacggaattattattatstccatcttcttgatgaggcaaagagagagaaaataacttgctccaggacacgtggctgacaaggtctggagctaggacctgagccaaagaaagaaggaagaaaatgatatctgggtgtagtacttggtactcaataggtgttttgaacaggaggggcatcataccttttcctcactgattggttctcattcaagcatctacaaaggaccaggacacggaggtgtacaaggcaggctaggtctgtacctgcactgagtggtatttcctgttccaccaaagacaagagcttagcaggtggca

SEQ ID NO: 88944 - DNA, 601 bp, Human
gttccagaccgtggatgtctgagtaggaggcagacagcaggctgttgcctggtagtggggaaggaagggcggatggcttggagcttgggacacagctaaagttgctacagatgcctcttctcggttgccaaaggttttgtaacttacaaaatagggagctcattggagggtttcaaacctcatttggggtacaggaccagagaatgccttcagatctctccaggctgtcaaattccaggatacaagttcccccagggacatctctaacacatctggcttggtctcaaaatgacagaggaaytagcacttagagcactttctgtcagccagttgctttatactgagttcttccagcaactctctgcacggaattattattatgtccatcttcttgatgaggcaaagagagagaaaataacttgctccaggacacgtggctgacaaggtctggagctaggacctgagccaaagaaagaaggaagaaaatgatatctgggtgtagtacttggtactcaataggtgttttgaacaggaggggcatcataccttttcctcactgattggttctcattcaagcatctacaaaggaccaggacacgga

SEQ ID NO: 88945 - DNA, 601 bp, Human
agcggcagaccctcaaagtcggactcctgagccaatgcatgttactattgcacaccctgcctctcactggagaggcttactgtctctctagagaaggggaggtgtgcagcatgaatgtcataaaggatgggaagtggagaagccaggagtggctgcaggtgaggttcagaaagcaaaaccatcttttgggtgttgtgtattctgccccagatgacaattttggggttgttccagaccgtggatgtctgagtaggaggcagacagcaggctgttgcctggtagtggggaaggaagggcggayggcttggagcttgggacacagctaaagttgctacagatgcctcttctcggttgccaaaggttttgtaacttacaaaatagggagctcattggagggtttcaaacctcatttggggtacaggaccagagaatgccttcagatctctccaggctgtcaaattccaggatacaagttcccccagggacatctctaacacatctggcttggtctcaaaatgacagaggaactagcacttagagcactttctgtcagccagttgctttatactgagttcttccagcaactctctgcacggaatta

SEQ ID NO: 88946 - DNA, 601 bp, Human
ttatgtaagaactatatagatgtatggatttattgatccaaggaacatactctgaagcaatagtcttctatataaagatcaagctccctaacatagcacacaggccctctgtgtccaggctggcctccctcacttctggagaaggcctttgttactcgctcctcctttctgcttcccccaccccttgtcaggcatcaaaatctcccatatcatggcaatcctttaggttaagaagaggggacaaatgggtgagaacacagaggactctgagtctaagccacagagttggatttagtcttakggtagaaaggaataaaggcttttgtcagctgggtacggtggctcacacctgtaatctcagcactttgggaggcctaggcaggaggactccttgagcctaggagttcaagaccaccctggacaacatggcaaaaccaagtcttccacaaaaatacaaaaattaactgggcatggtgatgcctgcctgcagtctcagctactccaagggctgaagtagaggatcacttgagcctgggaggttgaggctgcagtgagccacgttcacaccactgcactctagcctaggtgatagacacagtga

SEQ ID NO: 88947 - DNA, 601 bp, Human
tcatcatcagtgtcatctttggcctttgatgtcccttttctctccttaggcaagaaccatggctgtttccctcccacgttttgtgaatttctacttggttatcccagcagcctgtgggtaagcccctgagcctgtcagtagctctgacaccagatgaccttccctgggtgcctaccttcacttctctaacaccacccttccaaccccagtgaccattaaccatttcatccttggaagacttgctctttgacatttaaccctgacccagtaaagtcattagtctttaacttctaaatcccartgtagaagaaactagctcattttaaggcccagagatgccccagcttctgatcttttcttgatgcttaaattctaaatgttccatagcttaatttactcctggattttgtggaaggacctctctttgttttctaattaaatgtaaaatgaaaggtcaagctgttgttttgaggtaggtttggactctagtctccatgtcaccttccatggcttccataaaccataacaccatttctcagatgtgcctctcagaacactaatcacctaaaatgttcctgcatttattttgtttatttattta

SEQ ID NO: 88948 - DNA, 601 bp, Human
ggctttaaagtttacctacccagtgttttgatgacaaagacgtcacaaactgtcctactgacttttgtcatttggttcgagagcccaaggtcactgtttgtttggacattgtgtaattatgggagttaaagtcatcatcagtgtcatctttggcctttgatgtcccttttctctccttaggcaagaaccatggctgtttccctcccacgttttgtgaatttctacttggttatcccagcagcctgtgggtaagcccctgagcctgtcagtagctctgacaccagatgaccttccctgggtrcctaccttcacttctctaacaccacccttccaaccccagtgaccattaaccatttcatccttggaagacttgctctttgacatttaaccctgacccagtaaagtcattagtctttaacttctaaatcccagtgtagaagaaactagctcattttaaggcccagagatgccccagcttctgatcttttcttgatgcttaaattctaaatgttccatagcttaatttactcctggattttgtggaaggacctctctttgttttctaattaaatgtaaaatgaaaggtcaagctgttgttttg

SEQ ID NO: 88949 - DNA, 601 bp, Human
ggaccaaatatcttatgcctttagtactattaaaaaatacctttttcaccacaaaagccagacctgctaattttcccaccaaatacaggcagcagtgcaacatcgctgacacttttactttagatctttggacccaagactttgacagcagggtaaactgcttgacaataaaatcttagttaaagccacttgcacttgctagtggaaatacagctatcacacaacagggaaatggcagagctgcaattcatgaattttcatttgtgtcaatttcttcacagtgatggctgaagacactaamattagaacctgtagaaagaacatgaggctgaaagtagaggacatattcattaaggactgcgtcacacacttttgggttcttcaattcttcaagatccaatcatggatgatgattttgatttaaaaaaatacagcttttccaagtcaccacttacctgctatactgcagagaaaaagctgtcagctgctttaaagttttcctagccagtgttttgacctcaaagacatcaaaaactgtcctatcgactgctgtcatttggctcaggagcccaaggtcactgtttgtttggatgttgtgtaa

SEQ ID NO: 88950 - DNA, 601 bp, Human
tcctgcaaaatagttaaacaaatgacaccacagcaatagtgaagtataacagagccattaaaagacagaattccttacccatattctcatatggcaacctactgcatgtacataaagctgagcatagtcaggtcctacatattgtccacacaatataagagtgaccattaggacaacaaccaaggctagaaaagaatttaaaataagaattttatagtatattaaaatggtttaagttctttttctttaaaaaaaggggggaaaggcagtgtgccatggctcatgcctgtaatcccagcgstttgggaggccaaggtgtgcagatcaccaggtcaagagattgagaccatcctggccaacgtggtaaaaccccgtctctaccaaaaatacaaaaattagctgggtgtggtggcaggtggctatagccccagctacttgggaggctaaggcagtagaatcgctcaaacccaagaggcaaaggttacagtgagtcgagattgtgtcactgtactccagcctggcaacagagcaagactccgtctaaaaaaaaaaagggaggtgggggaagcctagaaaacagatataaagtatgtaacatgat

SEQ ID NO: 88951 - DNA, 601 bp, Human
tggttgcaatgtgggcaaaaatgcggtgcattccaagacacctacttttgatcaagaatataacgtatcttttctctggggcagcaaaattcaaggatccttctcagacatttgaaatttcttctgagggtctagaatattcctttgctcttgtcgtttacgcttgtcttgaaacagactaagcaggtgaatggcattgacaaatgtaaaatctctgacaatttagagagaatattaagaaaaatggggaaaatgagaataaaagtaatccttattctttcaaatataaagtctttatgtraattttattacataaaaatgtaaaactaattttctgataacacattatttaagtattgttatttcaggcaataattaactttttactcatttaatttgctcatttttatggcaagcattgtatctcttattataaaaaagtaagatcttttaggctgggcatggtggctcacgcctgtaatcccagcacgctgggaggtcgaggcgggcagatcatgaggtcaggagatcgagaccatcctatctaacatggtaaaaccccgtctctgttaaaactacaaaagaaaaaagaaaaaaaaaa

SEQ ID NO: 88952 - DNA, 601 bp, Human
ttgaggtcaggagttcaagaccagcctagtcaacatggtgaaaccccacctctactaaaaatacaaaaattagctgggcatagtggcatgtgcctgtaatcccagctactcgggaggctgaggcaggagaatcacttgaacctgggaagcagaggttgcagtgagtcaagatcatgccactgcactccaacctaggcaacagagcaagactccatctcatctcaaaaaaaaaaaaaaaaaaatcttagctgatggtctccttgaacaagttaggtaactctgagccttggttttctcataygtaaggcacagcagatggataacaacactgtccattacagagctgtttctctttagttacaaacaaaataattatgtgaaatacatggtgcatggccaactgcccatgaaagttggtgtggccttctgagcaggttgtaggatgtctagcagtaatgattctaaagattctataactttgtacttagctacactttgagagttcctgaatgaattgaataccatcaaatacacctagactgggggaccccatgatgtttttttccaaattcatcctcacaaacttataatcgacccatac

SEQ ID NO: 88953 - DNA, 601 bp, Human
tttacccccaaccgcccgcatccctgtcacccaagaacacatctgagactttgcaccacatactgaaatacgtgcctactctcatgtggacacaaatagataccagaagcctggcctagccccaacagaaacatgacacatcttccacgaacagcaaaatcttcctgaatttcctccgttctaattatacattttcccatattttaagttttctgaaaatggaatgtgtctcataatgaatgtagtttcccttatcccaatgctgttataaaatcaatggaaactcctataaatgattacrtttataatcagagaaacatggtagtttaaaccataacatttacatagaaatacaaacaaacaatagagcatgatgtaaaaatttgcttggtttcaaagaatttttcccttgtggcaggcccctttggccaatgtgagttcaaactcttctaccttgttggtagagagacttaaaacattatagagtttactctcaggatgaaaaaaggccaaaggtaagacggtctgtgaatgagaccaaccatggtgagctcactttcagaatctcagcatcagagagacctgacttccctcctcccaa

SEQ ID NO: 88954 - DNA, 601 bp, Human
ccaggaagtctgaggtggagggattccttgaagcctaggagttccaggctgcagtgggctacgattacactactgtacccagcctatgtgacaacgcaagactatgtttcttaaaactaactaaataaataaataaaataaataaaaaatcctgaaatcaaaggatctgtgttggcccacctcttccaacgtttctcttttgccctaacacagtggttctcagccaggggcaattttgtaatgtctggacacatttttggttttgctgcaaatcaccccccaaaacaaagaattattttgmcccaaatgccaatagggccgaggtcgagaaaccctatcccaacagatgtcagggaggcagaaggagccagccatgggcaattccttacactttttacccccaaccgcccgcatccctgtcacccaagaacacatctgagactttgcaccacatactgaaatacgtgcctactctcatgtggacacaaatagataccagaagcctggcctagccccaacagaaacatgacacatcttccacgaacagcaaaatcttcctgaatttcctccgttctaattatacattttcccatattttaag

SEQ ID NO: 88955 - DNA, 601 bp, Human
ttcaattacaggccaaagcctcccttgaaaggatgttaagtgaataaagagtatgatcataggacttagtgcaatattaatatacatttaaactttaaggagggaggatttcaacagacagcactgttagaatggtaccactggttaaaaatcctataatcctggcaactactgagaaaagtttcatgcctagaagagtccctagaaacccttgggtctgatcgttatacagatagaagaccaaaacacaaatctattaccaaatggcaaaggtatcctattagtggcatactgggacaakaggccttctgatataaaaagaaagtcttagctgggtgcagtggctcctgtctgtaatcccagggcttttggaggctgaggagagaggattggttgggaccaggagtttgagaccagcctggtcaatataacaagaccccgtgtctacaaaaaaaaaatttttttttaaattagccaggcatgatggtgcacacctggagtccccactaccaggaagtctgaggtggagggattccttgaagcctaggagttccaggctgcagtgggctacgattacactactgtacccagcctatgtgac

SEQ ID NO: 88956 - DNA, 601 bp, Human
ttgatctgtgtgattgatggatgtgcatcatcccccactagactgtacccttcttgagaacagaattggaacttgtttcctcactgctaaatcacctattaagagcacaatagggtttccaataaattttagctacattaaaatatgtgagtctctaatagagagctcgaagacaaatgattaattcccacctcagatgatcaaaatttctttcaatgatccttggcaaatatccctaatagcaagggtggacatgagctagaccttcagaaaagaagaaagtcttgtcacctttctaccrtcaacagaccatgttgatatttaattaattgcatgttaaatagtatttaggcatttattattattgtgcttttgccccgctggctcccagtgactccttactcctatttcaattacaggccaaagcctcccttgaaaggatgttaagtgaataaagagtatgatcataggacttagtgcaatattaatatacatttaaactttaaggagggaggatttcaacagacagcactgttagaatggtaccactggttaaaaatcctataatcctggcaactactgagaaaagtttcatgcctag

SEQ ID NO: 88957 - DNA, 601 bp, Human
tacttacataccatgccctggttatgaatctcaaacttcatctagttccacttagttttccagcctgcttctgatgttgagtgaagaatgtcagtgttgggagtgaattaccttaacacatccacggtcccttatcagtccaagccacagctttctgcagagggaaggtttaattaccaaaagctctgtgacgcagttagcactatttttggctggcaggcagggcaggttagttctttatccatccctgccttggctgagccccagaggtcacagacagagagcattttcaccatcccarggccaagcccatctttctagaagccattccaatgctgcctcttgagaaagcagtaaggccccagttcccttctgcaaaggagtggcacaatttctcctcctgatattctcacccctgtctagaattgcaagctgtctcagggcatgctcactgcactgagagagctgcccttgttttgtaatacaccttactggatacatttcagagggttaggttgagatggttggcagtgagttcatgcatggctaaactgcaccatgcgagaaatcaatgggaactcaagggattgggaattaagga

SEQ ID NO: 88958 - DNA, 601 bp, Human
aactttgttggcacatgttctgtctttttgctacttacataccatgccctggttatgaatctcaaacttcatctagttccacttagttttccagcctgcttctgatgttgagtgaagaatgtcagtgttgggagtgaattaccttaacacatccacggtcccttatcagtccaagccacagctttctgcagagggaaggtttaattaccaaaagctctgtgacgcagttagcactatttttggctggcaggcagggcaggttagttctttatccatccctgccttggctgagccccagagktcacagacagagagcattttcaccatcccaaggccaagcccatctttctagaagccattccaatgctgcctcttgagaaagcagtaaggccccagttcccttctgcaaaggagtggcacaatttctcctcctgatattctcacccctgtctagaattgcaagctgtctcagggcatgctcactgcactgagagagctgcccttgttttgtaatacaccttactggatacatttcagagggttaggttgagatggttggcagtgagttcatgcatggctaaactgcaccatgcgagaaatc

SEQ ID NO: 88959 - DNA, 601 bp, Human
tcagagtaaaaacaaagaactacttaatctataagaaactttgttggcacatgttctgtctttttgctacttacataccatgccctggttatgaatctcaaacttcatctagttccacttagttttccagcctgcttctgatgttgagtgaagaatgtcagtgttgggagtgaattaccttaacacatccacggtcccttatcagtccaagccacagctttctgcagagggaaggtttaattaccaaaagctctgtgacgcagttagcactatttttggctggcaggcagggcaggttagytctttatccatccctgccttggctgagccccagaggtcacagacagagagcattttcaccatcccaaggccaagcccatctttctagaagccattccaatgctgcctcttgagaaagcagtaaggccccagttcccttctgcaaaggagtggcacaatttctcctcctgatattctcacccctgtctagaattgcaagctgtctcagggcatgctcactgcactgagagagctgcccttgttttgtaatacaccttactggatacatttcagagggttaggttgagatggttggcagtga

SEQ ID NO: 88960 - DNA, 601 bp, Human
atctgtgaatgataagatgatggatgggtttttacttccttattgcttctttcctttatgtttccaactttctacagcaaaaatgaagcatttttatgatcagaaacaaagttgctaactaagctgactgaccaaaaaggaaaaaagtccatatgactcagagtaaaaacaaagaactacttaatctataagaaactttgttggcacatgttctgtctttttgctacttacataccatgccctggttatgaatctcaaacttcatctagttccacttagttttccagcctgcttctgatgytgagtgaagaatgtcagtgttgggagtgaattaccttaacacatccacggtcccttatcagtccaagccacagctttctgcagagggaaggtttaattaccaaaagctctgtgacgcagttagcactatttttggctggcaggcagggcaggttagttctttatccatccctgccttggctgagccccagaggtcacagacagagagcattttcaccatcccaaggccaagcccatctttctagaagccattccaatgctgcctcttgagaaagcagtaaggccccagttcccttctgca

SEQ ID NO: 88961 - DNA, 601 bp, Human
cccatcagatacagtatgattgggagtatattgtgtgtacatttaaaaggtaagacagaaaactgcagatatactctgattattattttattttttatttttatttatttatttattttttgagacagagtcttgctctgttgcccaggccagagtgcagtggcacaatctcggctcactacaaccctctcctcccaggctcaagcgattctcctgcctcaatctcctgagtagctgggactacaggtgcatgccactacgccctgttaatttttgtatttttagtagagacggggtttcmccatattggccaggctggtctcaaactcctgacatcatgatccacccacctcattctcccaaattggtgggattacaggcgtgagtcaccgcatctggccctgatcataattttataaaaattgtacattgcatcgagaaaaaagtggacacaaaaggttcctagtggctatctgtgaatgataagatgatggatgggtttttacttccttattgcttctttcctttatgtttccaactttctacagcaaaaatgaagcatttttatgatcagaaacaaagttgctaactaagctgactg

SEQ ID NO: 88962 - DNA, 601 bp, Human
acttgagccagaccttaaccccaggtatctggggatccttccgtaaagacacagcaagataagattttatctcagcttttaaatttgggactctaaaaagcttggctgatgcaacaaaccctttgatgatttatttaaatacttatagctgcagctgcccatcaagcctgattaggaagatgcctgggctgagattggagctgcttgttggtctgaacccaaatctcctaccaggcactgaagtgtcctcaattcatggtctggaaaatgaaatggaaggagccttaagatttcattcttytgactcccctaaactttaaatacaccttctctctgagagaacatattaatactaaaagccaccaatatttttacttccttttaaagattatcttaaagagtgaacccatctacccactatcctcatccaatagaatcagctgacccagtccttgttggagagattaataaaaataatatactaatgatggctaacattcattgagtacttactctgagtcaggtactatcctccaataacccagtgaaatacataataccattagtcccactttataagtgagaaaattgaggtttagag

SEQ ID NO: 88963 - DNA, 601 bp, Human
gggactcagctctggaccacaaggcattcgatctaatggcagagacatgacctataaacaagagtaactaatgacagaaatgtaaacagactgtaggctctttgagggcaggttcacgtcatatacgccagggacttagaggaggcagtcaataactgtttgttgagtgactcaaagcgtaagctagtaagatcctctgctcatggcacttattatcctctgaaatcataaagaagtcagaaagggctttctcagtgaaatgacagtgaagcggagactcataggatggatatgacagacmaaacagagaagaggggcagggcaggggcatgtgccaaggcatgggagcaggactccccatgggtaccccacatcttggacacaggatggaagaagacctcgtgctcacagcagtagttctgtaggcaaggagctgggactggaaaggggactggaaagataaatagggtcagatggtggaagtgcttcagtgccaaagggaggagtttagactttggaaaaagacatctctgaagatacagatttgacagttaactactttaaaaagctagaaaaagctgagggaagaaattagctctcc

SEQ ID NO: 88964 - DNA, 601 bp, Human
caagcatagagcagggacttcttcctcccttagtctccatgggctactccttcccctgccagctctgcaaccctttatgagcctccccaagaatcacacactcaaaagagccaccagcaaaccagacagggaaagaagctgcctttcactcaactcgggatgtgctgagcatctggcatacccaggggattgaggggatacagtgactgggactcagctctggaccacaaggcattcgatctaatggcagagacatgacctataaacaagagtaactaatgacagaaatgtaaacagactstaggctctttgagggcaggttcacgtcatatacgccagggacttagaggaggcagtcaataactgtttgttgagtgactcaaagcgtaagctagtaagatcctctgctcatggcacttattatcctctgaaatcataaagaagtcagaaagggctttctcagtgaaatgacagtgaagcggagactcataggatggatatgacagaccaaacagagaagaggggcagggcaggggcatgtgccaaggcatgggagcaggactccccatgggtaccccacatcttggacacaggatggaag

SEQ ID NO: 88965 - DNA, 601 bp, Human
tttaagttctggcatccatgtgcagaacgtgtaggtctgttacataggtatgcatgtgccatggtggtttgctgcacccatcaacccatcatctacattaggtatttctcctaatgctatccctcccctagacccatgttcttaatgcatcttagccatggctgctttccatttgaggcatccatttccatcccacctcctgctgttctggggtcaagcatagagcagggacttcttcctcccttagtctccatgggctactccttcccctgccagctctgcaaccctttatgagcctccycaagaatcacacactcaaaagagccaccagcaaaccagacagggaaagaagctgcctttcactcaactcgggatgtgctgagcatctggcatacccaggggattgaggggatacagtgactgggactcagctctggaccacaaggcattcgatctaatggcagagacatgacctataaacaagagtaactaatgacagaaatgtaaacagactgtaggctctttgagggcaggttcacgtcatatacgccagggacttagaggaggcagtcaataactgtttgttgagtgactcaaagcg

SEQ ID NO: 88966 - DNA, 601 bp, Human
accagtgatggggacaggcagaagacggggagctgaaggttacctccccacaccaatcacaccatgaaatacccacacagcacctggggcagaggttaccagagttaactataaccccttcaccaaccagactctttccctgtctcttaaaaaaaggtaaagaaatagttttacaatatattttccagatgagctaaataatatacattttgtctacagaaaaatacaatgatgaatatgaaaatcaccagtaaatcccactgccaggaaaatctaagtaatagccaatgcttgtaccaakaattattttaaatgttttatattcattttaactcattttcttagttaaacctcacaacctctctataaagttgacattgttttaagacccattttgcaggtgagaacaccaagtcacagagaaattaagtaacttgctcaaggtctcacaatcattaagcataagagctgcaacaattaaaacgcagacccatgttctttttttttttctttatactttaagttctggcatccatgtgcagaacgtgtaggtctgttacataggtatgcatgtgccatggtggtttgctgcacccatcaa

SEQ ID NO: 88967 - DNA, 601 bp, Human
cctgctttctcagcttcaaggactaggaaactatcttcgagcaataaaaagcacaatcttcggcctgctcactcaccctctctgtaacaggaagggcttctggagccctgagcacctggattggatcaaattccatccactctgatttggaagtgagctagaggagcttttaatctccagaaggtagtaagagaattggaccaaccaattaggcttagcagctctgattcaaacagtgagcacgtaactgagaaatatttttggtttgtctctaagtggagttttgaatgccccaagagtaaaaaaaaatagtccttttaaaaataataaacaagccgatttaagcagcatgctgaacccaagcaatccagtccatgatgcttggcctgtttcatgccagtatcacatatgccgccaaaggactcgcagtgctaagaccatcacacctcataactcttgctaaataccagggttccaattacagctccactgtaaaacacttcataaaacgtgcagaccttgctcctgcttttgcaaacccagccttgtcttccctcctttctctcctgggttctgcaaatggccttccagctttcagaac

SEQ ID NO: 88968 - DNA, 601 bp, Human
aacctccctcttcagacaatgtgcttgttctgaatttcaaaaagaatgggagacccttcctgctttctcagcttcaaggactaggaaactatcttcgagcaataaaaagcacaatcttcggcctgctcactcaccctctctgtaacaggaagggcttctggagccctgagcacctggattggatcaaattccatccactctgatttggaagtgagctagaggagcttttaatctccagaaggtagtaagagaattggaccaaccaattaggcttagcagctctgattcaaacagtgagcamgtaactgagaaatatttttggtttgtctctaagtggagttttgaatgccccaagagtaaaaaaaaatagtccttttaaaaataataaacaagccgatttaagcagcatgctgaacccaagcaatccagtccatgatgcttggcctgtttcatgccagtatcacatatgccgccaaaggactcgcagtgctaagaccatcacacctcataactcttgctaaataccagggttccaattacagctccactgtaaaacacttcataaaacgtgcagaccttgctcctgcttttgcaaacccag

SEQ ID NO: 88969 - DNA, 601 bp, Human
aatgaagcaatgtactgttgagcgggatatttaatataaggtggtcaggaggtgacatttaaccagtgacttgaagaaagttacagtgaccatgtggatcttggggaaaagtattctgagaaggaacagcaagtgcaaaggcctgaggcagaagcaagcttggtatatgctacaaatagtagcaagctctcactacacagtgcacaggtcaaattctgtgagtgcatgcttgatgggattatggaactctccccctgaaaatgcacatacagacaaactttccttacaatttcagaccccrgaagacctttacccacagcccctagttaagatcctttgttctactccaaccagttgttgcttctgacatggctctgtgattccaaaaggctgagtcctggctgccatccctcacatggtgaaagacaaaaagaaggccaacctccctcttcagacaatgtgcttgttctgaatttcaaaaagaatgggagacccttcctgctttctcagcttcaaggactaggaaactatcttcgagcaataaaaagcacaatcttcggcctgctcactcaccctctctgtaacaggaagggcttctgga

SEQ ID NO: 88970 - DNA, 601 bp, Human
ccattcaacagacatttgctgagcatcttctctgggcttggcattgttctatatgctacagatacagcagtgaataccatagaggcttacatactgaaagagggaggtaataacaaacaatgtcatatggaataagcactgtaaagaacaatgaagcaatgtactgttgagcgggatatttaatataaggtggtcaggaggtgacatttaaccagtgacttgaagaaagttacagtgaccatgtggatcttggggaaaagtattctgagaaggaacagcaagtgcaaaggcctgaggcagragcaagcttggtatatgctacaaatagtagcaagctctcactacacagtgcacaggtcaaattctgtgagtgcatgcttgatgggattatggaactctccccctgaaaatgcacatacagacaaactttccttacaatttcagaccccggaagacctttacccacagcccctagttaagatcctttgttctactccaaccagttgttgcttctgacatggctctgtgattccaaaaggctgagtcctggctgccatccctcacatggtgaaagacaaaaagaaggccaacctccctcttc

SEQ ID NO: 88971 - DNA, 601 bp, Human
gttattaatttgttcatgcatttacccattcaacagacatttgctgagcatcttctctgggcttggcattgttctatatgctacagatacagcagtgaataccatagaggcttacatactgaaagagggaggtaataacaaacaatgtcatatggaataagcactgtaaagaacaatgaagcaatgtactgttgagcgggatatttaatataaggtggtcaggaggtgacatttaaccagtgacttgaagaaagttacagtgaccatgtggatcttggggaaaagtattctgagaaggaayagcaagtgcaaaggcctgaggcagaagcaagcttggtatatgctacaaatagtagcaagctctcactacacagtgcacaggtcaaattctgtgagtgcatgcttgatgggattatggaactctccccctgaaaatgcacatacagacaaactttccttacaatttcagaccccggaagacctttacccacagcccctagttaagatcctttgttctactccaaccagttgttgcttctgacatggctctgtgattccaaaaggctgagtcctggctgccatccctcacatggtgaaagac

SEQ ID NO: 88972 - DNA, 601 bp, Human
agacacacacaggcacacacacacacacacagatctggtgtattcgaaaaacagaaattaataatgatgtacaagcattgtgaaatcccttgaaaacttctgcctaaacatctattacaatgtcaggtgatcatttcatagcagatgaaatgtctggaacccaagacacatggctgagaagtggccccactgagaactcagatccttttttacccatcattaaaactttttttttttacaggtgagacctaagtataatcaaagttattaatttgttcatgcatttacccattcaacagayatttgctgagcatcttctctgggcttggcattgttctatatgctacagatacagcagtgaataccatagaggcttacatactgaaagagggaggtaataacaaacaatgtcatatggaataagcactgtaaagaacaatgaagcaatgtactgttgagcgggatatttaatataaggtggtcaggaggtgacatttaaccagtgacttgaagaaagttacagtgaccatgtggatcttggggaaaagtattctgagaaggaacagcaagtgcaaaggcctgaggcagaagcaagcttggt

SEQ ID NO: 88973 - DNA, 601 bp, Human
ttgaattccttctggctctggtgtcaagagcctggacaccaaccaggatggaggtcccctgggaatttggggacctaccctagcacatcagtagcagtagtattagcatccccattttcaaatggagataacctattatctgtgcaccagaataataataataataatagtatctgtgcaccaggatgtgcacagacacacacacagaggcacacacacacatttttacacagacacacacaggcacacacacacacacacagatctggtgtattcgaaaaacagaaattaataatgatgyacaagcattgtgaaatcccttgaaaacttctgcctaaacatctattacaatgtcaggtgatcatttcatagcagatgaaatgtctggaacccaagacacatggctgagaagtggccccactgagaactcagatccttttttacccatcattaaaactttttttttttacaggtgagacctaagtataatcaaagttattaatttgttcatgcatttacccattcaacagacatttgctgagcatcttctctgggcttggcattgttctatatgctacagatacagcagtgaataccatag

SEQ ID NO: 88974 - DNA, 601 bp, Human
tatacttttcacttgcaataactctccatactttcactattttcctgactagtccttgaattccttctggctctggtgtcaagagcctggacaccaaccaggatggaggtcccctgggaatttggggacctaccctagcacatcagtagcagtagtattagcatccccattttcaaatggagataacctattatctgtgcaccagaataataataataataatagtatctgtgcaccaggatgtgcacagacacacacacagaggcacacacacacatttttacacagacacacacaggcrcacacacacacacacagatctggtgtattcgaaaaacagaaattaataatgatgtacaagcattgtgaaatcccttgaaaacttctgcctaaacatctattacaatgtcaggtgatcatttcatagcagatgaaatgtctggaacccaagacacatggctgagaagtggccccactgagaactcagatccttttttacccatcattaaaactttttttttttacaggtgagacctaagtataatcaaagttattaatttgttcatgcatttacccattcaacagacatttgctgagcatc

SEQ ID NO: 88975 - DNA, 601 bp, Human
ctctcaaatgagtgttttttttgttgttgttgttgttgtttgttgtttgttttttttgccttggttcaaaaggagccacagcataataatttctagtggggtaacttttgctgcctcatgtaagattagagaacaatggctaggtgtggtggctcatgcctgtaatcccagcactttgggaagccgaggtggaaggatcgcttgagccctggaggttgaggctgcagtgaccagtgatcactcccctgcactccagcctgggcgcgacagagtgagaccttgtctcaaaaaaataaaattaaaaaaataaaatgaaattttataagattagagaagaatgcagcatctcttttctgaactttaaccctacacattcagtagcagacgcaattatatcccattcacactcaagttcatgtgtcagaaaatactagccccaagttggtcttgaccacctatattcaactactaggacatcttttccagaatggaacactaatggttctagagtggaactggagtttgcaagagggacttctatcactatcctgctctgatacatcgtgaggcttcagacaagtcacaaaaaccacactggtgt

SEQ ID NO: 88976 - DNA, 601 bp, Human
ggaagaagacagcatttgttttaacaagaaaaatattaacttttaaaagatgagtctaagaagctgtcatttataaaggaagttatccaggatgtactaagctctgtgtgaagatttacctccaagctcacccgatgcagataccgacaaaaagtaactttctgcccaaaatgagtctgaggtttatgcttgaaaatcaaagcagtttgtctagaagagaccagagtttatttctctcagatgtaatgtacctctcaaatgagtgttttttttgttgttgttgttgttgtttgttgtttgttttttttgccttggttcaaaaggagccacagcataataatttctagtggggtaacttttgctgcctcatgtaagattagagaacaatggctaggtgtggtggctcatgcctgtaatcccagcactttgggaagccgaggtggaaggatcgcttgagccctggaggttgaggctgcagtgaccagtgatcactcccctgcactccagcctgggcgcgacagagtgagaccttgtctcaaaaaaataaaattaaaaaaataaaatgaaattttataagattagagaagaatgcagcatctct

SEQ ID NO: 88977 - DNA, 601 bp, Human
atggtgaatcagccatctaagatgtttggaagaagacagcatttgttttaacaagaaaaatattaacttttaaaagatgagtctaagaagctgtcatttataaaggaagttatccaggatgtactaagctctgtgtgaagatttacctccaagctcacccgatgcagataccgacaaaaagtaactttctgcccaaaatgagtctgaggtttatgcttgaaaatcaaagcagtttgtctagaagagaccagagtttatttctctcagatgtaatgtacctctcaaatgagtgttttttttgttgttgttgttgttgtttgttgtttgttttttttgccttggttcaaaaggagccacagcataataatttctagtggggtaacttttgctgcctcatgtaagattagagaacaatggctaggtgtggtggctcatgcctgtaatcccagcactttgggaagccgaggtggaaggatcgcttgagccctggaggttgaggctgcagtgaccagtgatcactcccctgcactccagcctgggcgcgacagagtgagaccttgtctcaaaaaaataaaattaaaaaaataaaatgaaattttat

SEQ ID NO: 88978 - DNA, 601 bp, Human
gaaattctggaaagaaaagttaaaaaatgataggcaaggattacctctgggaatggatgagggttttgcagacaggtgtgtaaatggagattcttatatatttttgtagggtttttgctaggcttttacgtttaaaataatgcatataaatgtatcatgctgtacaattaaaactacttttaagaaatggtgaatcagccatctaagatgtttggaagaagacagcatttgttttaacaagaaaaatattaacttttaaaagatgagtctaagaagctgtcatttataaaggaagttatcsaggatgtactaagctctgtgtgaagatttacctccaagctcacccgatgcagataccgacaaaaagtaactttctgcccaaaatgagtctgaggtttatgcttgaaaatcaaagcagtttgtctagaagagaccagagtttatttctctcagatgtaatgtacctctcaaatgagtgttttttttgttgttgttgttgttgtttgttgtttgttttttttgccttggttcaaaaggagccacagcataataatttctagtggggtaacttttgctgcctcatgtaagattagagaacaat

SEQ ID NO: 88979 - DNA, 601 bp, Human
ctaagatgtatttaagaagttgaaaattgcatatgcatgtgtatatttataatgtttggaaagaaattctggaaagaaaagttaaaaaatgataggcaaggattacctctgggaatggatgagggttttgcagacaggtgtgtaaatggagattcttatatatttttgtagggtttttgctaggcttttacgtttaaaataatgcatataaatgtatcatgctgtacaattaaaactacttttaagaaatggtgaatcagccatctaagatgtttggaagaagacagcatttgttttaacragaaaaatattaacttttaaaagatgagtctaagaagctgtcatttataaaggaagttatccaggatgtactaagctctgtgtgaagatttacctccaagctcacccgatgcagataccgacaaaaagtaactttctgcccaaaatgagtctgaggtttatgcttgaaaatcaaagcagtttgtctagaagagaccagagtttatttctctcagatgtaatgtacctctcaaatgagtgttttttttgttgttgttgttgttgtttgttgtttgttttttttgccttggttcaaaaggag

SEQ ID NO: 88980 - DNA, 601 bp, Human
caaaatttaagatatgtaataccttttcacatcccaaaatgtttttcttaacatctgtcttgagaaatgtggatgtatgttcacaaagatgtcgattctttgcagaattgtttataaaagtaaaaaactgagtaataacctaaatgtcatcaatagaggagtgcttaataaattctgatatattttgatgcaatgaaagtgtatggacctgttaaaaagaaggatgcattgctatatgaactgatatggaaaaatatctaagatgtatttaagaagttgaaaattgcatatgcatgtgtayatttataatgtttggaaagaaattctggaaagaaaagttaaaaaatgataggcaaggattacctctgggaatggatgagggttttgcagacaggtgtgtaaatggagattcttatatatttttgtagggtttttgctaggcttttacgtttaaaataatgcatataaatgtatcatgctgtacaattaaaactacttttaagaaatggtgaatcagccatctaagatgtttggaagaagacagcatttgttttaacaagaaaaatattaacttttaaaagatgagtctaagaagctgtca

SEQ ID NO: 88981 - DNA, 601 bp, Human
gggggtaagtttggtagtttctatcaaaatttaagatatgtaataccttttcacatcccaaaatgtttttcttaacatctgtcttgagaaatgtggatgtatgttcacaaagatgtcgattctttgcagaattgtttataaaagtaaaaaactgagtaataacctaaatgtcatcaatagaggagtgcttaataaattctgatatattttgatgcaatgaaagtgtatggacctgttaaaaagaaggatgcattgctatatgaactgatatggaaaaatatctaagatgtatttaagaagytgaaaattgcatatgcatgtgtatatttataatgtttggaaagaaattctggaaagaaaagttaaaaaatgataggcaaggattacctctgggaatggatgagggttttgcagacaggtgtgtaaatggagattcttatatatttttgtagggtttttgctaggcttttacgtttaaaataatgcatataaatgtatcatgctgtacaattaaaactacttttaagaaatggtgaatcagccatctaagatgtttggaagaagacagcatttgttttaacaagaaaaatattaactttta

SEQ ID NO: 88982 - DNA, 601 bp, Human
gtagaggggagaagtgggggtaacgagacttaagatcgaggaaagtgaacttgggttggcgcaccttaccaacaagtatttaagtatttactacctaccaatactaataaatgaaggcatattttaactaccagctgcatagcaaccctggagaagaagcatttctgaaatagtcgtattcacgaaaatgtttaaaaccctgttaaaaacctaataaggtgtgtgatgttccgcttcctaaagtataatttaaaaatatttttttaaaaaaacctaataaggtatagaacatcacaagcarcatgcaaaaaacactctcaactaccttagcaatcagggcagagtaagtgaaaacaccaatttttgccatcaaattgacaaaacatctttaaaaagttgacaacatctgtgattgccaaggacaggtaaatttaacatgggagtccaaaccggtattgggtgttgggggtaagtttggtagtttctatcaaaatttaagatatgtaataccttttcacatcccaaaatgtttttcttaacatctgtcttgagaaatgtggatgtatgttcacaaagatgtcgattctttgcagaattgttt

SEQ ID NO: 88983 - DNA, 601 bp, Human
actgcattagagcagcctctggaaggttcaggttcgccccgaagtgctacatattaacctcttaattgttgcctcctagggaggtcccaggccggagaggtagaggggagaagtgggggtaacgagacttaagatcgaggaaagtgaacttgggttggcgcaccttaccaacaagtatttaagtatttactacctaccaatactaataaatgaaggcatattttaactaccagctgcatagcaaccctggagaagaagcatttctgaaatagtcgtattcacgaaaatgtttaaaaccctrttaaaaacctaataaggtgtgtgatgttccgcttcctaaagtataatttaaaaatatttttttaaaaaaacctaataaggtatagaacatcacaagcagcatgcaaaaaacactctcaactaccttagcaatcagggcagagtaagtgaaaacaccaatttttgccatcaaattgacaaaacatctttaaaaagttgacaacatctgtgattgccaaggacaggtaaatttaacatgggagtccaaaccggtattgggtgttgggggtaagtttggtagtttctatcaaaatttaagata

SEQ ID NO: 88984 - DNA, 601 bp, Human
tgccaaactatctgaatagaggctggaactgcattagagcagcctctggaaggttcaggttcgccccgaagtgctacatattaacctcttaattgttgcctcctagggaggtcccaggccggagaggtagaggggagaagtgggggtaacgagacttaagatcgaggaaagtgaacttgggttggcgcaccttaccaacaagtatttaagtatttactacctaccaatactaataaatgaaggcatattttaactaccagctgcatagcaaccctggagaagaagcatttctgaaatagtygtattcacgaaaatgtttaaaaccctgttaaaaacctaataaggtgtgtgatgttccgcttcctaaagtataatttaaaaatatttttttaaaaaaacctaataaggtatagaacatcacaagcagcatgcaaaaaacactctcaactaccttagcaatcagggcagagtaagtgaaaacaccaatttttgccatcaaattgacaaaacatctttaaaaagttgacaacatctgtgattgccaaggacaggtaaatttaacatgggagtccaaaccggtattgggtgttgggggtaagtt

SEQ ID NO: 88985 - DNA, 601 bp, Human
tatgttactgtgaatctcccagacgccaggaacttacataaaacacagattgagtacatttggttgacagcggggaagggacttgtcaaaatattttttaaatggtatatcaatatgccaaactatctgaatagaggctggaactgcattagagcagcctctggaaggttcaggttcgccccgaagtgctacatattaacctcttaattgttgcctcctagggaggtcccaggccggagaggtagaggggagaagtgggggtaacgagacttaagatcgaggaaagtgaacttgggttggsgcaccttaccaacaagtatttaagtatttactacctaccaatactaataaatgaaggcatattttaactaccagctgcatagcaaccctggagaagaagcatttctgaaatagtcgtattcacgaaaatgtttaaaaccctgttaaaaacctaataaggtgtgtgatgttccgcttcctaaagtataatttaaaaatatttttttaaaaaaacctaataaggtatagaacatcacaagcagcatgcaaaaaacactctcaactaccttagcaatcagggcagagtaagtgaaaacaccaa

SEQ ID NO: 88986 - DNA, 601 bp, Human
gggatcacttccattaagtgccaactacaaagaagcaatcagtattggcctggttcccccctcccctttggcatctcagaagtaaagggaatgcttttttaaagaatttattgattgaaagagacaacagaaaactaaatgaactttcttagaaaactgtgcagacactgaagtgagacccagcttctctggactcttatgtaacaagttacataagggtcatcttattcccccagtgtgccccctgggattatggtgtggaggctaaggtcaaaaggaaattatgtaagcataatcctgrgaaattgacaaacaaagcagtgaccagttcaaggagcaaaccagcagtatgttactgtgaatctcccagacgccaggaacttacataaaacacagattgagtacatttggttgacagcggggaagggacttgtcaaaatattttttaaatggtatatcaatatgccaaactatctgaatagaggctggaactgcattagagcagcctctggaaggttcaggttcgccccgaagtgctacatattaacctcttaattgttgcctcctagggaggtcccaggccggagaggtagaggggaga

SEQ ID NO: 88987 - DNA, 601 bp, Human
agagctgtcctgcacaattctgaatcacacacatattctgtaggaagaacctgtgtctggctttaaagcctacttctacccctttctagctgtatgatcctcagccactcactttagtccctgagagcttcagtttccttgtccatacaaaggaaaaagattgtagcgtaaattagatgggatcacttccattaagtgccaactacaaagaagcaatcagtattggcctggttcccccctcccctttggcatctcagaagtaaagggaatgcttttttaaagaatttattgattgaaagakacaacagaaaactaaatgaactttcttagaaaactgtgcagacactgaagtgagacccagcttctctggactcttatgtaacaagttacataagggtcatcttattcccccagtgtgccccctgggattatggtgtggaggctaaggtcaaaaggaaattatgtaagcataatcctgagaaattgacaaacaaagcagtgaccagttcaaggagcaaaccagcagtatgttactgtgaatctcccagacgccaggaacttacataaaacacagattgagtacatttggttgacagcgggg

SEQ ID NO: 88988 - DNA, 601 bp, Human
tgtctgccccaactcagtgccaagccagaggtaaagggcaaagggtgataggaaggagtccaaaatacaggccacaaaggcctctagtccatctgggcactgctggagccagggcagggcaacgctggcacagagataaaagggctgtccacagtctggcctctaagggacttgaagtccatggaatgatctgagctccctatctgctttagtatagtcagtggacaatgtctatcacttcaaaagaataggacatgaaacagagctgtcctgcacaattctgaatcacacacatattctktaggaagaacctgtgtctggctttaaagcctacttctacccctttctagctgtatgatcctcagccactcactttagtccctgagagcttcagtttccttgtccatacaaaggaaaaagattgtagcgtaaattagatgggatcacttccattaagtgccaactacaaagaagcaatcagtattggcctggttcccccctcccctttggcatctcagaagtaaagggaatgcttttttaaagaatttattgattgaaagagacaacagaaaactaaatgaactttcttagaaaactgtgc

SEQ ID NO: 88989 - DNA, 601 bp, Human
cagaagaaacagctgcaaactccaaaactgccccagcttgctgtgtgaacttgtgcatgtgctgcctcttatctgagcctaagactcatctataaaatgagatgtttgagttggatgcctctcccctgccttccagctctatgagtatgtggaggggaagctccaccaacagtttagaaacagtcctggaatacactgctgacttatgactcataattcatcatatctcattatctaattagtattataattaccatcaacattatcattgttattatccttagtatagcataaataatamcaatataataataactagcatttcttaagtgctttgcatgtgccagatcttatttgttcaggtctctagaatatgtgggacaagaagattgtagtatctgcatagatcaggagttggcaaactacagccatgggccaaatccagtcaacagcccatttttataaacaaggttttattagaacacagcgaagcctattgtttacctattgtctacggttacttttgcactccaagagcagagttgagtaattgcaacagaaaccctaaaatatttatctgaccctttacagaaaacacttg

SEQ ID NO: 88990 - DNA, 601 bp, Human
acatagctaaacctacattggcccaaatccaagactttagtttgtaggactatgctcaagtaactaggcagccaattcaaatactccatcctccaattttatatttataaattacaagcactcacagccggggtcagcaactcatggctttccatatggcccatgaagcctaaaatatttactctttagccctttacagaaaaatgttttctgacccttggcctagaacagtaaaccaaatcccaaattttccattcagtgtactgaggtctctgtagtacttgggaccagcagattccayaacattttttaactcaagaaaaatatttatttgcattgatttatgtaaatgaccctgagtgatgaaagttggaaataaatttggggaaaaaaagagctaaagagttgtggttgtaaaatatccacctcctaaactactgcagagctgctggttaaccaaaatccagggagggttttgccagaatcatgaagaattttatgaatgggtctacactgagtacagagaaaagtgcccacaggcctctctgtatccatgttgatgggggattaaagaagactcctcctaccaacatccagccaa

SEQ ID NO: 88991 - DNA, 601 bp, Human
cagagggacatgaattgagctggaagccattatcctcatcaaactaatacaggaacagaaaaccaaacaccacatgttttcacttataagcaggagctgaacaatgagaacacatggacacagggaggggaacaacacacactgggcctctcagggggtggggtgggtgggggtagagcattaggaaaaatagctaatgcatgctgggcttaatacttaggtgatgggttgataagtgcaacaaaccgctatggcacaggtttacctatgtaacaaacctgcacatcctgcacatgtaccmcacaactaaaattaaaattaaaattaaaaagagaaggaaaaaaggtttcttgatgatctctatctagaaccctttgaaggtgacccaatcagctcattaattgtttgctcttgaatacttgctttcacccaatgggctttgatattaataacagtattgattatactctcaacatttatggaacatactagctctgagataagtggtttcctttgtttgatcctcacaacaacaattctataagcaagtaggaggaaggaacaaacagatagagtgctattattatcctcattttataga

SEQ ID NO: 88992 - DNA, 601 bp, Human
attaaattaaaaaatgttgttaaaaatctgatccagtctcttcagacatcctcccacagaagatgctgaaaaaaggtttcttatatggtacaaatacacaatggaatactatgcagccataaaaaggaataagatcatctccttcagagggacatgaattgagctggaagccattatcctcatcaaactaatacaggaacagaaaaccaaacaccacatgttttcacttataagcaggagctgaacaatgagaacacatggacacagggaggggaacaacacacactgggcctctcagggkgtggggtgggtgggggtagagcattaggaaaaatagctaatgcatgctgggcttaatacttaggtgatgggttgataagtgcaacaaaccgctatggcacaggtttacctatgtaacaaacctgcacatcctgcacatgtaccccacaactaaaattaaaattaaaattaaaaagagaaggaaaaaaggtttcttgatgatctctatctagaaccctttgaaggtgacccaatcagctcattaattgtttgctcttgaatacttgctttcacccaatgggctttgatattaataacagta

SEQ ID NO: 88993 - DNA, 601 bp, Human
aaaacaaaaattaggtagtctcataagccagtctcaaaaaaattaagtaaataaaatttttaaaaaattaaattaaaaaatgttgttaaaaatctgatccagtctcttcagacatcctcccacagaagatgctgaaaaaaggtttcttatatggtacaaatacacaatggaatactatgcagccataaaaaggaataagatcatctccttcagagggacatgaattgagctggaagccattatcctcatcaaactaatacaggaacagaaaaccaaacaccacatgttttcacttataagyaggagctgaacaatgagaacacatggacacagggaggggaacaacacacactgggcctctcagggggtggggtgggtgggggtagagcattaggaaaaatagctaatgcatgctgggcttaatacttaggtgatgggttgataagtgcaacaaaccgctatggcacaggtttacctatgtaacaaacctgcacatcctgcacatgtaccccacaactaaaattaaaattaaaattaaaaagagaaggaaaaaaggtttcttgatgatctctatctagaaccctttgaaggtgacccaatc

SEQ ID NO: 88994 - DNA, 601 bp, Human
actcatcacctcagactgtgttgatgatccagaccctgggcatgccatttagctgaactctatagctgaaggaaatgctcaggaaaggatttttaatttgagattttcctttgaataatgtgaggcttcattttttggagaaaggaagacagtctatcatgagttactaccagggtcttcacaacaatgccaagcaaaatctgatccagtctcacccaagtcagtggctcatatctacaatcccagcactttgggcggccaaggcaggtggatcacttgaggccaggagttcaagaccaasctgagcaacatggtgaaaccctgtctctaccaaaaacaaaaattaggtagtctcataagccagtctcaaaaaaattaagtaaataaaatttttaaaaaattaaattaaaaaatgttgttaaaaatctgatccagtctcttcagacatcctcccacagaagatgctgaaaaaaggtttcttatatggtacaaatacacaatggaatactatgcagccataaaaaggaataagatcatctccttcagagggacatgaattgagctggaagccattatcctcatcaaactaatacaggaacag

SEQ ID NO: 88995 - DNA, 601 bp, Human
ggatcaggaaacctgaagtccaccagaagctccaactaatgtttagtgaccttgccaaaagcaactagggcttctaattaccacaagtgatcatgacttgaatttttatgcacttcctgaagtcattccagcagcaccacgtctcctcaacagcctggaagtggtgatgatgtggtatgttggctaccgggtcatcaataccacttaattccttagcaactgaggtgaaaagccttcatcccaagtgccttggaagaaaggcttgttcctgctcaactcgtaaagtctcaaatttatgctraggatagtttctcgccgagtgacttatcaggttgactcttaaattatgacatcaaagcaaggaacatgtcctgtttttatttgaatcctctatataatgacatgtacaatgccaggcacctaataggtgttcagcaaaagctggtagattgaattatgtatatgacaaaattaagacagaggggtcaaataagacttacagataagtccagatgagatctctggactcaaatatattctagggctttgagttaacacagaaatggcagggtttttttgccatggacaatcatgctttctt

SEQ ID NO: 88996 - DNA, 601 bp, Human
ggactgggaggtgcctctgacagcgagtggcaggaccttatcagcttaagcatctcccatggagatggctttggacagaagcctaaacaaagcacaaggaaaggatcaggaaacctgaagtccaccagaagctccaactaatgtttagtgaccttgccaaaagcaactagggcttctaattaccacaagtgatcatgacttgaatttttatgcacttcctgaagtcattccagcagcaccacgtctcctcaacagcctggaagtggtgatgatgtggtatgttggctaccgggtcatcaayaccacttaattccttagcaactgaggtgaaaagccttcatcccaagtgccttggaagaaaggcttgttcctgctcaactcgtaaagtctcaaatttatgctgaggatagtttctcgccgagtgacttatcaggttgactcttaaattatgacatcaaagcaaggaacatgtcctgtttttatttgaatcctctatataatgacatgtacaatgccaggcacctaataggtgttcagcaaaagctggtagattgaattatgtatatgacaaaattaagacagaggggtcaaataagactta

SEQ ID NO: 88997 - DNA, 601 bp, Human
ggtcacttccccactcccctaagcccatcaaagactgcctttctcactttcaacctccagcacgtcagattctaccagagctgaggcttctgccctgcctttgaaaaactgaagggcataggtaatttcacagtagagaaagaaggtggtagggagtactggtaatgaatagaaccatttattgactttttattctgtaccagtgataggtagagtaatgccccaacaaatgtccatgtcctaatccccagaacctgtggatgtgtcagattacatggcaaaggggctctaaggctgcagktgcaaagaaggttgctaatcagctgacctcaagatagggagatgcgcctgaattctccaggtgggaccagtggaatcacaggggttcttatgcatgaaaaagggaaacagaaaagaaagaactgaaggatggcagcatgacaaagacacagcccaatgttgctggctctaaagataaaggaaagggccaggagccaaggcatgtgagaagcttctagaaactggcaaaggcaaggaaacagactcctcctccgagcctccagaaaagaatgcagccctgctgacaccttgattttagccc

SEQ ID NO: 88998 - DNA, 601 bp, Human
gagtagatgagctgggatggcaacccagcttggcctgaacaaggtgcacacacttaatcacgacacttacagaaaatgaagctgaatcccttctccatctaccaacctttgaggcatatgaagtttctgctcagggttttctcttctcccaagtttgtcactatcctggttaaagcacctcaagctacttacttgcctgtgcctcccagacctgcacacaaccttccaggtaagggctggtcacttccccactcccctaagcccatcaaagactgcctttctcactttcaacctccagcaygtcagattctaccagagctgaggcttctgccctgcctttgaaaaactgaagggcataggtaatttcacagtagagaaagaaggtggtagggagtactggtaatgaatagaaccatttattgactttttattctgtaccagtgataggtagagtaatgccccaacaaatgtccatgtcctaatccccagaacctgtggatgtgtcagattacatggcaaaggggctctaaggctgcagttgcaaagaaggttgctaatcagctgacctcaagatagggagatgcgcctgaattctccaggt

SEQ ID NO: 88999 - DNA, 601 bp, Human
agacctctgggcttttgcaaaagcacccagatgacactgttgcagctaatccacataccaatgtctggtcaatgcctgaacagttgcagtgcagggcagcttatcacttctactctaaccatcccgccgttggatagctttgactattaagaagcccttcctttatggtgagcctatatctgtttccctgcagcttttacccacaggttatttttctatcctgtggagctacctaataataacagttgccatcagacaatgtactggatgctttacatgcattatttcattgacttcccayaacactctcacaagatagctactattattagtccttctttatagatgaaaaactggaggtcagagagaggagcacatttgctccaagtcaggcagttggtgagtagatgagctgggatggcaacccagcttggcctgaacaaggtgcacacacttaatcacgacacttacagaaaatgaagctgaatcccttctccatctaccaacctttgaggcatatgaagtttctgctcagggttttctcttctcccaagtttgtcactatcctggttaaagcacctcaagctacttacttgcctgt

SEQ ID NO: 89000 - DNA, 601 bp, Human
tgaaataacctcaagggttcactccaactctggttcttcaccgggaaggactcccccatcagagggaccctaatgtctggtaactggtaataataagaataatgatggtgacaataatgatgacagcagctaacatttactcaaaactaacttcacaccaggtatttttctaagtcttcttatatatgaacttattgatttctcacaataacctcaggagataggtactactatcagcaacttttactgaaggaaaaatgaagtcattgaatggttaagttacttgctcaatgtcacaaawgtaatggatggtagagctaggatttgatccctgtcagtcctggacttggaaaaactggtcagcccactctccctccagcccgagaaaacttgctctttatattaggcaatttcatgctagcaatagacatcgacactgaacatttggccaaaagagtgattttgctgttgggggatgggaaggatcccagagagaagaaagttaacacctagtccaaaccagagcctgatccaagagctacatacaacagtcatggaaccctagaatttctggactagagagtcttcctgtcccctctca

SEQ ID NO: 89001 - DNA, 601 bp, Human
actaagaggtggtttaattagctgcagcgccttcaggcactaggcagaaactgggtgaggtgctgtataccttagccaggactgggtctttttatcacactttacaactgcttttcttcagtgcagtctgtctcttttttcttccttctagactgagcagccaaccaggcaatgtagcatcaatcccaagcaagaaggcaagtcactaccatgaccttgcaaattgcaagatttaccatggcaggcattcaaaacgccacacaattcttttgtgagatgatgtttaagagcttcctcaaargttccctggagaccttcaaagtcacccacttctggctcccagagacccaaatttcctccttgagagaactatccctttggattccacccaaggacccagatttaagccagaaactcacggaaaaagcaacccattcactgacaccttagtataaaggagattctcaatccatcccccaaaatagaattgtctggaggaaccccttaatataggtcctggacagaaccatatctggaagccagacaaaaggagatgtcaaaacataaatgacgtaaactttgctaactgcataccattgcc

SEQ ID NO: 89002 - DNA, 601 bp, Human
aactcaggaatgacttccctcaggaagcctttgatgactcccaggtttgctttgtagatgcagtttaccatgtcgcctgtgctctcaaggcatttttcacagtttacttgtatgttttccccactagaacataaacactttgaggacaaactgtgtcttatttgtctctgtctccaccatgcctagcatcttcctggcacatagtagatgctcaattagtttatgttgcctgaaggaatgaatgaatggatgattaggttaaaatatgttcttgtcacaggttctttgtgacactccattrtaagaggtagtggtccagaaggctaacaaatctgagaagaagagagaaatgagagaaggaatatcagaaatggtttcaagtggggaagtcacgtcctgtaaaaagcaggcgggccaggtgaagtggttcatgcctgtaatcccagcactttgggaggctgaggcgggtagattgcctgaggtcaggagtttcagaccagcctggccaacatagtgaaaccctgtctctactaaaaatacaaaaaattagctgggtatggtggcaggcacctgtaatcccagctactcgggaggctgaggc

SEQ ID NO: 89003 - DNA, 601 bp, Human
gatttctaacatgggcaggtcaatgccttgggaacacagtcaaacaggtaaactggcattgggaccagcaaagtgctaaacttaccactaagtcattgagagaccacctacatcaggcacagtcaattactgtggaactggtgaggtggcactcagaaaagacaagatgagaaatcgaaggagaagagcctttttttccatattgcttcctaagcacagtggcccaagccagctaatacaatgaatggcaggtatacagccagtggagccttcaggtgtctacacagaagctgcaaagacraagtagcaggagacaaagttttcaagggatcaataaaagttgtatttgtttggctcagaaacagatgttaaaacaccagctctgatgagtaactgtcagaagacaagttggtggaatgcaatcacataattacatggccattgattcttggttaaaatgtctcttttctggcagtggctgagacaagacatttagtcatttggacaaaccatgcaactcactgggtcattacagagctccagtgagatgatatctatgaaagcactgatatagtatctgatatatagtagatactcaatt

SEQ ID NO: 89004 - DNA, 601 bp, Human
ccttttaacctgtcctatctgttacggaagcatgtttttctagggccaataaagctgggttgggatgaaattcagtacacaattcagacgtgagcatcttctaattcctcatccatccttcacccattctcaggtctagatttctaacatgggcaggtcaatgccttgggaacacagtcaaacaggtaaactggcattgggaccagcaaagtgctaaacttaccactaagtcattgagagaccacctacatcaggcacagtcaattactgtggaactggtgaggtggcactcagaaaagayaagatgagaaatcgaaggagaagagcctttttttccatattgcttcctaagcacagtggcccaagccagctaatacaatgaatggcaggtatacagccagtggagccttcaggtgtctacacagaagctgcaaagacaaagtagcaggagacaaagttttcaagggatcaataaaagttgtatttgtttggctcagaaacagatgttaaaacaccagctctgatgagtaactgtcagaagacaagttggtggaatgcaatcacataattacatggccattgattcttggttaaaatgtct

SEQ ID NO: 89005 - DNA, 601 bp, Human
tgaatcatgatggtattgggccaggataggactggaagtcaggaagtctgtgttctaattccaggacggctgctaaatgggtgtgtcaggggaaaagtatgaggataaaatggatataatgttaccttctgtgatcaacagacagtagggtaaactgctatgaaatggtaaaaacacgttctaatgtaagatatcaataaggtttaagtatcaattttggcccatttttattttttaggtcccattctcttaatctataaaataagagggttgaattggaaattctttaacatttaaaatyctgtgattctctaattctccaggtagggaaaaggatagtagtagcattcagttctagagatgtggattccattctaggtacccacgatggaataagcttagagctgaccatgaagacaagtcatttcattcgccatgagacagctcagtagctataccacaaccctcacagggaaaggtagagatgagcgacaaaccaacagcaacaataacaacaaccatttcttgatgtttttgtgttccttttaacctgtcctatctgttacggaagcatgtttttctagggccaataaagctgggt

SEQ ID NO: 89006 - DNA, 601 bp, Human
ctctgacactgcccaccatctgtgtttctgcttgactgcctcctaaattgaggaatattagcaatgcaatgccttaatgttggaagttccagtgcgccaactcaggccgatctctcaaatggcctccactgcctaacaaagtaaggccatgtgatgggacagctgttgggataattaaaaacttttaacaatgagcccataatttccttcagccttagcctctccattgaattatttaaacagctgttaatattgcaatctctgcccagttctttctcatgcaaatccacgtgagtcctgkttcaaggcaagctcagcttatcgtgcaaatcatcctctgtgactcagaagggaacgtgtaatggggctaacgctaagttttaaactattctcagaacctgcttttcattagcattcgatttcccttgctttgccaatagcctgtaataataggctcattagatgtggtgttggattcagatttcctgctgcacacttcagtgtcaccttagctggcaccaaactcttttttccaccttcactgatttgatgaggtggcaacagaacactccccagggagcctaaaagcaactggtgtgtt

SEQ ID NO: 89007 - DNA, 601 bp, Human
atcctaaagctcccacccagatgcacactctggggtccacatgttgatttttacatggattcaaatgaatatgtaataagtcatgctgggccctgtcaccatcatgaatattatgagggtttaaatgactatttcagcgccccctaagagatatggttaccaggaagaggtgagttggatacagatggaaagcctaaggtcacaacagccagcaggtttgctcccatggcaatgagcagaaagtgccaaatctggtctgggaagtccaccggatacacagtaagtcacgtccagtgggcaygcttacccctttactaatattcccttcctatgtcctgtggctgtgcacacagaacaaagcaataaaacccaggttggatttgggtccaccaaatccctcgaggctaatgctctctgacactgcccaccatctgtgtttctgcttgactgcctcctaaattgaggaatattagcaatgcaatgccttaatgttggaagttccagtgcgccaactcaggccgatctctcaaatggcctccactgcctaacaaagtaaggccatgtgatgggacagctgttgggataattaaaaacttttaac

SEQ ID NO: 89008 - DNA, 601 bp, Human
atttgaatagaaacctagaagaaatgaggggtttcttcaagtattttatgcaatttgtctagagcttagcaaataaatggaacatacacaatttggaaatctgtcttactaccaagatcctaaagctcccacccagatgcacactctggggtccacatgttgatttttacatggattcaaatgaatatgtaataagtcatgctgggccctgtcaccatcatgaatattatgagggtttaaatgactatttcagcgccccctaagagatatggttaccaggaagaggtgagttggatacagrtggaaagcctaaggtcacaacagccagcaggtttgctcccatggcaatgagcagaaagtgccaaatctggtctgggaagtccaccggatacacagtaagtcacgtccagtgggcacgcttacccctttactaatattcccttcctatgtcctgtggctgtgcacacagaacaaagcaataaaacccaggttggatttgggtccaccaaatccctcgaggctaatgctctctgacactgcccaccatctgtgtttctgcttgactgcctcctaaattgaggaatattagcaatgcaatgcc

SEQ ID NO: 89009 - DNA, 601 bp, Human
atgagtttgtatcaagtgtccagggaaggcgtctgtgatgaagggacatttgaatagaaacctagaagaaatgaggggtttcttcaagtattttatgcaatttgtctagagcttagcaaataaatggaacatacacaatttggaaatctgtcttactaccaagatcctaaagctcccacccagatgcacactctggggtccacatgttgatttttacatggattcaaatgaatatgtaataagtcatgctgggccctgtcaccatcatgaatattatgagggtttaaatgactatttcagygccccctaagagatatggttaccaggaagaggtgagttggatacagatggaaagcctaaggtcacaacagccagcaggtttgctcccatggcaatgagcagaaagtgccaaatctggtctgggaagtccaccggatacacagtaagtcacgtccagtgggcacgcttacccctttactaatattcccttcctatgtcctgtggctgtgcacacagaacaaagcaataaaacccaggttggatttgggtccaccaaatccctcgaggctaatgctctctgacactgcccaccatctgtgtt

SEQ ID NO: 89010 - DNA, 601 bp, Human
tgacattttgttcagggggcttacccacttgccctgccattctagcaagacaccaagaacttagcttccagactcagagttaagacctggaacccaaatacaactacttgctttttcataacaggctgcttaatatacttgctacccaaatgttttaaaattaggaataacattgcatgaccagatgagaatgttagtcaaaatataggcttcttagtctccccttaatggcctaattttctattcatctagttaatttctgaggcaacttctggtttcctgacatatgtgtgcaataacmatccctcagaccatctgaaaaagaaaatagggtatgactgctcacagcagttgggtgagggcctttctgatcagtgagcaacaaatatcacttcctcccctcgccaagtgaaacagacagaaaattcattttacaacacagcagggggaaatgatcaaaatgacctttttaacgtggatagaccatatttctgtgtttgcagtgggatctttttccatttttaaacatgtctccagcaagtaatctgaagctctaaaccaggaaatgtcaaacaaagaatggaggtagtatgcgttctga

SEQ ID NO: 89011 - DNA, 601 bp, Human
gcagaccagtgttttggaataactggttataatgggaatagtgtgggttttggagtcagagggccttgacttcaaatcctgactccaactcttgctagctgtgtggggtgtagaaagaaatgcctgatgcctacttcataaaaattaaacaaaaatatgctagcatagtacctttctccagtgcacacaaagaagagacatataacacccatcaacttcatgacaaggatgacattttgttcagggggcttacccacttgccctgccattctagcaagacaccaagaacttagcttccagwctcagagttaagacctggaacccaaatacaactacttgctttttcataacaggctgcttaatatacttgctacccaaatgttttaaaattaggaataacattgcatgaccagatgagaatgttagtcaaaatataggcttcttagtctccccttaatggcctaattttctattcatctagttaatttctgaggcaacttctggtttcctgacatatgtgtgcaataacaatccctcagaccatctgaaaaagaaaatagggtatgactgctcacagcagttgggtgagggcctttctgat

SEQ ID NO: 89012 - DNA, 601 bp, Human
accacctaggtttgctaatatgtagattgcaggacctcatttcaggtggcccaaagcaaagtctccataagtataggaatccacatgccaacactctcacaagatatttatttgcaaaaaatttaagaactactagaatccaaaggagaacgaatggctagaggaggtaaggaggaaaattatatcactgaagcctgggcagacagggccctaggcaaaccacgtggcttcctttctggtggaagggctggctgctgagaccagctgccccacagagccaggagagtcccagagaagaggsggctgggggtggggtagtgcaggtacctaccaaacaccgtcagggtgagcagcagattcttccccagcttgtcacacaggcgcaggcccaggtgccggtgcttgggttcctctgagccaagatgactgtcgtgcattcgcacttccacctgcttgggcatattgttggcactggaacagaagtgaaggcagagattagagagactggcacctcccctatacagtttcaggggctcgactagtaggaacctctccaggcacagttggaatctggaaccatctgcaggaaaataaaagtaag

SEQ ID NO: 89013 - DNA, 601 bp, Human
tcagtatctgaacaaaatataatttagaaaggggagaaaagtagacattaaaaattaaggccaggtgcagtggctcatgcctgtaaacccagcactttgggaggctgaggcgggtggatcatgaggtcaggagttcgagaccagcttggccaatatggtgaaaccctgtctctactaaaaatacaaaaattagccaggcatgatggcacatgcctgtagtcccagctactcaggaggctgaggcaggagaatcgcttgaacccacgaggcacaggttgcagtgagctgagattgcaccacygcactccagcatgggcaacagagggagactccatctcaaaaaaaaaaaaaatttaaaaccactagaggtatcatcacttgtaacatgtggctgtgtttccttttcttttcttttttttttttttcttttttttgctggagagaaagacaaatagactgactaatcgatggcaagcttttatttctttagggttgattatcctcatttcagagacgggaaaaccaaagctctgaaatgaaatgacatagacgatcacattcactcaaccaaattgagattctacagttaattaaaagccag

SEQ ID NO: 89014 - DNA, 601 bp, Human
tcccaattaaaatagtagataatttccttttccatctattacctttatcagtatctgaacaaaatataatttagaaaggggagaaaagtagacattaaaaattaaggccaggtgcagtggctcatgcctgtaaacccagcactttgggaggctgaggcgggtggatcatgaggtcaggagttcgagaccagcttggccaatatggtgaaaccctgtctctactaaaaatacaaaaattagccaggcatgatggcacatgcctgtagtcccagctactcaggaggctgaggcaggagaatckcttgaacccacgaggcacaggttgcagtgagctgagattgcaccaccgcactccagcatgggcaacagagggagactccatctcaaaaaaaaaaaaaatttaaaaccactagaggtatcatcacttgtaacatgtggctgtgtttccttttcttttcttttttttttttttcttttttttgctggagagaaagacaaatagactgactaatcgatggcaagcttttatttctttagggttgattatcctcatttcagagacgggaaaaccaaagctctgaaatgaaatgacatagacgat

SEQ ID NO: 89015 - DNA, 601 bp, Human
agcaaattcacaaaaactccagccccactgggtttttttccagttgtttcttgaatgtgttcacttcctggtttcagttcctgcttttaccagaaagagagattgaacccctttttgggtgttagtcctttttgctatgggggaagaagttagtgatgtgagctgctctaaattaagctgacctacgtgtgacctacttctctttacaacctagtctaattctagccgacgggagctaggtttccccaccaagttggccaacgtatgacctgttaacaggtgcagagaacattttctctgktttatagaggagcactgatggtaaatgcaccctttcactcaatctagcgctgaatgataaggtcccacttagcccctaagtgcctgatcctgagttccagcatttcaggtactggggtcactggtcaaccagctgaagcctcaacccagctcagcccctgaatctcctggagttaccagagcctcactcacttctttcatgaggtggccagtccaggggaacaacttctccagatcacttagctggctggtacccaaatatggaccaaagctcagcttcctgcccttaactcagagttta

SEQ ID NO: 89016 - DNA, 601 bp, Human
agggagattttcaagattttacagaactgggagagttggagatcctcctgtttagagtttacaaatggtctgtaacaaattttttgtcagtctgcaataatgagttaaaataaagttgaagacatcccatttttaattctgagattattcctttccactttttattttttttggtcttaacatctcctttgttttatgaagcgatgctgctggtacatgctagtttttaacttgtttatttatttatgttttaatgtcctcacttggaagactaaaaagctagtagttctgtgccacactsaaaatgtcttttgaatatattactggtaactgacatggagagtctgagaataacgattttgcccagtcctctcatttctctgaggtgaagcatgaagatccacattcccagcctcatgcagggattagggaacaccccgtgaagcaccctgccaatggtgggcacttcatctatacctagggaggttagaggaaattccaagcaaattcacaaaaactccagccccactgggtttttttccagttgtttcttgaatgtgttcacttcctggtttcagttcctgcttttaccagaaagaga

SEQ ID NO: 89017 - DNA, 601 bp, Human
tctcaaatattttcaatctgcacatgtgggactcacagatatgcagggccgactgtattgaatatttgatcaatcccatagtttatcattctattatccagggagattttcaagattttacagaactgggagagttggagatcctcctgtttagagtttacaaatggtctgtaacaaattttttgtcagtctgcaataatgagttaaaataaagttgaagacatcccatttttaattctgagattattcctttccactttttattttttttggtcttaacatctcctttgttttatgaagygatgctgctggtacatgctagtttttaacttgtttatttatttatgttttaatgtcctcacttggaagactaaaaagctagtagttctgtgccacactcaaaatgtcttttgaatatattactggtaactgacatggagagtctgagaataacgattttgcccagtcctctcatttctctgaggtgaagcatgaagatccacattcccagcctcatgcagggattagggaacaccccgtgaagcaccctgccaatggtgggcacttcatctatacctagggaggttagaggaaattccaa

SEQ ID NO: 89018 - DNA, 601 bp, Human
atactttctaaaattttcataatctgcatgtattacttccacaatttaaaaaactacccaagctccagattcatctcttggagattctgattgtgtagggtatttgtatttttttaaaagtgccattggtggtttagctttactgccacgtttgagaaccactgtgtattctagaaggttgtgggcaaggctaataaaaatatgcccatggacaactcaaagacacatttcccagcctcatgcacaaaaaggaaaggaagagatagatataaggagagagagagagagagagagggagggggagagagagagagagagagagaggcggggggggggggtgggggagaaaggaggacaatcccacagcaaaaatatattaagtgagctggaaaaaaagggatgtttaaaaaaattaaaaccaggagactccaatcccaagatcctgccctaaaccacctcatagaatccctgggcctagacagagataattatatatttagaaaatttctacccagagttggtctgttaaaatactcttaagttatcgccttgataacttagaggactggagaagagagaacatctgaactctgggttacct

SEQ ID NO: 89019 - DNA, 601 bp, Human
tccttccaggcttaaggaatctgtaaccatcctctccctgaggtggattctacaccattcttcctcaggttgtcctaatccaaagggaccttgatactgagcctactgagggaccaaggctcagtcctcatatgaattttggcaatagaaagttggggtcagggctggcgtggggcagggaatggctcaggtctctattccagaatggcagagagcagcctttgccatgggcagctgcatgcaaagactgcccatccaccacagcgctcaccgagtgtgagtgtggccagctccacaaaarttcactccaagaccagagcaatagctccaggagcctgcctgcttcttggtcctgccttccttttttcacagagcatggcatgaccaggcacagaactgtgtccaaatctgtccttcccaggccctcctatgctccactctcccccaatctactaccagctcagcctcctgcagctgcgatcccagaatgctctttccaaaatgttaagaatggatagcacccaatcgtgtctctcacactaaagcaagtcagttcatctttctgagcaggctggctgaggggcaaacacgctatacagat

SEQ ID NO: 89020 - DNA, 601 bp, Human
atctgggcaacattggtgtgaagagaatgcagggaggatcacaagagaagcttatgtgaacagcagagtcatgctcccaggaaagaaaagggaaccaaagccaactgtcaacctatcctaaggatgctaaagaagcctacgtttggtttaaaagagaaatactcatggatctaaatgaatggtggctgtcaggatcaggcaggaggccagctgctacctattttacatccattacgtcttaggtcaacagtagcccttcgactcaagggcagcttgctagttagttgctgaagcaggattmgagatgagttatgtttgactccagaaatccagatttcaaatagcaaaggccagtgatgtaagttgaagctgaggagataggaacacgaacgcaggccgagttctctgcctgagttcctgattcacagaagctgttcggttgcacaactccatgtaagtgctgttttagtctgttttgtgctgctacgacagaatacctaagactggataatttatgataaacagaaatttattttttcaccattctggagactgggaagtacacaatgaagatatcagcatcgggcaagagccttcttgc

SEQ ID NO: 89021 - DNA, 601 bp, Human
tcccataggaagcaatgctgaactgccagttatttaaaatggatgggaagggaggtcagtgttctctgaggtgaggcagggtgctctctgttctagcctggccacatgtactcgtgcagggagagaggaagcctagggcctgctgtgtgaggggagaacaggcagcccacttctcccctcaatgtggccccttcatctgggcaacattggtgtgaagagaatgcagggaggatcacaagagaagcttatgtgaacagcagagtcatgctcccaggaaagaaaagggaaccaaagccaactktcaacctatcctaaggatgctaaagaagcctacgtttggtttaaaagagaaatactcatggatctaaatgaatggtggctgtcaggatcaggcaggaggccagctgctacctattttacatccattacgtcttaggtcaacagtagcccttcgactcaagggcagcttgctagttagttgctgaagcaggattcgagatgagttatgtttgactccagaaatccagatttcaaatagcaaaggccagtgatgtaagttgaagctgaggagataggaacacgaacgcaggccgagttctct

SEQ ID NO: 89022 - DNA, 601 bp, Human
aagtccttctctcaagcccatggagaggagtctgctacgtgggaggtcaaagagaatcaatctgaatattctggctgagaatagctcatattacttggttaatttcatttgaaattaagagaaaatgcccgaggtatcaaggtcccaaagaactggaataaaaaaagctccattcagtgtcagcagaaactggccatatctatgagagataggtttttaaaggaacagttggagttgatttaagcagttgggagagggtggagaccagaattgtttctggaggttttttaggagagaaatggttccttaaagaagtgggaggcaagagctggggttgtatcttcacttattgcaagtgcttaatcctcgggactttccaaagccaaaaaacagaaagacagcaaaacaaacaaataaaaaagccactatctccaccctcagaagaccgtggaaagaaccttatttcagccatgatttgtaaatgggaagtttctcaacagtctaacttcccttggctttccagagccttgatctgcacttggatggaaaccgtattcagcttgtaatttttctttgtaaacattgcctaattgaaattgct

SEQ ID NO: 89023 - DNA, 601 bp, Human
actgcctgggggctatctggatttctaatttccaatccccatgtgctccctgacctctgacccctgatctagtattgccattcttgaggtctcagttcttactacttacatgttctataaatcagtgttgctatgtccttggctacaggactttgcttccccacctgacttgttctctgactctgaagtatgagccatcttctctttcctcctcttctccacacctaacctgctcaatttggcagtcctaatttccagtccctccctattatatccagtttcctatggtgtccagttatgyctaaagtcttaacccatactcagtaaattttagcattataatttgattctcttataacaaaattccttctctctgaacctttgactttactctttccctagtcatctaacccactaacctctttacaccaagcacatatcaacccagattgtctaactaccctttgctggatcctttctatcttcagcaaaaagaatccatcacttgcacttggggttactaatacttcacatttagtatctcctctttttgctctcagctagaaagcttgacaaatgacttcacaagtaagttattggt

SEQ ID NO: 89024 - DNA, 601 bp, Human
attggaatagcagaggccaattagccaataaattctttgctagagttacatctagcttgttttggtattatcccaaatcaatgcatggctggtatgtttcactcttacaaaatcctatatgtaaaattattttttattactacacacataaaatgacagggagaaaaaaatactgaaaaatcaaagggaaaacaataaggaatccgaaattccattttatccagtttttttaaatgtaatctgttatttatgaatttgtcataattattttcatgattgaaatggttagaatgcttttttwattttatttattttttcaggatcataaagacagaatatagattcactgtcagattttgctagttcctagtccctccactcttttcttcctttacttgacattcttgacttgtatctaagtccagcctcacatcagcctttggggtcaatcctaaccccaggaaagatttaaggagcttcatctctgccctcttcatgtcagcatcacattgcactaggtcttggaccaactccaatacccaaccatgagtcttacttctgtgttggctttacctcatcccctgtgcctgagatcctggga

SEQ ID NO: 89025 - DNA, 601 bp, Human
aggggaagctccaaaaaagatattttcatccctttctcaaagtctttctggaaagacatttgatcagcccatgccaactttttcctgcagggagagctccagtatcctctggggaccccaaggctttctcaacccactgctaagaagtaagaacaaggccacttaccacatgatcatgatcactaacttcattacaatctcattcaaaatgttgaagaaatccaccatcagcttggcctgatctcccatcttccccatagcgatgccaaaagcaatgaaaaaccctatcagacctgttggrtgaatcacattacatagaaggacaaattacaaaaaatgtactttttctccctcattctttaccattcccaatgtatggagccatgttctcactgctggttaccctatgaattagacattaaaagaacaaagcattatatttgatactgaatgtaactttcccctggataattttggatttcttgaacactttccacatgagcaagttaaactgtaagcagcattaggtccttgaagaaaatgtattcattttcattccaaactaaaaggtgctctcttttccctcccctcacttatgaaa

SEQ ID NO: 89026 - DNA, 601 bp, Human
ggaaaagagaacacaggtatgacttggtctaagagtggttttatttttttctaggcagacatacaggaccatcctagagatctgaaacaaatgcaagtaaaaagctttctgtctgatggatatgggacaccaaaagtttccaatgattgaagatgacagagcttccacaatgagagaatagatactcatgctctcctaggctcccctagatttcagagtcactgactataaacacatgtgaaataaaggggaaacaatattgcttagacgatccaaaccaaaaaacctacctgcttatgcrtcaagggttttgataccaatatgaactacagctcttcctctccctagctataatcatcttaggcaagttaattattaggttggtgcaaaagtaactgtggtttttcccattgaaagtaatggcaaaaactgcaattcataagttgaattcatatgtcccccaaattcttatgttgaaacttaattcccagggcagtggtgttaagaggtgaaccatctgggagatgattaggtgatgagggctgtgccctcttcaatggaattagtgctcttaataaaagatgctcgagggagcctgttt

SEQ ID NO: 89027 - DNA, 601 bp, Human
catgcagagatggggaataggtaacccagaattcctgtggaaaagagaacacaggtatgacttggtctaagagtggttttatttttttctaggcagacatacaggaccatcctagagatctgaaacaaatgcaagtaaaaagctttctgtctgatggatatgggacaccaaaagtttccaatgattgaagatgacagagcttccacaatgagagaatagatactcatgctctcctaggctcccctagatttcagagtcactgactataaacacatgtgaaataaaggggaaacaatattgyttagacgatccaaaccaaaaaacctacctgcttatgcatcaagggttttgataccaatatgaactacagctcttcctctccctagctataatcatcttaggcaagttaattattaggttggtgcaaaagtaactgtggtttttcccattgaaagtaatggcaaaaactgcaattcataagttgaattcatatgtcccccaaattcttatgttgaaacttaattcccagggcagtggtgttaagaggtgaaccatctgggagatgattaggtgatgagggctgtgccctcttcaatggaat

SEQ ID NO: 89028 - DNA, 601 bp, Human
tgaggtggggtgggagacaagaaaaggaggaagagaaaaagcagctggaatttccacgaaagacacctacagaaaagtggaaaaggatcagaagaagtttggcaaagaaggtgggtaggcctggaacatgcagagatggggaataggtaacccagaattcctgtggaaaagagaacacaggtatgacttggtctaagagtggttttatttttttctaggcagacatacaggaccatcctagagatctgaaacaaatgcaagtaaaaagctttctgtctgatggatatgggacaccaaaagkttccaatgattgaagatgacagagcttccacaatgagagaatagatactcatgctctcctaggctcccctagatttcagagtcactgactataaacacatgtgaaataaaggggaaacaatattgcttagacgatccaaaccaaaaaacctacctgcttatgcatcaagggttttgataccaatatgaactacagctcttcctctccctagctataatcatcttaggcaagttaattattaggttggtgcaaaagtaactgtggtttttcccattgaaagtaatggcaaaaactgcaatt

SEQ ID NO: 89029 - DNA, 601 bp, Human
ataattgtttcctcagtaataaatgggttagtacctgtactgtaaccgaaatagtactgagcatacagcaagaagttagtaattctaatttataatttaataataaaaagaattattataatcttttcaatgttacattctgctattattactattataactgctacatagaaaagaatacaaaagaattctgatttttttaagctttgaggggtcagttaaagagtagttgactgttttatccagaacctttttacacacatcattagcaaatactgatgctgacgaggcagtgaaagawttaaagaaatgtgtagaattggcatctcatgtcatgtgacattgtcctgactatgagcctagatgaggtaaccaaacagctgtcagaaatcattctaaggtcttattcctgcctcacaaccactttttacctcccaagatgataataagtatttaggagttctggtttcagtgaatgggaaacttcttaattcataccaccaccctccatctctggggagaagggaggctacacttcatcccacagactcatctgatgtcctagaagattccctttcctgcaagggtttagtggaaatca

SEQ ID NO: 89030 - DNA, 601 bp, Human
aggtggcctgcaggaccctggaggatctgcctcctgcccacctctccaacttgacttccttttgccccctttcaccaaccacactgcagcctctctagacctttgttctgaccctcaaaaggctttccctgccacttcttcctcttggaatattctcccctcagttcttcaccaggttgcttggctcactctgcaggtcttcattaaaggtcacctttccagacagcaccacgtgggccatcacttctacccccatcactatctctcgctattgcacggcacttattactattcgaattartaataagtgctacaaagacaatttgctaccatttgctcccttttggctttccctctctccctttcctagaatgtaagctccacaagggccagaacctttctctgtcttattcaccattatctcaccagtacctaaaatcattgcctgcacagaatagaatatttattgaatgaaaaaaaaaatggatggattgacaaagattctttgtttgaccaaacttcagttaggcgtctgaaccttcttctggcctcttctgggctctttgctaaaccttccttataaaatccggtttagcaaaaa

SEQ ID NO: 89031 - DNA, 601 bp, Human
cccatcaaggtggcctgcaggaccctggaggatctgcctcctgcccacctctccaacttgacttccttttgccccctttcaccaaccacactgcagcctctctagacctttgttctgaccctcaaaaggctttccctgccacttcttcctcttggaatattctcccctcagttcttcaccaggttgcttggctcactctgcaggtcttcattaaaggtcacctttccagacagcaccacgtgggccatcacttctacccccatcactatctctcgctattgcacggcacttattactattygaattaataataagtgctacaaagacaatttgctaccatttgctcccttttggctttccctctctccctttcctagaatgtaagctccacaagggccagaacctttctctgtcttattcaccattatctcaccagtacctaaaatcattgcctgcacagaatagaatatttattgaatgaaaaaaaaaatggatggattgacaaagattctttgtttgaccaaacttcagttaggcgtctgaaccttcttctggcctcttctgggctctttgctaaaccttccttataaaatccggttta

SEQ ID NO: 89032 - DNA, 601 bp, Human
aattccaacccatcaaggtggcctgcaggaccctggaggatctgcctcctgcccacctctccaacttgacttccttttgccccctttcaccaaccacactgcagcctctctagacctttgttctgaccctcaaaaggctttccctgccacttcttcctcttggaatattctcccctcagttcttcaccaggttgcttggctcactctgcaggtcttcattaaaggtcacctttccagacagcaccacgtgggccatcacttctacccccatcactatctctcgctattgcacggcacttaytactattcgaattaataataagtgctacaaagacaatttgctaccatttgctcccttttggctttccctctctccctttcctagaatgtaagctccacaagggccagaacctttctctgtcttattcaccattatctcaccagtacctaaaatcattgcctgcacagaatagaatatttattgaatgaaaaaaaaaatggatggattgacaaagattctttgtttgaccaaacttcagttaggcgtctgaaccttcttctggcctcttctgggctctttgctaaaccttccttataaaat

SEQ ID NO: 89033 - DNA, 601 bp, Human
aagctccccaggtaattctgatctgtttgaaaaccagtatttcaagaaacaaaaatcttaactgcaactgatgaaacgcagatattacttggtgaccttctggaaaccatttaccttagctccaactacttcaggatctttgaggtcttaacccactcgaataattcatttgggactttcaggcctgggacagatgatgagacagacacttggagtggaggtaagctgagggactttctcagccctgctgtggagcacctctggttctgtcccacacgtttccaatagcttgtcaatagasctaaacacacattccaagagttgctgaaaggtgctgtctgtgctcagaaagtatcacaaatcttcatctttcccaatccatttagggataggagttccagctacccaaagagtgatttttgttaaaagttaccatttgtggattagaacttttcatcaagacagagtgaaaagcagttagtatagcctccaggtttattattcctccagagacttccttttgcaaggaaatgaaattccaacccatcaaggtggcctgcaggaccctggaggatctgcctcctgcccacctctccaactt

SEQ ID NO: 89034 - DNA, 601 bp, Human
gtgccagaaaccaccagcttcctgttaacaattccctggcttaccctgggcttacctgagcttacctggattccctgggcttaccacatacctatggagtcagaatgtcctggagctggccttggggcatttatattttaaacaagctccccaggtaattctgatctgtttgaaaaccagtatttcaagaaacaaaaatcttaactgcaactgatgaaacgcagatattacttggtgaccttctggaaaccatttaccttagctccaactacttcaggatctttgaggtcttaacccactsgaataattcatttgggactttcaggcctgggacagatgatgagacagacacttggagtggaggtaagctgagggactttctcagccctgctgtggagcacctctggttctgtcccacacgtttccaatagcttgtcaatagacctaaacacacattccaagagttgctgaaaggtgctgtctgtgctcagaaagtatcacaaatcttcatctttcccaatccatttagggataggagttccagctacccaaagagtgatttttgttaaaagttaccatttgtggattagaacttttcatc

SEQ ID NO: 89035 - DNA, 601 bp, Human
tccgggtgccagaaaccaccagcttcctgttaacaattccctggcttaccctgggcttacctgagcttacctggattccctgggcttaccacatacctatggagtcagaatgtcctggagctggccttggggcatttatattttaaacaagctccccaggtaattctgatctgtttgaaaaccagtatttcaagaaacaaaaatcttaactgcaactgatgaaacgcagatattacttggtgaccttctggaaaccatttaccttagctccaactacttcaggatctttgaggtcttaacycactcgaataattcatttgggactttcaggcctgggacagatgatgagacagacacttggagtggaggtaagctgagggactttctcagccctgctgtggagcacctctggttctgtcccacacgtttccaatagcttgtcaatagacctaaacacacattccaagagttgctgaaaggtgctgtctgtgctcagaaagtatcacaaatcttcatctttcccaatccatttagggataggagttccagctacccaaagagtgatttttgttaaaagttaccatttgtggattagaacttt

SEQ ID NO: 89036 - DNA, 601 bp, Human
ttctgaagccaaataatgcccagtgattgttggtccattttccacatgagaaggacatggctggagagcctggggagagggaatggctcccatgctgctcttaggctgttcctgttctctgttttcagggccacagattcatccaggactggcctgtggagtctttttcttactactgtatccattctagcctccacctactttgtctttcagcccttgccagcctaagatgcccctcgcagggctccacaaacacactcatctacagcaggcaagctacctagaattcagtcggtgtccrggtgccagaaaccaccagcttcctgttaacaattccctggcttaccctgggcttacctgagcttacctggattccctgggcttaccacatacctatggagtcagaatgtcctggagctggccttggggcatttatattttaaacaagctccccaggtaattctgatctgtttgaaaaccagtatttcaagaaacaaaaatcttaactgcaactgatgaaacgcagatattacttggtgaccttctggaaaccatttaccttagctccaactacttcaggatctttgaggtcttaacccac

SEQ ID NO: 89037 - DNA, 601 bp, Human
tgaagccagcaatcaaaaccacaaatcaaagtgcataaagaggctgagggctccacggagagttctgaagccaaataatgcccagtgattgttggtccattttccacatgagaaggacatggctggagagcctggggagagggaatggctcccatgctgctcttaggctgttcctgttctctgttttcagggccacagattcatccaggactggcctgtggagtctttttcttactactgtatccattctagcctccacctactttgtctttcagcccttgccagcctaagatgcccctcrcagggctccacaaacacactcatctacagcaggcaagctacctagaattcagtcggtgtccgggtgccagaaaccaccagcttcctgttaacaattccctggcttaccctgggcttacctgagcttacctggattccctgggcttaccacatacctatggagtcagaatgtcctggagctggccttggggcatttatattttaaacaagctccccaggtaattctgatctgtttgaaaaccagtatttcaagaaacaaaaatcttaactgcaactgatgaaacgcagatattacttggtg

SEQ ID NO: 89038 - DNA, 601 bp, Human
aacttaggccttcactccgaaactgggacttctgggttcctgggtttccatatcaatgaattacctaattgaaaataacattccatggaaaaggatgggcaaatgcccagcacccaaggccaccactcaaagcttctgagatgaagccagcaatcaaaaccacaaatcaaagtgcataaagaggctgagggctccacggagagttctgaagccaaataatgcccagtgattgttggtccattttccacatgagaaggacatggctggagagcctggggagagggaatggctcccatgctgytcttaggctgttcctgttctctgttttcagggccacagattcatccaggactggcctgtggagtctttttcttactactgtatccattctagcctccacctactttgtctttcagcccttgccagcctaagatgcccctcgcagggctccacaaacacactcatctacagcaggcaagctacctagaattcagtcggtgtccgggtgccagaaaccaccagcttcctgttaacaattccctggcttaccctgggcttacctgagcttacctggattccctgggcttaccacatacctatg

SEQ ID NO: 89039 - DNA, 601 bp, Human
tttcagggccattactttcttgtgcctatttttattttatttattttttattttatttttatattttgagacagagtcttgctctgttagccaggctggagctcagtggcaccatcattgcttgctgtaaccttgacctcctgggctcaagcaatcctttcacctcagcctcctgagtagctaagactacaggtgtttgccaccattctcagctaatttttgtttatttttatttttgtaggaggtctcactattttgctcagctggtctcaaattcctagcctcaagcaaacctcccacmtcagcctcccagagcactaggattataggtgtggccgaccaactgcacccatttttaaaacaaacaacttaggccttcactccgaaactgggacttctgggttcctgggtttccatatcaatgaattacctaattgaaaataacattccatggaaaaggatgggcaaatgcccagcacccaaggccaccactcaaagcttctgagatgaagccagcaatcaaaaccacaaatcaaagtgcataaagaggctgagggctccacggagagttctgaagccaaataatgcccagtgattgttg

SEQ ID NO: 89040 - DNA, 601 bp, Human
ataaggcttccagcaggggtcagggagtcaggaaaggatgctgtaattgtaagatctatacagacttgcaattgtgcctggagcaaacactttcctggattaaagaaaaaatgtgaagagtagatgagacacatatatatgaatactacataagacatggagctcgtctcaccacttattagttattaatatgtgaccatggttagtggcttattcccattttacagatatgtatgtcaaggctcagagcggctaactccaacctcatggagatgctgtggggattaaatttttgagcatkcatatatgtgtgctgctaaaaacccctctcgcatctctgtcagtaccattaattctctgagtcccgacaaaggcattccttgtaggttctgttttcacacatgtaccccatgtcctctcatcactcatgcttagtaagcctgagttagtgatgctttctagaacatctcatgggatacccaattgcaagatgattttatagcaacatattctctcaagaggaacctaatcctgaaggaactgatctgtaactgacacaaattagttaaactaacattagcatagctgctctcttcccata

SEQ ID NO: 89041 - DNA, 601 bp, Human
aaaatctgttttgtggatctggtggcgcctgctctgatgaaaagtccaaaggcaaattttgtggctaaggtgagttctaggaataaaggagagacatgcattgccatctttatctttaccatcaagttcaaagttgagagacccaggtgtgtctctgggaatcttgtttgatttgtgttcctcagttccttcctagaaatttgggaatttgagctttttagaaaactataaactggaatttgtaaatttgcattgttcttacctaggaagatagggaatatattgaaatgagagagagacggagagagagagagagagaacaaggaaatcatctgagccaaaatgtacatttagagaaaagtggttttatgacttctaagtctgaaagtcttttttccatacttattctaacaataatgctggctactttcattttgttttaagcactatggtgagagctgcacacccattccctcacttaatgcttaccacaacccgaaaatctaggtgtcattattgcaacgtggcaaataaagaaactgaggttaagaaaagctaaataatcagcccaagaccaggaaaccaggaaatgaaaacaatc

SEQ ID NO: 89042 - DNA, 601 bp, Human
acgcttggctcttctgtacaaaaaaagacttttgctgagaaaagttcatgttattttttactttggaccacttcccttaaccaaaatctgttttgtggatctggtggcgcctgctctgatgaaaagtccaaaggcaaattttgtggctaaggtgagttctaggaataaaggagagacatgcattgccatctttatctttaccatcaagttcaaagttgagagacccaggtgtgtctctgggaatcttgtttgatttgtgttcctcagttccttcctagaaatttgggaatttgagcttttyagaaaactataaactggaatttgtaaatttgcattgttcttacctaggaagatagggaatatattgaaatgagagagagacagagagagagagagagagaacaaggaaatcatctgagccaaaatgtacatttagagaaaagtggttttatgacttctaagtctgaaagtcttttttccatacttattctaacaataatgctggctactttcattttgttttaagcactatggtgagagctgcacacccattccctcacttaatgcttaccacaacccgaaaatctaggtgtcattattg

SEQ ID NO: 89043 - DNA, 601 bp, Human
accacttctaagtccttgattgcaatgatctttccacagatcaggcaggcgatacccaggggagagtacctgaaaaacacaaaagggaaaaacagcattgaagagatcattagggattcagaacctgggcctcctctgtaccgcacactgaggaaaacgcttggctcttctgtacaaaaaaagacttttgctgagaaaagttcatgttattttttactttggaccacttcccttaaccaaaatctgttttgtggatctggtggcgcctgctctgatgaaaagtccaaaggcaaattttgtsgctaaggtgagttctaggaataaaggagagacatgcattgccatctttatctttaccatcaagttcaaagttgagagacccaggtgtgtctctgggaatcttgtttgatttgtgttcctcagttccttcctagaaatttgggaatttgagctttttagaaaactataaactggaatttgtaaatttgcattgttcttacctaggaagatagggaatatattgaaatgagagagagacagagagagagagagagagaacaaggaaatcatctgagccaaaatgtacatttagagaaaagtg

SEQ ID NO: 89044 - DNA, 601 bp, Human
tcttcaagtgaagatctgtatggatagagatacttagtcatggaaaatttataaatcaagaaggaaattttgaagtgttttccttcatcttcggaaactgggtaaagaatctagacccttaagattgtatatattccagctttgtctgaaactccattttctactagcactgaatcctcattgatttgcaagatggaagttttatttggcttcccaggtggttggcattattggtctgttaggtcgcttaagggaaacctgactgactgctcagtagccgtggagcaacaggccctgctgygtcatgcagtggcacctccctagcattgcatgggcacaggttctgcaacaaggacctgaatgatgagctatgggtttcagaatttgcttgcctccctgccacctgttttatgattcagtcttagttttgtgacccaaggacatatgtgcagaaataaaacaatgattgcaagctgaaagtaaaacactagtcttaaaaattctcaattgtaaggcatttctttctttctttctttttttttttcagatggagcctcactttgtcacccagactagagtgcagtgatgcaatctcagctca

SEQ ID NO: 89045 - DNA, 601 bp, Human
aaatatacatcactgtggctaggacagggtggggtttgcattgtagtacatacagtgcattattatgcagtttaaaaaatggtagtaaagtctcttgcaatagatacaacttttatgatacgttgaccagtaaaaaaataactatttataaaacaatatatacatacatagtaagaacttgaaagatatataactaaagactaattaaaaggttatgaccagttatcactgggtgatagaataattggcaaagctcattttcttcttcaaaattgtattcactgcctgaactttttcacawtgagcctgcagaaattttattttatttttgttttctggttatgagcctggtatgagataaagtatgagataccaggcttataaccagaaaacaaaaataaaattaaaccaggttgggtttttttttttttctctttttcttcaagtgaagatctgtatggatagagatacttagtcatggaaaatttataaatcaagaaggaaattttgaagtgttttccttcatcttcggaaactgggtaaagaatctagacccttaagattgtatatattccagctttgtctgaaactccattttcta

SEQ ID NO: 89046 - DNA, 601 bp, Human
acatttttctgaatagcaatctggtaatgtgcttcaaaactgtcaatgtgcataccatttgactctgaaattccacttatcctgaggggatcatcatacaaccttgcagagatgtatttgtaaggatgtttgtcacagccctgtttaatagacatgccttaaatatacatcactgtggctaggacagggtggggtttgcattgtagtacatacagtgcattattatgcagtttaaaaaatggtagtaaagtctcttgcaatagatacaacttttatgatacgttgaccagtaaaaaaatarctatttataaaacaatatatacatacatagtaagaacttgaaagatatataactaaagactaattaaaaggttatgaccagttatcactgggtgatagaataattggcaaagctcattttcttcttcaaaattgtattcactgcctgaactttttcacattgagcctgcagaaattttattttatttttgttttctggttatgagcctggtatgagataaagtatgagataccaggcttataaccagaaaacaaaaataaaattaaaccaggttgggtttttttttttttctctttttct

SEQ ID NO: 89047 - DNA, 601 bp, Human
tattgcattcatttttccaaaatgtcatcaaatggtctttggacaattaagtcgactgggaaaaatgattggtaagtataaaaatatcctctatttctctactggacaggctttttgtcttaaaaaacccacccacccaatcaaactaggacttgagaattttaatttcaagctttcctgtgtggatgggctgacatgctgacattgcttttttggttcctgcctcaatggccatatgacagccttcaaatgttgctaataataactgtcagatatttgaaatgcttcttttgttttttamgtattagttttaacagactgcactgaagttggagggctgaagacaggtcagtctcaggccaccccactccctctgtcctccctgacaccagcctctggaaccattgagaaaagatgttcaactaccctcaacgtctttattctgtacaagggccgaggaggcaggaaggatattttgtgggctgtccctgggttttacatttttttttttcttctctgtgaccatgatggcaaagaaaccttcagttaattctcggtacatgactcacgccacatggccttttaaaaaaagaaattccac

SEQ ID NO: 89048 - DNA, 601 bp, Human
accaggactggtatgagatgactgctcagttgtggttggtggccaggattctcgattgcaagcattctcaaatctaaggatacttctggaattgctggcatacatttatgtttattattgcattcatttttccaaaatgtcatcaaatggtctttggacaattaagtcgactgggaaaaatgattggtaagtataaaaatatcctctatttctctactggacaggctttttgtcttaaaaaacccacccacccaatcaaactaggaattgctggcatacatttatgtttattattgcattyatttttccaaaatgtcatcaaatggtctttggacaattaagtcgactgggaaaaatgattggtaagtataaaaatatcctctatttctctactggacaggctttttgtcttaaaaaacccacccacccaatcaaactaggacttgagaattttaatttcaagctttcctgtgtggatgggctgacatgctgacattgcttttttggttcctgcctcaatggccatatgacagccttcaaatgttgctaataataactgtcagatatttgaaatgcttcttttgttttttacgtattagtt

SEQ ID NO: 89049 - DNA, 601 bp, Human
gtctcatgcctccttcttggtctggggtaggaagaagaattgtttgttgggggacatctcataactaaaatcttgcaaacccagggcaaagttggagcctggcctcatttgcatgcaggggatggcatcagacctagcttgctatcttaatgagaagtcagtgtccctttcttcctcttaccccaccctttcctgggccctttcgaagggttgccaggacaccaggactggtatgagatgactgctcagttgtggttggtggccaggattctcgattgcaagcattctcaaatctaaggayacttctggaattgctggcatacatttatgtttattattgcattcatttttccaaaatgtcatcaaatggtctttggacaattaagtcgactgggaaaaatgattggtaagtataaaaatatcctctatttctctactggacaggctttttgtcttaaaaaacccacccacccaatcaaactaggaattgctggcatacatttatgtttattattgcattcatttttccaaaatgtcatcaaatggtctttggacaattaagtcgactgggaaaaatgattggtaagtataaaaatatcct

SEQ ID NO: 89050 - DNA, 601 bp, Human
ttaattgggttgcaaaaaaaaaaaaacaaaagccagctatgtcagaaaagaatcagctatcaacagcaaaatgggatgaggaatttttgaataacccataatttcatgctagaaatgctgtttccgataaaatgactgaatggattgcatttagccctgggaaattgtcctgagctggacttgctaatttccataacaacaaacatgtccagcacacttcagcatgaacctgagcttcaagcaattcactggggaacctcacagatagtccaacaccctgatatatgctcatcggccaatkctacagtcacttcaatgacatggagcaggaaagcatgtgctcattagcaaatcaaagactaaatatgaagggacttcacccccactcctcccaggcctgggatgtggattcgtgaccacatgaccaagcctcgaaggccagaattcctgacacgttcatatgtcttcaaaattggagaccaataaacagtaagggttgctaaaggccagaatattatttccatgtggatagaagtgcctgggagggtgagtggatttgctgcaaagtttaagtaatgtagaaagcaatgcagaacactca

SEQ ID NO: 89051 - DNA, 601 bp, Human
ttaagacactaataggcagcaaaatattttcattggttctggttttggagatatactcagagcttgaagattttttcttttggccactgtttccaccttggattcgatattgaagtgcatctgattgcccatattaattgggttgcaaaaaaaaaaaaacaaaagccagctatgtcagaaaagaatcagctatcaacagcaaaatgggatgaggaatttttgaataacccataatttcatgctagaaatgctgtttccgataaaatgactgaatggattgcatttagccctgggaaattgycctgagctggacttgctaatttccataacaacaaacatgtccagcacacttcagcatgaacctgagcttcaagcaattcactggggaacctcacagatagtccaacaccctgatatatgctcatcggccaattctacagtcacttcaatgacatggagcaggaaagcatgtgctcattagcaaatcaaagactaaatatgaagggacttcacccccactcctcccaggcctgggatgtggattcgtgaccacatgaccaagcctcgaaggccagaattcctgacacgttcatatgtcttc

SEQ ID NO: 89052 - DNA, 601 bp, Human
tccactttagagaagcaggacaatgcataaactggaatgccactgcatccttagtttttcttgttttgtgtcaatcaagcaatgtgacatgcaaaaaagcagtatctggagccagattaaaaactcgtgagttggaggctcaaattcaatcttattaagacactaataggcagcaaaatattttcattggttctggttttggagatatactcagagcttgaagattttttcttttggccactgtttccaccttggattcgatattgaagtgcatctgattgcccatattaattgggttgcaaaaaaaaaaaaacaaaagccagctatgtcagaaaagaatcagctatcaacagcaaaatgggatgaggaatttttgaataacccataatttcatgctagaaatgctgtttccgataaaatgactgaatggattgcatttagccctgggaaattgtcctgagctggacttgctaatttccataacaacaaacatgtccagcacacttcagcatgaacctgagcttcaagcaattcactggggaacctcacagatagtccaacaccctgatatatgctcatcggccaattctacagtcacttc

SEQ ID NO: 89053 - DNA, 601 bp, Human
gagacagggttatgtccactttagagaagcaggacaatgcataaactggaatgccactgcatccttagtttttcttgttttgtgtcaatcaagcaatgtgacatgcaaaaaagcagtatctggagccagattaaaaactcgtgagttggaggctcaaattcaatcttattaagacactaataggcagcaaaatattttcattggttctggttttggagatatactcagagcttgaagattttttcttttggccactgtttccaccttggattcgatattgaagtgcatctgattgcccatattaattgggttgcaaaaaaaaaaaaacaaaagccagctatgtcagaaaagaatcagctatcaacagcaaaatgggatgaggaatttttgaataacccataatttcatgctagaaatgctgtttccgataaaatgactgaatggattgcatttagccctgggaaattgtcctgagctggacttgctaatttccataacaacaaacatgtccagcacacttcagcatgaacctgagcttcaagcaattcactggggaacctcacagatagtccaacaccctgatatatgctcatcggccaat

SEQ ID NO: 89054 - DNA, 601 bp, Human
aggcaaagttccagcactgagaacaaagagaaagagagagacagggttatgtccactttagagaagcaggacaatgcataaactggaatgccactgcatccttagtttttcttgttttgtgtcaatcaagcaatgtgacatgcaaaaaagcagtatctggagccagattaaaaactcgtgagttggaggctcaaattcaatcttattaagacactaataggcagcaaaatattttcattggttctggttttggagatatactcagagcttgaagattttttcttttggccactgtttccaycttggattcgatattgaagtgcatctgattgcccatattaattgggttgcaaaaaaaaaaaaacaaaagccagctatgtcagaaaagaatcagctatcaacagcaaaatgggatgaggaatttttgaataacccataatttcatgctagaaatgctgtttccgataaaatgactgaatggattgcatttagccctgggaaattgtcctgagctggacttgctaatttccataacaacaaacatgtccagcacacttcagcatgaacctgagcttcaagcaattcactggggaacctcaca

SEQ ID NO: 89055 - DNA, 601 bp, Human
tgtaaaatgggaataatgactattccttctcttcaggactgctgggcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttayaaattgttgagtccaagattgacaaactccgttgtcttaaagggctaagctgtggtgacaggtgcagcaggccaggcataagtaatagggagcaggggagactgtgggaaactgaagggcagctgtctcataagaggatgaaattctaatcttttacaatatatttcaaggcaaacaaagcaacactctgggctgggagtccatccatgaactaccaacttttagccccaaattatgaataccttccttatttatagatgaggaaattgagactgagagtagggatatgacataaggcag

SEQ ID NO: 89056 - DNA, 601 bp, Human
cggggtttgaagtgggagaaagaggctagtgccttagcctgaacccaaaaactattgccccttctaatgcccaatggaaaaagtcaataaaaacactattctaatgtctttttttgagtcacagtcagaaagaagaaatgacctgtggttggaagaggtaaactgtggaatagaaatttgacttgtgcctctggcacccatagccatgagacctaggtttgtcagataatttctttgagcctcacatgcctcctctgtaaaatgggaataatgactattccttctcttcaggactgctggkcatgttcaaagcaatgtatggaaagagtccgccatctcagaggaaccaaagagtggagtgattatcatcatggaggatgaaagtgtattccagtgtctacctcattcatttcctaaagtgaatcacccaggccttggctgttctaatatctggaattctctttctactacaagtacatctgtcacacagaatgttacccacttactccctatgttttctgatcacatagaatctgagaggggaaataaaacttataaattgttgagtccaagattgacaaactccgttgtcttaaagggc

SEQ ID NO: 89057 - DNA, 601 bp, Human
ccagttacctcaacttactgtgcctcattttctccatctgtaaaatatagaacccaatatctactttgtagggctgtttctaggatcacaagttaaataaatggaagcatatgccagcatttggaaacttaaattatagttgttcctctagacggctgtgtgtgatctattctctgagcctctgtttccttatctatgtataaggtgagataatttagcaagagaaccactgggagacatttcagatgatacattctagctgattaaataaatgtgattgttatttcatgttttcatattttgtgtgtgtgtgtgtgtgtgtgtattaaacatggtgaattttttcttttctctatttgctgactgagttgctaaagtgaactcagatgcatatgggatattcactaaatcttctggaatggttagaaggagagaggagaaagctgtgttttaacaaaaatgtccttgagctggttgaatacctcagagctagatagatcaagcaaaggctctgaagtggccattccatggcaatatcagcccctagaacacatagaggacatgattagagcaaatttccagcactgctacagacactggg

SEQ ID NO: 89058 - DNA, 601 bp, Human
agcctctcaaattgtttcaactaaatccaggccatcagttgaccaagcacagaatcctggggtcttattgctgaatatacctaatcttacgtttggaagattaaggcccctggagagcctgtggtttgagctgttttttcccctattgccatcattcccaggtttaggcccatccttgcatagacacttgccctgggtgtgatctacagaccccccaaccacacccttcccctccccgtccatggtgtcaaggctcagagcactccaatttccttgaatccatctgggtcacaggaggtayagtgtggagtgctcagccgtgaaagttctgcagttgaacaacctgagttcaaattccagctctgccacttaaccacatgactacaggcaacttaacctccctgtgccttgacttcctcatctgtaaaaaggagatagtaatggtatctctctcatggggtggtcagaagctttcaggagctaataaattaaaatgcacttacaagaggctgggcacattgcaactcccccacccccaccatgcccagtgaatgtgaattgtttttcttatcaagaaatctggacaggaccaggctgcttt

SEQ ID NO: 89059 - DNA, 601 bp, Human
aggcagtactcacagtcccagcagaaccccatccacagacacttacagcagccagtccacagccaccagcaggctgatgtcctctgttggcaggcccacggctgtcagaatgaggagcatggtgaccagcccggcactggggatactggccgcgccgacgcttgccagggtggctgtgaggctatgagaacagagaagttcaggtcatggaaatggaaagaatcttagcaaaaccaaccctggcaattttaagctctaattttcctgcagccataaaattcatcccccaacccccaccccrtactctccaccaaggaatagagaaatctaaagtactaagaccaaggaattaaggattaaggcctatttgggtactgctcaactatgatgtaagcttataaattcatggactggagccttattcccatgatgctatccggttagtctaatatatcacagggctcaaataaggcaagcgtggctctaaaagcaggcaaggaaatattaaagataaaaacaaatcacccttaatcctcccatgggaacacaactgcattcatttctgcttacgcttttatgtctctgtgagcaccagaggctt

SEQ ID NO: 89060 - DNA, 601 bp, Human
ggaataataacatttaactttcaaggttgttaaagaggaagatgtaaagtgctcagtctagtagctggaacctagtgaacactcaaattcagtaaccactttcatgtttcttgatattctccgctctgtccttccattcttgactgggatgaaggcctctctctatcactatgcttttatgtgtgtgctgtgttttaatcactttactgaagcataatttacatacaacaaaacgtacccattttaagtgtgtgttttgaagagttttgacaaatgtagacacctgtgcatacctgtgcakatggaacatttctgtcactcccaaaggtttccttgtgttccttcccagttaatctctatccccctatacctggcccaagaaaccactaatctctttcttttttctttttttttcttaggcagagtcgcactctgtcccctaggctagagggcagtggcacagtctcagctcactgcgacctccgcctcccgagtttaagcaattctcctgcctccgcctcttgagtagttgggattataggcacatgccaccacgcccagctaattttttgtatttttagtagagatggggtctcaccat

SEQ ID NO: 89061 - DNA, 601 bp, Human
tgccaataaatgtcagaaaatttgctactggcaagtcaggcagtttgaaaaataagtgtgggcactttggccttgggactctgggccagcacttgtcactctgtgcctctgacattgaagactggcattgccggaggccctatcatttaactccagtgctggacaggaggcatcagattacatctcacagaacatccaagcccaagtgggcacttagaggggatccattccaacccccttgtcgaagaccatctggttagactttcccacctttgtgaatgggcagtgagtattctacatkaggaaaatgtccttcactgggaaaggtagctgaactaccatacatggtcaagttcaagtttctctgcatggcctttgaggatgtccgtcttgctcacctttcaccacgccctgcctccaagagtaccagaccacttgtacatcctcacactgctggtagcctcagtgcctttgtgcaggctggccttgactggaatgtcctgtctccccgtctccctacatacacctgagaaacttttacctattggttatgattcagctcagctaccactgcctttagaagcttgaatgtgaccataaa

SEQ ID NO: 89062 - DNA, 601 bp, Human
tttttttttttttttttttagatggagtttcactcttgttgcccaggctggagtgcaatggcacgatctcagctcactgcaacctccgcctcccaggttcaagtgattctcctgccttagcctcccaagtagctgggattacgggcatatgccaccacacctggctaattatttttgcatttttggtagagacggggtttctccatgttgttcaggctggtcttgaactcccgacctcaggtgatctgcccgcttcagcctcccaaagtgctgggcacttcttatttctaacctaagcccygttgtctgcaccaacagcaggcacatcttatggagaagtcaggcttctttctagccttcccagctgtccttcctcccttcggccacttgcattttcctctctttggaagggtgggagtgggaagcagaaacagactcaagtccacaaaatgtggcttctgaggctgggcacagtggctcacccgtgtaatctcagcactgtgggaggctgaggtgggccgatcacttgaggtcaggagtttgagaccagcctgaccaacatagtgaaaccctgtctctactaaaaatacaaaaattagcc

SEQ ID NO: 89063 - DNA, 601 bp, Human
tcctgatcatattagtgcatttttttccactcaaaggcatttgtattataatggggggcagcctctataataatattttttaaaaagatgaatttctaatggtggtttaaagccttggaaataagcccaagaaaaaaatgaggcaatattgtcacagcaggcgagggaccctcaatgaccacaagcattgaaaagacttgagaggcaaagagtcaagggtttaagtaagcaacaagtcatggggaaagccagcagaacttaaatggcttccttcgtctttcttttcatgtggatggaccctattatcacacagcaactatgtggttaagagtagctcacatttattgagctgctactatttgctctgtctctagaccactgccaatgtctttatttcccttttgtcccccttccatccatggcctaccccattcctttgtatccttcatccccttctctcacaatccttctcacccatacaccaccattgactctcagctgccttgtctgaacagatgtcatgagaaaggctgtcccttggggccaatataggacacagagaataaccaagctagcaggtagggacgccactaccaccacc

SEQ ID NO: 89064 - DNA, 601 bp, Human
cccatttgtcctcattgagcctatttgttttattttcatgctgagagaagaaaaaaataggtcaaaaatatttctctggttagcatgcagaatcaggtgtgtcttagtctgtgctgctatagcaaaatacttgagattgggtaatttatatagaacagaaatttatttcctcagaattctggaggttgggaaatccaagatcaagaaactggtatctggtaagggccttctttctgcatcatgacatagcagaaggcagaaagacaaagagagggcaagaaggggctgaattcaccctttyataatgcaccaaccccactcatgagggtggagccttcacgatataatcaccttttaaaggccacacctcttaatattgttacaatggcaattaaacgtcaacatgagttttggactggacaaatattcaaaccatagcccagtgggtggccctaataagtgtgtcttctccaaccgttccaactctgggcctctctgctcctcctccccactgttagaacacttagtacaaattaggaggctgtgtggagttgggtgaagtgtcctgacctggccatacaagctctgctgtgcatcaggc

SEQ ID NO: 89065 - DNA, 601 bp, Human
aacctagactcttgcttccaacctgatatgttattgccccattttacacatgatgtagctgaggctcagaaagtcacttgcccaaggtcctttagatagtaagtgcagagctcagactgagggctcctgcctcttagactctctttcccttgatcacactcctccctccatttgagatcagagccccagaactggacaacagctcttcatttgctcctttcttcccagctccagcctaggatggggttttctattatatgatttcatcaacatagttaatccaaatgtatcatcctttttwaaaaaaaaaaaaaattcagccaactcccttctgctgacacacttcagccctggagttaggacgctctgctttcctttgcaagtgtaagcatgtgagcacctgcatggggtgatctgggagggcccagccctcctgtttcatttgctaacatttaggtcagaagtaggcagggttttgaatgtttcatgaagtgactcacatccaacaggcttgaaaacaagtgactgccaaggaccaggacctacaatggcagacccactggggctggaagacttgaattctaagggtggccaagacctt

SEQ ID NO: 89066 - DNA, 601 bp, Human
cttctggaagggagagtccctggagattgcatcatcagaatcacctgggaacttgctagaaatgtcaattctccagccccacctcagatatatctctgggagattttggtgcatgctcgagtttgagaatgaatgctctattctctccagagaggaatgctgttgggaggagcttcagagccctcctggagggtggaggctctttgaggtcttccttctaagtgccgtctcaactatattccccaattagcacatgtgagcccagaaaagatctcactagcagagtcttatgtgagaattrggccataggtccactcggatttcactttattttgattttccttttcctacctgtagccagacacagttatttattacctcttcctggtattggctcccatttaccactccatcctgcctccttcagagacactggggtgtcagcaaggtctcataaatatctgccaagggctcctgacgcaaagggcttcctggacccaggggaaggttctggttttaaacagtcccacccatccagtgctctgggactcggcatttttcagggctccagaatcttggttttcaccatgacatttacaga

SEQ ID NO: 89067 - DNA, 601 bp, Human
tcaaaaaaaagtagaggtgctcatatacccacaatcagaaactcctgttttccttctccgtctctagttcattgcttctggaagggagagtccctggagattgcatcatcagaatcacctgggaacttgctagaaatgtcaattctccagccccacctcagatatatctctgggagattttggtgcatgctcgagtttgagaatgaatgctctattctctccagagaggaatgctgttgggaggagcttcagagccctcctggagggtggaggctctttgaggtcttccttctaagtgccrtctcaactatattccccaattagcacatgtgagcccagaaaagatctcactagcagagtcttatgtgagaattaggccataggtccactcggatttcactttattttgattttccttttcctacctgtagccagacacagttatttattacctcttcctggtattggctcccatttaccactccatcctgcctccttcagagacactggggtgtcagcaaggtctcataaatatctgccaagggctcctgacgcaaagggcttcctggacccaggggaaggttctggttttaaacagtcc

SEQ ID NO: 89068 - DNA, 601 bp, Human
atttgcatcctgtatcttttcaatctatttttttgaaaggatgcatcaactgtcaagagttaactcaaaaaaaagtagaggtgctcatatacccacaatcagaaactcctgttttccttctccgtctctagttcattgcttctggaagggagagtccctggagattgcatcatcagaatcacctgggaacttgctagaaatgtcaattctccagccccacctcagatatatctctgggagattttggtgcatgctcgagtttgagaatgaatgctctattctctccagagaggaatgctgwtgggaggagcttcagagccctcctggagggtggaggctctttgaggtcttccttctaagtgccgtctcaactatattccccaattagcacatgtgagcccagaaaagatctcactagcagagtcttatgtgagaattaggccataggtccactcggatttcactttattttgattttccttttcctacctgtagccagacacagttatttattacctcttcctggtattggctcccatttaccactccatcctgcctccttcagagacactggggtgtcagcaaggtctcataaatatct

SEQ ID NO: 89069 - DNA, 601 bp, Human
acaattcatctggtgtcttgcattggattgaaccatatgaaattgccatttatttccatataaaaaggtcaaatattggcaatttcatatggttcaacttaatattgatagaaacaaaacatagcacctgcctctcaggatgcatggtgcgaagggactgtctttaggggcagggtgtggaagaggggtcacttgaggccccaaacccgaggaaggctggcacagctctgggcattcaagggctaaagtcacatggggttagggaagaaaaggagatccacgtaagcattggctaagagcstgaagtccggataccagcctggatgacactcccagctcaagcattaaagatttcttagcctgtcctgctcagctttctcattcgtaacatatggagagggatactcacctgcaagcatgttgagaagataataactgctaacatgtattgagtgcttgtcaaccaagaggtcctccaccaaggctgttttatataaaaggcttatatgacccagaagaagcttctcattatattaccatttttagtccaggtgaaaaggggatcagagcattttctcttttattcctccctacaccttat

SEQ ID NO: 89070 - DNA, 601 bp, Human
tcatctctcagtctaaatcctccaacagggaaatgtgaaatcgtctggaactcctggttcacagagaagaacagggctgagggagctgtcacccacaattcatctggtgtcttgcattggattgaaccatatgaaattgccatttatttccatataaaaaggtcaaatattggcaatttcatatggttcaacttaatattgatagaaacaaaacatagcacctgcctctcaggatgcatggtgcgaagggactgtctttaggggcagggtgtggaagaggggtcacttgaggccccaaacscgaggaaggctggcacagctctgggcattcaagggctaaagtcacatggggttagggaagaaaaggagatccacgtaagcattggctaagagcgtgaagtccggataccagcctggatgacactcccagctcaagcattaaagatttcttagcctgtcctgctcagctttctcattcgtaacatatggagagggatactcacctgcaagcatgttgagaagataataactgctaacatgtattgagtgcttgtcaaccaagaggtcctccaccaaggctgttttatataaaaggcttata

SEQ ID NO: 89071 - DNA, 601 bp, Human
tgttaaacagaaagctgtcaatttggattaaactagaatacagagccctctcatgccaggtttctctgccacaaggcattctgggaagattcccaggatgcccagccaggaggtaggtcatggctgctctgcatgggtcttcctttctgaaaatgctgcaaggcagaacacccttgaggctgccaggggaatgtctgaccaactctggggaagtttaactggggcccaaggcaggacatgggagtttgtggttcatgtgtggaaagtttcttcacaggcagagtttcattttctctcacartcatccctcaccactcaggaaaccctgtctttcgcgttgccctcaagagctttaaggcttggtaaaagacaacttttagagtgtgtgacaccatctttgggtctggacgctgtgtgtcaggactgcaagaaggggatgaagatgaaagcagatcttgcatttcatgggttttctacagatgacacggctatgctttagaggtcaccaggaaccaaaaatgagagaggggcttgaccgagttacttcacactgagtcactgggtctggttcactgaaagaaaaacaagtaccaaggtactc

SEQ ID NO: 89072 - DNA, 601 bp, Human
gttagtgaatttatttattcaacagatgtttaataagcatcttagagtgtgtaagggcactatgccaattgcttaggcagcaaaaatccttcttaaactcccttttccccaagaacccacgtactgtttatttgtctacctcctccactagagtgagataaatgttcaaaaagaaatgagtacagagtgctacagggtcatgtaggtagaacactatcacacttgggtcataagaaaagctttaagtagaagtgtcttgagttgggccctaaggataagtccaagaaaatgagatagagaraggaaagaaataatatgcatgaaatctaagaggtaggaacacttagttgaattcaggatggctaacaagtatagtgagagacgcagaaagtaagaattaaccaaatcatgtatggccttatcagccaagttcaggagttagtctttatctcaagtgtaatgaagagccattgaaagaaaagatcatgtttgttccattgtgaagaacgaactaaaaaatcataagcctgaaagagtgaaatccagttagtgaggatatgatgggtttggagaaagatggatttgagcaagactcaggaga

SEQ ID NO: 89073 - DNA, 601 bp, Human
tgggaggctgaggtgggtggattacttgaggtcaggagtgcaagaccaccctggtctctactaaacccagtctctactaaaaatacaaaaattagccaggcgtggtggtgcacgcctgtaatcccagctactcgggaggctgagataggagaatcgtttgagcccggtaggcagaggctgcagtgagtcaagattgtgccattgcactccagcctgggccatagagcaagactctgtctcaaaaatgaatgaaagaatattttaaaatgaatttttaaaaaacaataaaagcagattgatrcttttattcttttgatgcaaaatcaagatgcaaagggccctggaccttgggtgagaacactaacccagggcttctgattcccatttgagcaaataacttttcacctgagcaagggaatgaggctaatcccaacctcacaggaggttgtactaagcggaataagagaaatactagacatcctttaagtactcattgtaggttacaggcatacatgagcaagaaaatgttccttttcttacacctgttaatagctaagtagaaagaagaaaacatcaactctaatagtttgagttctttgtt

SEQ ID NO: 89074 - DNA, 601 bp, Human
agccgggcatggtggtgtgcacctataatcccagatactcaggaggctgggatgggagaatcacttgaactggggaggcagaggttgcagtgagccgagatggtgccactacactccagtctgggcaagagcaagactctgcctcaaaaaaaaaaaaagaaagaaagaaaagaaaacaaagaatatactttatagatactaccttattaaccctcactgtaactctgaagaggtaatattattcgtatttactagatgacagaactaaggcctggagagattagtggcttcccaaagtctracatcctagtaaagtcatacagcaaatgtgaacacaggcggtaccattccagaatccaccatctgccacatgttgagaagcaccctggaaccacacagccctgattttgaatctagctcagccacctactaactgtgtgatctggatgacttactgctgtgatctgaacgtttgcatccccccaaaattcatatgacgaaacctaatcatctccaaggtgatggtatttggagatgggaccattgggaggtgattaggtcacaagggtggagccttcatgaatgggatcagtgacctcag

SEQ ID NO: 89075 - DNA, 601 bp, Human
aaaaatacaaaattagccgggcatggtggtgtgcacctataatcccagatactcaggaggctgggatgggagaatcacttgaactggggaggcagaggttgcagtgagccgagatggtgccactacactccagtctgggcaagagcaagactctgcctcaaaaaaaaaaaaagaaagaaagaaaagaaaacaaagaatatactttatagatactaccttattaaccctcactgtaactctgaagaggtaatattattcgtatttactagatgacagaactaaggcctggagagattagtgkcttcccaaagtctgacatcctagtaaagtcatacagcaaatgtgaacacaggcggtaccattccagaatccaccatctgccacatgttgagaagcaccctggaaccacacagccctgattttgaatctagctcagccacctactaactgtgtgatctggatgacttactgctgtgatctgaacgtttgcatccccccaaaattcatatgacgaaacctaatcatctccaaggtgatggtatttggagatgggaccattgggaggtgattaggtcacaagggtggagccttcatgaatggg

SEQ ID NO: 89076 - DNA, 601 bp, Human
agatagctaatagttaaatatctccacaggtagctactctatattcaccttatcttatgtaaagtgctgatttactgagcacaagataaatacataattgtctattgccctaccagcttcttttccctggcaacatgtggattcagtaaagtgaccagactctccctcttttccctccagtctgcatttcccctttaaatatggaagccctcaaaatcatctttggagaaaagtacaggctacagactgtttctgtgattccatgtttttttcttctgggcatgtctttaaccttggaaawataaacttctaaattgattgagacctgactcagatactttttagtttacatatacaatacctttgaccaattgcaaaattccaaagaatgctgaggtctttcagagcaatactctgagtacccattgatctcataacccagaataatttgcattattggcaaagaaagacaccaaaggtaatggtggtggtggtagtgataatgatgatgacagttaaatttatatcacacttactatgtataagaatatagtttataggctgggcatggcggctcatgcctgtaatcgcagcactttgg

SEQ ID NO: 89077 - DNA, 601 bp, Human
ttattataaattgtatcaagtcaattcaaatatatttgtggcaacttctaggtagatcatccaaatatggctagttaagctactatctccccctgaaaacattaaccctatttaatagcacaacaattcctatggcaacgctcccaactaactagctgacctatttgtccgttatacagttgtggtctactttggagctactccactatactttcaatccctcctggaatgtatcctgagtcatatatctgtgaaaggaaagtaaaatctccagcccccaatttactatgtcaaatggggaaaaaaaaaaaagctgaaagttgaatcatgcaagaaactgcctctccttctgttcctaagcagatagctaatagttaaatatctccacaggtagctactctatattcaccttatcttatgtaaagtgctgatttactgagcacaagataaatacataattgtctattgccctaccagcttcttttccctggcaacatgtggattcagtaaagtgaccagactctccctcttttccctccagtctgcatttcccctttaaatatggaagccctcaaaatcatctttggagaaaagtacaggc

SEQ ID NO: 89078 - DNA, 601 bp, Human
agataacaaagtgcttacatgcttccggacatttaataagaactcaaaaaaattatttattctatgatgtataattttaatattattataaattgtatcaagtcaattcaaatatatttgtggcaacttctaggtagatcatccaaatatggctagttaagctactatctccccctgaaaacattaaccctatttaatagcacaacaattcctatggcaacgctcccaactaactagctgacctatttgtccgttatacagttgtggtctactttggagctactccactatactttcaatycctcctggaatgtatcctgagtcatatatctgtgaaaggaaagtaaaatctccagcccccaatttactatgtcaaatggggaaaaaaaaaaaagctgaaagttgaatcatgcaagaaactgcctctccttctgttcctaagcagatagctaatagttaaatatctccacaggtagctactctatattcaccttatcttatgtaaagtgctgatttactgagcacaagataaatacataattgtctattgccctaccagcttcttttccctggcaacatgtggattcagtaaagtgaccag

SEQ ID NO: 89079 - DNA, 601 bp, Human
taggaaggaatacatgatagtagttaagaaaaagcacgaactttagaggcagcctgatttggattcaaatgccaatttgtcccttggctgtttgacaaccctgatcatacttgacatttgagagccttagttgcctcgtttataaaatgaaaataataaaaatctccaatacataaggttgttgtgaagattaaataagataacaaagtgcttacatgcttccggacatttaataagaactcaaaaaaattatttattctatgatgtataattttaatattattataaattgtatcaagtyaattcaaatatatttgtggcaacttctaggtagatcatccaaatatggctagttaagctactatctccccctgaaaacattaaccctatttaatagcacaacaattcctatggcaacgctcccaactaactagctgacctatttgtccgttatacagttgtggtctactttggagctactccactatactttcaatccctcctggaatgtatcctgagtcatatatctgtgaaaggaaagtaaaatctccagcccccaatttactatgtcaaatggggaaaaaaaaaaaagctgaaagtt

SEQ ID NO: 89080 - DNA, 601 bp, Human
gaaaaaaacaaaatactttatcttgctctattaacctaaaaaaataaatcttccagaatgtttctggaatcaggaaatgttaagaaaatccttctccccgtcttgagttgcaagttttgacttgaaaaaagaatggttgataactctcttagaaattcagtgccaggaaagctaattaaattcttaagagtaagttttctcctctcatccataagttcaagccaaatcagtgtgaagaatacttttggccatgtttactagatattcaaagtcttaaaaggaaggatgctggaaaaccacaaaaaaaagttaaaaaaattaaaatgaaggagtttacataaagatgctgctgagacagtcttagtccaggacattttagctttcaattcaaataatatgagttccaggcaaagcggaaactttaatttgttcttggaacaaagactctaaatgaattctagttgctattatcaaatctatttcttattagagaataataaggaagctgcactaggaaaagtcgggcctggctcctttgcaaggccagttgtttgcaaggtataagctggtggtctttctaatttcaactaagaagaaaatg

SEQ ID NO: 89081 - DNA, 601 bp, Human
tcgatgctgggagtcaatggtatccagctcagacttggagaggtgatagactatcccagccccaaaagagtcacccacaacattgactgaagttctcatcctgtccctggggacaaagaacagaaaaggttcagtgaggaagcagtattatgtggtagttgagaggtcaaggtctggagtcagagagacatagggttgagtactggctctaccttttccctctgcctgatttggggcaagttacttaactttcatgagccttgacttccttgtttgtcagttggaggtgatgcttatactyctctcataggccgtgtgaaaattcagtgagataacgtatgtaaagtgcttagtaaaatgtctggcaaatggtaaacaccaataaccagtagcaaaggaaaaggaggaggaggaaagaaaagattaaagaaaaataatgtgtccaaatcagaactagtacacaggctccagacacacctagctgagtacagcaacccctcctgatttaaactgttgtgtttttgaagactctacactatctctgcttatcttacttatttgttttactgaaaaacttaccatctgtgaactttctcatagt

SEQ ID NO: 89082 - DNA, 601 bp, Human
cctttcccacacaaataagaaaaagatagttgtgtaaagttaagttggcacatttttgaccaatatatgatatatagcaaggaggactacttgtgctaggtacatcagatgatgctggggatttctcttgatgtttaatttgaggaataaaatatttgaaagtcagtagccacaaattcttttttttttttttttttgagatggagtcttgttctgtcgcccaggctggagtgcggtggcgcaatctcggctcaatgcaagctctgcctcccgggttcacgccattctcccacctcagccycctgactagcaggagggcgcccgccaccacacctggctaattttttgtatttttagtagagacagggtttcaccttgttagccaggatggtcttgatctcctgacctcgtgatctgcccgcctcggcctagtaaccacaaattcttgggcgaaatattcaagacaactggtcaaattagttaaatggggtagataggggaacccgaatggttgtttcacatcacatggacgaaataagcaactgattgactctttctccatcagacttgttgatttcctgccatgttagacacagaatta

SEQ ID NO: 89083 - DNA, 601 bp, Human
aagatggcacagccaggcattgtctgagatgtagtgtttttaaaaagacatttctggataattgtcctgaaggatagctgttctttacttgaaattgtttacccacttttggagcaaggtactctcaggtcaaaattcacctttcccacacaaataagaaaaagatagttgtgtaaagttaagttggcacatttttgaccaatatatgatatatagcaaggaggactacttgtgctaggtacatcagatgatgctggggatttctcttgatgtttaatttgaggaataaaatatttgaaartcagtagccacaaattcttttttttttttttttttgagatggagtcttgttctgtcgcccaggctggagtgcggtggcgcaatctcggctcaatgcaagctctgcctcccgggttcacgccattctcccacctcagcctcctgactagcaggagggcgcccgccaccacacctggctaattttttgtatttttagtagagacagggtttcaccttgttagccaggatggtcttgatctcctgacctcgtgatctgcccgcctcggcctagtaaccacaaattcttgggcgaaatattcaa

SEQ ID NO: 89084 - DNA, 601 bp, Human
cacgcctgtaatcccagcaccttgggaggccgaggcaggtggatcacctgaggtaaggagttactgacaagcctgaccaacatggagaaaccccatctctactaaaaatacaaaaaaattagctgggcatggtggcacatgactgtaatcccagctactcgagaggctgaggcaggagaattgcttgaacctgggaggcggaggttgtggtgagccgagagcacgccattgcactccagcctgggcaacaagagtgaaactccgtcttaaaaaaaagaaaaagaagcaaatttatcctcakgtgcttgatgtccttcaaaaacaaatccaggaagtctgaaatctaaagacatctccacgcccacaccttctttttcaaaaagtgtcctacaaaatattaagaggcctcttgagaaattccaaaagggccatacgcagttaaccactaggattcttctcaaatataattatgaaatgtttaaaaaattgtgatttttttgttttacataatttttcctcatatggcaataatttgagttcaagtcttatcatcattacaacattatacattctttttgctgtcctccagtgcctaatttat

SEQ ID NO: 89085 - DNA, 601 bp, Human; identical to SEQ ID NO: 34328

SEQ ID NO: 89086 - DNA, 601 bp, Human; identical to SEQ ID NO: 34329

SEQ ID NO: 89087 - DNA, 601 bp, Human; identical to SEQ ID NO: 34330

SEQ ID NO: 89088 - DNA, 601 bp, Human; identical to SEQ ID NO: 34331

SEQ ID NO: 89089 - DNA, 601 bp, Human; identical to SEQ ID NO: 34332

SEQ ID NO: 89090 - DNA, 601 bp, Human
gatagagaaaatgtatatgaagaattaagacagtgtgtacgaaatgctccccagtttagatttgactggtttatcaagtctaggactgccatggtatgtattcctttcttaccgatttcctccaactttttattttgaaaaatttcagatgccatatatccttcacctagattctccaattaacattttgacacattggcgctctctctttctctctctctgtgtgtatgtgtatacatacgtagcacctatatatacgtgcagaatctatattttgtattaaaaaatacggggacatctrtattctatattctgaaatgcgtatctatattttataagtatacttaactatatttatgaaccatttgaaaattacagacaatgtgagtgttcatctctaaatacttaagcatgtatctcctaagaataatgacattttcttacataaccacaatcccacctgaaaacattgattcagtaatgtcatttagtatacagtctatgtataagcttttccagttgcccccaaaatgccccctttatagctgttttttttaaaattgatgatcctgcaagtttcacacattacatttcgttgttg

SEQ ID NO: 89091 - DNA, 601 bp, Human
ggagtttcactctttgtcacccaggctggagtgcagtggtgcagtcttggctcactgcaacctccacctcccgggttcaagcaattctcatgtctcagcctcccgagtagctggtattacaggcacctgcaccacgcccggctaacttttgtatttttagtagagatggggtttcaccatgttggccaggctggtctcgaactcctgatctcatgtgatccacctgcctcagcctcccaaagtgctgggattataggcgtgaaccaccgcgcccagcaaacatgacatttaatagggatamatgtaaagtgctatacttgtacaaaagaatatgaaaagatatatatgttagcaaggtacagtaggaagaattaagaaaagaataaaaaagataaagaggtaatctgtagcttgaaggactgaggttggatatagggaagagttgttttatagagttctttggatcattgaaatagattattgaagaacaatgtagaatagcttttcattagcctttgaaagtggaattctattttgactctctgaagacattggcagtaagttacttggccttttaaggtcccctttagcacagtgaatc

SEQ ID NO: 89092 - DNA, 601 bp, Human
acatgcagtagtttattttatatttaaatattttaattgaaaagttttatttattactttttctatcgtattaaatttttatttcccttctagttaatggataatttttgcttataataatttttgcttataattctggatttagagtataaataatgtattttaaaacacacatacatttggaactttttagaatatttcatgataatttcaacaattaggaaattatagaaatggattgatggttcttgatgatcttctttccccctttcatttttagtaactcttctgtatagtgaawcacattcacaatctaggaagagaaactgccccatttgaaagaggcacttgtgatttctgaaatacaaagaagttgtttcattgaaaaatcccatcttagaactacagagaatgtaatttgattcattatgtgagtgtgtcactgtgttcaaatgaaaatcttactaatgattgaacttagcttactaaagatacctttaaaaacgatctggcttaaagatgactcttttctttctcagagacatgaatagtgtgaaatgcatcttataaaaagtagaaaccttaatagttatatttgatt

SEQ ID NO: 89093 - DNA, 601 bp, Human
actttgaaagccttcagctaaaggttgcagatttctttgaggctctttttcattaaaaaatgctagctatacaaaagagaaaatgagtttcagttcaatttctctgtgctaaaaggattgtgatttctttctctgagaatttgtgtggtctttaagtaagtaatcagtctctattgaactacataaacaagtaggaaggatatgatcaacttagctttttaagctcagagcatatgaattgccctaccattttctttctaagaaaaccatcttagaatgaggtcatagtcttaggatagtmaaaaacttatcagagttaaaaggacccttatcaaataaccataagaggaagtaatactttgtatttatgtagtaccttttatataatgcttgccaatccctttaccaacattagcttaattttcttgccactccttttaggaaatgaatgtcaggagagtatctctgttcattgagtgacgactaaatgtgactgggagattctggaagaatctaagaagtccaaaagatctagcacattagtcagtttactgcaaaggacatgtggaaagagtacccaaaattcaatcagtaattcctt

SEQ ID NO: 89094 - DNA, 601 bp, Human
agttgcgcatcactacgaccggctaatttttaatatttttggtagagatgggatttcaccatattggccaggctggtcttgaactcctgacctcaagtgatcctcccacctcgcggtctcccaaagtgctgggataacaggcatgagacaccgtgcccggcctaatattgatattttagagcattacattcttagtagaatatgaaaaatatgaattaatacatcattggtaaaattaataaactgtaaaatgtactgatgggttcttcttgactatagaattaaaatatttaaaaccacrtatttatgcacttaggagtttattacctcctcatgcacttaaaagactaaaatgttcttttcttattaaattttttttttgaaacagggtctttttcttgcccagctggagtgcagtggcatgatcatgggtcactgaagcctcaaattcctggactcaagcgaacctcccacctcagcctcctgagtagctaggactacaggtgcgtgccactgcacgcagctggcttttttagtttttgtgaagacggggtctcactgtgttgcccaggctggtcttgaacacctgggctcaagcaat

SEQ ID NO: 89095 - DNA, 601 bp, Human
ttgtgttaacaggcatgaaaaacctcaatatccttatacattatctccatcagaactcttgggtggccaggtgcattgtcaaagagcaataatattttaaaaggaatctttttttgaggagtagggtctcaacatgggcttaaagtataaatacttcatactataaatagtgctgtcaccccagcctttgttgttccagttctagagctaaggtagagtggatttagcataatttttaagagccctaggattttcagaataataaatgagcgttggtttcaatttaaagtcaccagctgcwttagcccctaatgaataaacctgtcatttgaagctttgaagctgggcatccgcttttcctctctagttatgaaagtcctagatggcatcttcttctaatattagggtattttgtctccattgaaaattcgttggttagtgtggccaccctcatcaattatcttagctagatttttctggataacttgctgcagcttctccatcagcacttgctgtttcaccttgcacttttatgttatggaaacagcatctttctataaacttcatgaaccaacctccaccaactttaaacttttcttct

SEQ ID NO: 89096 - DNA, 601 bp, Human
gctgggcgtggtggctcacgcctgtaatcccagcactttgggaggccaaggtgggtggatcacaagatcaggagatcgagaccatcctggctaacatggtgaaaccctgtctctactaaaaatacaaaaaattagccgggtgtggtggcgggcgcctgtagtcccagctactcgggaggctgaggcaggagaatggtgtgaacccgggagatggagcttgcagtgagccgagatcgtgccactgcactccagcctgggtgacagagtgagactccgtctcaaaaaaaaaaaaaaaaaaaaatggagctggtatctatagagaacatgacatgacctgtgtgataggaaggtaacacccatacttgtccattccttgatgtctttctgtagcgtcttagattatttttctgtctggagtagttattgacaggttaaaaggaatgaaggtatgaactaattacacagtccatttatactcattttgaggtattctacttccctgcttaggaggctgtctcaaaagtattagtttttttttctgaatcacccacatgaaccatgaatatatatctaaagatatctccagtcacaagcaactatt

SEQ ID NO: 89097 - DNA, 601 bp, Human
aacttttgtaaactgggtacttccaaaacttattttgaccatagaacatccccttatttttttttgtttatgtgatttatgttaactttttattttgaaataagaaaattcacaaaaagttgtaaagaaaatgtacagggaggtctcatgcacccttcacccagttttccccaatagtaacattttgcaaaactatagtaaaatatcacaaccaggaaattgacattcgtgtaatctatagagcttgttcagatttcatcagttatacatgcgctcgtgtgtgtgtgtgtgtgtgtgtgtgcagttcaatgcagttttgtcatgtgtagagttgtgtaacctccaccaccataagactccattgtgctatctctttacagtcacacctaccctctctcctctccctagctcccggcaaccattgatctgttctctctttctataattttgtcatttaaggatgttatataaatggaataatatggtatgtaacctttcgaaattagctttttttttttacttagcataattcccttgaggttcattcagattgttaactgtattaatagttctttcctttttattgctgagtaatattata

SEQ ID NO: 89098 - DNA, 601 bp, Human
tctatttaggccctcaacagactggatgctgcccacctactttggggagggcaatccactttactcagtctatccattcaaatgctcatcttttctgaaaacaacttcacagacacaccaagaaataatgtttaaccagatatctgggcatccgtgatccagtcaagatgacatgtaaaagtaactatcacactgggctaagcattttacatgcaagactgcaatcctcacttaaacctgcaaggtaggtggtgttagccttatttgcaggaggtgaaaccaagtccctgggaggtttgastaacttgtcccaggtcacacagcacagtaagtgggagagatggaatttggatcctggtctgaagcccatgctcagtctcctaaccacttgctaccatccctctgcctcattaagataaattctgagctaaagatgaacactgaacgagtggtaagcaatctactacctgctgagttcagttccctagggtcagtactgtatttactttcacattcactattctaattcacactttgaccatgagctcaacactgggaactaatctgagggcataaagtaaggctttttcccctacttgtc

SEQ ID NO: 89099 - DNA, 601 bp, Human
acttgttagcaggaaggctggtgttgtagcctgaaggcctgagagccaagggtgtaggttccagcctgagtgtgaaggcctcagcaccaggagcaccaagggcagaagatatcccagatcaagcatgcaggaggagacaggacacattcttccttctttggctttttgttctatttaggccctcaacagactggatgctgcccacctactttggggagggcaatccactttactcagtctatccattcaaatgctcatcttttctgaaaacaacttcacagacacaccaagaaataatgtytaaccagatatctgggcatccgtgatccagtcaagatgacatgtaaaagtaactatcacactgggctaagcattttacatgcaagactgcaatcctcacttaaacctgcaaggtaggtggtgttagccttatttgcaggaggtgaaaccaagtccctgggaggtttgagtaacttgtcccaggtcacacagcacagtaagtgggagagatggaatttggatcctggtctgaagcccatgctcagtctcctaaccacttgctaccatccctctgcctcattaagataaattctgagctaaa

SEQ ID NO: 89100 - DNA, 601 bp, Human
tgaaactcacctcggcactggtaaaaagagggctcaacctgtctctagatttacagtctaatgcttgctctgccattttaccctcatacttatgttcatcaatcattgatgaaaaagaaaagaaaaaaaaaatgactggaataagggcaccttactggtaagaaagaaccaaacctcaaacccgtaccttctatgtcatggtgttctgggtatcagcaataacaacagtcacccttttactgagcatttactcatgttaattactgggtgtattagagttcttcagagaaacagaaccaayggcatatatttacatctagaaagggatttgttataaggtattagctcatgcagttatggaggctgagaagtcccatgatctgctgtctgcaagctggagacttgttagcaggaaggctggtgttgtagcctgaaggcctgagagccaagggtgtaggttccagcctgagtgtgaaggcctcagcaccaggagcaccaagggcagaagatatcccagatcaagcatgcaggaggagacaggacacattcttccttctttggctttttgttctatttaggccctcaacagactggatgctgc

SEQ ID NO: 89101 - DNA, 601 bp, Human
gtttagttatgcaaacaccccaaagaaaaatcaatctacccattgtaaacagagaaaatatttctcctgggttctaatctgtggttctcttaggtaataaaaccgatgctggcatgaagtttaggcttctggataataaagagctccctgagatgtgttgcaaataaaaatccaactactacccttatcctttatctgacgtcactgaaagcatttgtcttcttttttaatcctgtatacaatcattcccaaacactgaaagcatttctaatataaaattaggccaggacagtggttcatrcctggtaatctcagcactttggcaggctgaggcaggaggattgcttgagagcaggagtccaagatcagcctggacaacatagcgagaccccatttctacaaaaattttaaaagttgttaacaaggagccgggcatagtggcgcatccctgtagtcctaactacgcaggaggctgaggtgggagaatcacttgagcccaggagttcaaggttgctgtgggctataatcgtgccactgcactccagcctgggtgacagagaaggatcttgtctaaataataataataataataataataata

SEQ ID NO: 89102 - DNA, 601 bp, Human
aaagacattttatacgatggctatgttcaacatcttccaaggagctaagactcagaattccaaatgcttcacaatagtagtaggcaaactaattccttccacccatccccccaacacttactgagtgcttactatgtgcctggaactatttattctaggacttttagggtacacaggtgaattccttattcccagtatttccctcaggaagctcagagtctagggcagagacagtgaaacacagggtgataagtgcactgcagcacagaggggaagcctgacgcagcctgggattagagtrgggtgcaggtagtgggggaagacttgacccgaatctgtaataaaaatgggaatattcagggggtgatatcaatgctgaagtcctgattttcaaagaggataatggtgatatcatctaccgaacatttactctgagccaggcactaggctgctgtacatatctgacttcactgaagctgtgggcactgaattttcactctgaagcatttggaaggctttactggacttgtctcctgcaatttttatcactcctcactggaagaagaactgaagttgtgggcagaagccctgggtttgagtc

SEQ ID NO: 89103 - DNA, 601 bp, Human
ttccactgctctggggctggtaaaaatgagtcccccgtaatcttcaggatgagaaagctgcacaccaaaaagcaataaagacattttatacgatggctatgttcaacatcttccaaggagctaagactcagaattccaaatgcttcacaatagtagtaggcaaactaattccttccacccatccccccaacacttactgagtgcttactatgtgcctggaactatttattctaggacttttagggtacacaggtgaattccttattcccagtatttccctcaggaagctcagagtctaggrcagagacagtgaaacacagggtgataagtgcactgcagcacagaggggaagcctgacgcagcctgggattagagtggggtgcaggtagtgggggaagacttgacccgaatctgtaataaaaatgggaatattcagggggtgatatcaatgctgaagtcctgattttcaaagaggataatggtgatatcatctaccgaacatttactctgagccaggcactaggctgctgtacatatctgacttcactgaagctgtgggcactgaattttcactctgaagcatttggaaggctttactgga

SEQ ID NO: 89104 - DNA, 601 bp, Human
ctctgctgcttccactgctctggggctggtaaaaatgagtcccccgtaatcttcaggatgagaaagctgcacaccaaaaagcaataaagacattttatacgatggctatgttcaacatcttccaaggagctaagactcagaattccaaatgcttcacaatagtagtaggcaaactaattccttccacccatccccccaacacttactgagtgcttactatgtgcctggaactatttattctaggacttttagggtacacaggtgaattccttattcccagtatttccctcaggaagctcasagtctagggcagagacagtgaaacacagggtgataagtgcactgcagcacagaggggaagcctgacgcagcctgggattagagtggggtgcaggtagtgggggaagacttgacccgaatctgtaataaaaatgggaatattcagggggtgatatcaatgctgaagtcctgattttcaaagaggataatggtgatatcatctaccgaacatttactctgagccaggcactaggctgctgtacatatctgacttcactgaagctgtgggcactgaattttcactctgaagcatttggaaggc

SEQ ID NO: 89105 - DNA, 601 bp, Human
attcactggacaaattgaactgttctgaaacaaagttacaggctaatttatgacaattgctaagcattgttttaagtatttaaaatgctcaatgttaatttttaatgattactatttacattttatgctttaagaagaataaatagactcaagactggaaaaatgcacaaaatattaagaaaaccaaaaaaaaacaactatgatatcactatctggagatttaggcttttaaaaaaattatagtaaaaatataacataaaatttgtcattttaatcactaagtgcataattcagtggcatkatgtacattcacaatggaattagtcagccaaagggtacaaacattttaataaagcttttgcatacatactgaccaagtggttctcaaaagatgtaaaccaatttttaatgccatttggaaatgtttgattatatttgtttcactgcattcttatcagtagtatcgtatacttaattaatttttgcaaatttaataagcaaaaaataatatttttaaactgagttaaactgttttttaaaactgaaaaggctaagccattttttgttgttttatttttaccttgactccttacctagagaa

SEQ ID NO: 89106 - DNA, 601 bp, Human
caactcccaactggtttcttccccagcctcattttgttctctggaaaatgtgcttttaattcttaaactattttcactcatattatacattcctctaatattttcaaattcactggacaaattgaactgttctgaaacaaagttacaggctaatttatgacaattgctaagcattgttttaagtatttaaaatgctcaatgttaatttttaatgattactatttacattttatgctttaagaagaataaatagactcaagactggaaaaatgcacaaaatattaagaaaaccaaaaaaaaacaactatgatatcactatctggagatttaggcttttaaaaaaattatagtaaaaatataacataaaatttgtcattttaatcactaagtgcataattcagtggcattatgtacattcacaatggaattagtcagccaaagggtacaaacattttaataaagcttttgcatacatactgaccaagtggttctcaaaagatgtaaaccaatttttaatgccatttggaaatgtttgattatatttgtttcactgcattcttatcagtagtatcgtatacttaattaatttttgcaaatttaa

SEQ ID NO: 89107 - DNA, 601 bp, Human
ttggcaaccaagccactaattccctttccctggctgatctgctgagcttgtggtaaaagtcatgctgctcagaagatctaggaatcatcttttaattagcttagcaactcccaactggtttcttccccagcctcattttgttctctggaaaatgtgcttttaattcttaaactattttcactcatattatacattcctctaatattttcaaattcactggacaaattgaactgttctgaaacaaagttacaggctaatttatgacaattgctaagcattgttttaagtatttaaaatgctyaatgttaatttttaatgattactatttacattttatgctttaagaagaataaatagactcaagactggaaaaatgcacaaaatattaagaaaaccaaaaaaaaacaactatgatatcactatctggagatttaggcttttaaaaaaattatagtaaaaatataacataaaatttgtcattttaatcactaagtgcataattcagtggcattatgtacattcacaatggaattagtcagccaaagggtacaaacattttaataaagcttttgcatacatactgaccaagtggttctcaaaa

SEQ ID NO: 89108 - DNA, 601 bp, Human
ggaaaaccacaaagaaatgtatttcttaacacggttattgaagtccttttgttccagcgttattttttaacgtgcaaatacacaggtatgcagtttacaaatcacatagaggatgtcttttcttgaaagctactgagggaagatcacaagtgtctgttcagaagagaaagcatcaggtcctggtacctgcaccccagttgtgtaggctgggtaagtaaggccttaactagcttccctgagccccacatagctcatctacaagagggggaaaaaccaaccacatggaactgttttaaggatygtgtcagataataagagcaaagtgcttgccatctagaaggtgctcaacaaaggctgttttctcttcagtcaggaaggagatgatgggcatttggtactttttgcaggaatcggcattacagagccttcatttttttgggaggatgtggccagaccacatccagaaaggtgttatggcttgacatggccagactaaaatggaaggaaggggaggaaaggtttcataataatctgctaacagggacccacagcgctacaaatacaagtcatttaggatgaggggctataccagcacttttgt

SEQ ID NO: 89109 - DNA, 601 bp, Human
ttaaatccaagtccacaggcagcccaatcatgagtcagttctttacctgggagcaagctgggagagggaattcagagacagaagtagctcctgagaagggaaaggacagtcctcagtaaggggagagtacccactcacacctcctgcctctgctctctttggaatccctcaagtgatctctccactgtttttatctcccaaatgttttattttgtgttatgttcaagtcaagttctttggtacagggggtagaaggaagtgggctaaacctcacaaagtatagacatacacaaatacaaayaggctatgctcccagagtgggttatacgatgctcaccaatcaatctcaccaccaagaatgcactgaggaaatattcttttccctaggtagtggttgtgaggtcaacaaaaaataaatggcttcatttggagtgatgtttttctacttactggaacaaatatattctgcaagcttttctgcatttccacaggtttctccttctgtatccaggccaattttactcactggaaaaccacaaagaaatgtatttcttaacacggttattgaagtccttttgttccagcgttattttttaacgtg

SEQ ID NO: 89110 - DNA, 601 bp, Human
ctagcctggggtcaaagccaagcccattgtttgtttatttcctatggctgctctcatgcttctgttgcagagattagtagttctgacagaccatttgcctgcaaagcccaaaatatccttaacagatgaagtttgccagctcatgatctctaggaaagcctggatttcctcctcttcagcaatctaagataagatagttctacttcatgctctcatgggggtgtatgatcttacacctacagcagaggagtcaaatgacaagggtgtaagagcttgcggttgtactggacattcagggaasagagaggaagggagatgcaccttagaggtggggctgccctacaagtagacggtcagccttcccatccctcttgctccaagaatttttgcctatgtatcttctgaagcctacaattccataattagtttaagactaagtccccatttaaatgctaacacccctagaacaagtgccactttaaatccaagtccacaggcagcccaatcatgagtcagttctttacctgggagcaagctgggagagggaattcagagacagaagtagctcctgagaagggaaaggacagtcctcagtaagggg

SEQ ID NO: 89111 - DNA, 601 bp, Human
tataccactcatcctgatctcaccacccaagggccaaggcatatacccctctcctgggaccaccttagaggaaactctcagctgtcagcagttcatctgaccctggcctcccagctcagcagacactcaagcaattttagaaaggggtcagaaaactctagcctggggtcaaagccaagcccattgtttgtttatttcctatggctgctctcatgcttctgttgcagagattagtagttctgacagaccatttgcctgcaaagcccaaaatatccttaacagatgaagtttgccagctcaygatctctaggaaagcctggatttcctcctcttcagcaatctaagataagatagttctacttcatgctctcatgggggtgtatgatcttacacctacagcagaggagtcaaatgacaagggtgtaagagcttgcggttgtactggacattcagggaacagagaggaagggagatgcaccttagaggtggggctgccctacaagtagacggtcagccttcccatccctcttgctccaagaatttttgcctatgtatcttctgaagcctacaattccataattagtttaagactaagtcccca

SEQ ID NO: 89112 - DNA, 601 bp, Human
ccataaagagacctatttaaggtatactctctccctataccactcatcctgatctcaccacccaagggccaaggcatatacccctctcctgggaccaccttagaggaaactctcagctgtcagcagttcatctgaccctggcctcccagctcagcagacactcaagcaattttagaaaggggtcagaaaactctagcctggggtcaaagccaagcccattgtttgtttatttcctatggctgctctcatgcttctgttgcagagattagtagttctgacagaccatttgcctgcaaagccyaaaatatccttaacagatgaagtttgccagctcatgatctctaggaaagcctggatttcctcctcttcagcaatctaagataagatagttctacttcatgctctcatgggggtgtatgatcttacacctacagcagaggagtcaaatgacaagggtgtaagagcttgcggttgtactggacattcagggaacagagaggaagggagatgcaccttagaggtggggctgccctacaagtagacggtcagccttcccatccctcttgctccaagaatttttgcctatgtatcttctgaagcc

SEQ ID NO: 89113 - DNA, 601 bp, Human
tttcagaagccataaagagacctatttaaggtatactctctccctataccactcatcctgatctcaccacccaagggccaaggcatatacccctctcctgggaccaccttagaggaaactctcagctgtcagcagttcatctgaccctggcctcccagctcagcagacactcaagcaattttagaaaggggtcagaaaactctagcctggggtcaaagccaagcccattgtttgtttatttcctatggctgctctcatgcttctgttgcagagattagtagttctgacagaccatttgcckgcaaagcccaaaatatccttaacagatgaagtttgccagctcatgatctctaggaaagcctggatttcctcctcttcagcaatctaagataagatagttctacttcatgctctcatgggggtgtatgatcttacacctacagcagaggagtcaaatgacaagggtgtaagagcttgcggttgtactggacattcagggaacagagaggaagggagatgcaccttagaggtggggctgccctacaagtagacggtcagccttcccatccctcttgctccaagaatttttgcctatgtatct

SEQ ID NO: 89114 - DNA, 601 bp, Human
aggtccctcagcatccaatacttgtatctaaagtgggggacagtttgctaagactgagcccttaaagctgtggggtctgggttaattctgggtaatgtcaaaattaagttgtaggacacccagctgttatctggagcattggagaattggtcattgatatgaggaaaaaccccacctatttggtatcctgagtgttttacaggtagaaacaggtatcttaatagcaggcccaccatacaaaaactgttcatacctcttctggtcacttaatccaccctgccttatcacggttactgatgtmtatgttccccaccctaccccacctccagccccagctaggctgggaacttccagaagacaggaatggagttaaactcctcttcagtcccaacgccctgcaaagggcctggcacacaggtgctcctgggtaaacatctgccgaaccatattgaactgacttgttctcctgtgatgtgggaagcaatatggggggtggggcaagagaggcgtcagtcaatgcattaatacctgaaagccatgtccgagccgatgaacgcacatccactgaactaaggagtgcacaggctcaggattgccaagt

SEQ ID NO: 89115 - DNA, 601 bp, Human
ctggtggatcccaaagtggtaagggatgcagtcaaagcattctactcgcctttgtccttgagcgcttttggcaggatttctcttttgaggtttccacagggaaatagaagaggcagtgctgaggactcccctgtgaataaataaccaggctttgtgaaaactcagggccagtgcctgtgcacaggggaatggggaggggcagctttgggaagggggaagcagccctgggctccaggcctggctctgcttctaggactcagtttcagcatctgtaaacaggaagagcacctgctaccttgcygaacttgaagggttgttatatgaagatcataagaggtaatgtgtgtggaggtgctcagaaaatgaacatccacacaaacaagttagccacattcttttaactccttctgatcctgaagtgactccctagcctgcagtcactatttagaaggcagactttgcaccttaactaagtcaggaaggtgaagatcaggcctggtgctgactggcactggggcaaacattttctacctttaaagaggctccagatgagccagggctcatgctcaggaggcagccggtaaccggcagccaggagtgg

SEQ ID NO: 89116 - DNA, 601 bp, Human
ctgcatcgaggacggcagcatgcttcagaggcaagaactggtttctaggtgctgacagtcttgggagccacggcaggtggagctggaggggcaggtggagcttgtgtggctcggctggagggtgctgcatgctattataagatcggctacatttgtagactttcttctacatgtggaaccaattctatggtttgtcacctcagttatctgcccaggggccacctccacatctcgatctcctgtcctcttggtgaaggactggagacacactgtgtgctcctagcttgagctaacaagctgrgaagagtggatccaaagaaaggaaagtgcagactgcacgtccactcttcccatgagcatggtctctgtgtctcctggcctggcttatccaacccagccctgctctcccttgtgtgctctctgcagggccacccacttctatcactgcaaaggctcctggtggatcccaaagtggtaagggatgcagtcaaagcattctactcgcctttgtccttgagcgcttttggcaggatttctcttttgaggtttccacagggaaatagaagaggcagtgctgaggactcccctgtgaataaataac

SEQ ID NO: 89117 - DNA, 601 bp, Human
gaaagctggtactccaaaccactgatagactttgctcccagactaactatgtgacagcaaaaggtgcgcaggtgacagctaagacatctgcatcgaggacggcagcatgcttcagaggcaagaactggtttctaggtgctgacagtcttgggagccacggcaggtggagctggaggggcaggtggagcttgtgtggctcggctggagggtgctgcatgctattataagatcggctacatttgtagactttcttctacatgtggaaccaattctatggtttgtcacctcagttatctgcccaggggccacctccacatctcgatctcctgtcctcttggtgaaggactggagacacactgtgtgctcctagcttgagctaacaagctgggaagagtggatccaaagaaaggaaagtgcagactgcacgtccactcttcccatgagcatggtctctgtgtctcctggcctggcttatccaacccagccctgctctcccttgtgtgctctctgcagggccacccacttctatcactgcaaaggctcctggtggatcccaaagtggtaagggatgcagtcaaagcattctactcgcctttgtcct

SEQ ID NO: 89118 - DNA, 601 bp, Human
tcctgtggaagaggaggctgagacggcagaaaaagaacaaaggcccagaaaccaaagccttcatttgtacccagaatgccttttgttcccaggcttatgtaggtttgtccacacaaggccgtccctagtcactccatggatcccacacagactggttgcatgacaccagcaagtgtaggaagggcagctcttgggagaggcctggagtccagatccccggctgcactccagctgtgcctccacatggccacgcgtcccctctctgggcctcagtgtgtccacttgtacaagaactgattargccgtggactttcccacattcctccctgtgccattcagcgactctgaatattcccaggggttttcagggctggtgatgaggcgctaggcactgaagggactcacgcaatttcagtcagatattgacttatgaggggcagccagatggtaggtgaaaagtagtgaaaactcaggcttctgaaaataaaatgggaaactctctcagaagaaatgataacttcagcataaaacagcaacctattgccatttcatatccctgaaaactaaagaaataaactgaagtatcaaacctctgatttat

SEQ ID NO: 89119 - DNA, 601 bp, Human
acttaccacttcctcaaagtcaccacattaatctctccaaagagggagatttcatagaccacctactacaagcacctcttaccgaaatcactgatttcaaaccagcttgcaatagacatttcatgaaacaaccacaaaattgtttccattcctaattctagaatcccagaccaactatgtgacaggaaaaggcatgcaggtgacagctggggacagtgaaaccacatatagaaccaacatctatcagctcgtgcccttcaccctctgcttccccacctgggcacccaccctgccagaaccrcccccaaacgccacgtacctgctgggaatagtagctgttcaggttcccttggattcctgggtgtgcaactgtctgatacacagttatgctttccatggcaatccctgggcacaatcaaaagcaggaaagactttaccgcactgggcacacaatggggcctccaccacttcacagcacagttggtgaaacctcccaatacagcaccaccctcctggaacgagctgcttggaagctgagaggccagactcagcagagaggccttgaacagtcctctgcagcctgctaaacgctgtggagtgg

SEQ ID NO: 89120 - DNA, 601 bp, Human
gctttgcgtaaattatctcctttaacccctataaaaacttaccacttcctcaaagtcaccacattaatctctccaaagagggagatttcatagaccacctactacaagcacctcttaccgaaatcactgatttcaaaccagcttgcaatagacatttcatgaaacaaccacaaaattgtttccattcctaattctagaatcccagaccaactatgtgacaggaaaaggcatgcaggtgacagctggggacagtgaaaccacatatagaaccaacatctatcagctcgtgcccttcaccctstgcttccccacctgggcacccaccctgccagaaccgcccccaaacgccacgtacctgctgggaatagtagctgttcaggttcccttggattcctgggtgtgcaactgtctgatacacagttatgctttccatggcaatccctgggcacaatcaaaagcaggaaagactttaccgcactgggcacacaatggggcctccaccacttcacagcacagttggtgaaacctcccaatacagcaccaccctcctggaacgagctgcttggaagctgagaggccagactcagcagagaggccttga

SEQ ID NO: 89121 - DNA, 601 bp, Human
tgatgaatagcaatgataacatcaaggccactatttacctcagggttgtatgtatcttcgatgctgtacaaaaagctttgcgtaaattatctcctttaacccctataaaaacttaccacttcctcaaagtcaccacattaatctctccaaagagggagatttcatagaccacctactacaagcacctcttaccgaaatcactgatttcaaaccagcttgcaatagacatttcatgaaacaaccacaaaattgtttccattcctaattctagaatcccagaccaactatgtgacaggaaaasgcatgcaggtgacagctggggacagtgaaaccacatatagaaccaacatctatcagctcgtgcccttcaccctctgcttccccacctgggcacccaccctgccagaaccgcccccaaacgccacgtacctgctgggaatagtagctgttcaggttcccttggattcctgggtgtgcaactgtctgatacacagttatgctttccatggcaatccctgggcacaatcaaaagcaggaaagactttaccgcactgggcacacaatggggcctccaccacttcacagcacagttggtgaaacc

SEQ ID NO: 89122 - DNA, 601 bp, Human
agagcaagcagacaagcctgcctggcctttttgcatttggtttgtcctatcaggccctcccaataccaggcaagacattcagaagcttgccctgggagaggaaagggaggtgttttactgcatataaatgctgaagacatcaaggaactcaagcaagagctatccattctcctgcctgagtcctccaacagtccccacggactcccaaattcaatccagactccttggtggccactgtcagctcttcccactatgggctcagcctccctctccagtgtctgcccctccagctccaccagcrtccccgtatgatgaatagcaatgataacatcaaggccactatttacctcagggttgtatgtatcttcgatgctgtacaaaaagctttgcgtaaattatctcctttaacccctataaaaacttaccacttcctcaaagtcaccacattaatctctccaaagagggagatttcatagaccacctactacaagcacctcttaccgaaatcactgatttcaaaccagcttgcaatagacatttcatgaaacaaccacaaaattgtttccattcctaattctagaatcccagaccaactatgtga

SEQ ID NO: 89123 - DNA, 601 bp, Human
ctccctgtcaatgctccctccctctggaagcagagcaagcagacaagcctgcctggcctttttgcatttggtttgtcctatcaggccctcccaataccaggcaagacattcagaagcttgccctgggagaggaaagggaggtgttttactgcatataaatgctgaagacatcaaggaactcaagcaagagctatccattctcctgcctgagtcctccaacagtccccacggactcccaaattcaatccagactccttggtggccactgtcagctcttcccactatgggctcagcctccctytccagtgtctgcccctccagctccaccagcatccccgtatgatgaatagcaatgataacatcaaggccactatttacctcagggttgtatgtatcttcgatgctgtacaaaaagctttgcgtaaattatctcctttaacccctataaaaacttaccacttcctcaaagtcaccacattaatctctccaaagagggagatttcatagaccacctactacaagcacctcttaccgaaatcactgatttcaaaccagcttgcaatagacatttcatgaaacaaccacaaaattgtttccattc

SEQ ID NO: 89124 - DNA, 601 bp, Human
caggagtggttcccggctgatgctggcatcctctgctccagtgaggcaggattctggtagggaactgttggaaagagcaggctgccatcagaaagctggtgctgccccaggtctgtgtctgcctggccagaggacatgggcatcccggagctcatgtgcccagcagcctagacaatgcctctagctcctgtggtcatacggcactgatcacatgaggcagtggtgtgaggcagtgctggctccctgtcaatgctccctccctctggaagcagagcaagcagacaagcctgcctggcctttytgcatttggtttgtcctatcaggccctcccaataccaggcaagacattcagaagcttgccctgggagaggaaagggaggtgttttactgcatataaatgctgaagacatcaaggaactcaagcaagagctatccattctcctgcctgagtcctccaacagtccccacggactcccaaattcaatccagactccttggtggccactgtcagctcttcccactatgggctcagcctccctctccagtgtctgcccctccagctccaccagcatccccgtatgatgaatagcaatgataacat

SEQ ID NO: 89125 - DNA, 601 bp, Human
tacggagtttcactcttgtcacccaggctggagtgccgtggcgcgatctcggctcactgcaacctcagtctccagggttcaagcgattctcctgtctcagcctcccatgtagctgggattataggcgcatgccaccatgcccagctaatttttatatttttagtaaagacggggttttcatcatattggacaggctggtctggaacacctgacctcaggtgatccgcctgaggcctcccaaagtgctgggattccaggtgggagccacagcgcccggcctctctctaatctttctaaccayaagattcagatattgtttttcttcctcggtgacctgtgtgagtcctgggccttctaggaactcaaaacatgactttggcaagttgtttcacctctctagccctcagtgtcctcacctgtaatgaggaacactgacctctttttctggatacccaccactggactggtgtgagaattgtatcagttactgcccagaagtgcatcaactgctcagcagctcctgagaccatggcaaggcatcaccatggctgacaatgtggaatcagtcttcccaggttcaactgcagctcttccttctcag

SEQ ID NO: 89126 - DNA, 601 bp, Human
ccctacctcacacaacacacaaaaatcaattcaaaacagatcaaatacctaagttcagagctaaaactacacaactcgtagaaggaaacataggagtaaatcttcaaaacactgaattaaagcaacactaaattaatggtttcttggatacaacacccgaagcacaagaaacaaaagaaaaaaacaataaattgaactttatcaaaaaagtaaaaagacaactcgcagaatgggagaaaatttttacaaatcgtatgtctgataaaaagtttgtatttagaggccaggcatggtagctcaygcctgtaatcccagtactttgggaggccgaggtgggcagatcacctgaggtcaggagttcgagaccagcctggccaacatggtgaaaccccctctgtactaaaaatgcatatagtaatcccagctacttgggaggctgaggcaggagaattgcttgaacccgggaggcggaggttgcagtgagctgagatcgtgccactgcactccaacctgggcaacgagagcaaaactccatctcaaaaaaaaaaaaaaatgtattcagaggccaggcgccgtggctcatgcctgtaataccaacact

SEQ ID NO: 89127 - DNA, 601 bp, Human
agcaccacaggctcgatggttctgtgcagagcctcgcctgggatggagcactgcttctgtcccggctctgccccctgctagctgttattagtgcaagtcccttagcctctctgatcctcacctataaaaggggcacagttaccctggcctcagagggctagtgtgggggttaaatgagagaaggtcctcatcccccactctcctctgcattgagactgtggaccccaaacctgtttgggagcaagtgagcatccaacattggcagcccctgcccagcactccgcttcatcctccctcccascaagtgagcagcaggccaggtggtagtggaggtaacaagccacctgtacctctgcataacctcggatgctgcgggactgaggctccttcctccggctgagtcagaacgaggggagggaggccactgtcctgcagaggccccgctcccaccccgcccacagtactgccttgctaagcacccattgcttaggaaactccctgaggaaaaaataaagttggacccctacctcacacaacacacaaaaatcaattcaaaacagatcaaatacctaagttcagagctaaaactacacaactcgta

SEQ ID NO: 89128 - DNA, 601 bp, Human
ccacgctctcatcagtctgccaccctgagcgactgtcgccaggctcaggtgaggggcagggacttgaaggccccaggctggtgctcaccatcacggctgtgtcagtgcagtccttcctcagaggctctagctgcagacagttcttcttcgggtgttgggggccctgggtctgatcaaggggaggatggtgtggcaggggcagtgactgaatccccaagaaagtagagccatcaaggtcagggctctgtgggcacagggttgggatttaaatcccagctccacaggacaatgaccttggccsgtggcccatcctctctggcctccatctcctcatctgtcaaaccgaaaagataacaggactcttcactgggctgctgtggggatcaaatgaggtgacaggtgtgaaccacttggcctggcccagagataagctcaatgaccgtcatgggctgctgcctatgttgtcgtgatacttccaatcagccaatccggggcactggcctcatccacaggacatctctctctgaacaagcaccacaggctcgatggttctgtgcagagcctcgcctgggatggagcactgcttctgtcccggctctgc

SEQ ID NO: 89129 - DNA, 601 bp, Human
atgataaagcagtggaaattgaagagctaacatatatcatcaaacaggtgagctactagccatcaggagagcccagcattccaatcagatcacttctgtcttcctgtcattttccattgccatggggacccagagcaagtttctttttttagagaggggggtctcactgtgttgaccagtctggagtgtagtggtgtgacctagctcactgcagcccttaactcctggcctcaagctttcctccagcctgagcctcctgagtggtagagactacagggacatgccctcattcctggataattttttttttttttttttttttgaggcagagttttgctctttcacccaggccggagtgcagtggtgcgatcttggctcactgcaacctccacctcccaggtgcaagcgattctcctgcctcagcctccccagtagctgggactataggcacccgctaccaatgactggctaattgttttatctttagtagagacggggtatgccaggctggtctcgaactcctgacctcaagtgagccgcccaccttggcctcccaaagtgctgggattacaggtgtgagccactgcactcgactgtaata

SEQ ID NO: 89130 - DNA, 601 bp, Human
aggatgatgtgttaagaaagtaatggatgggtacggtggcttacacctgtaattccagcactttgggaggcccacacagtcagttgaactcaggagttcaagaccagcctgggcaacatggtgaaaccccatctctacaaaaataaaaaaattagctggacatggttgcgtgtgcctgtggttccagctactcgggaggctgaggcgggaggatgacttaagcatgggaggttgaggctgcagtgagccatgatggaaccactgcgctccagtctgagtgacagagcaagaccccatctcaaaaaaaaaaaagaaagtgactaagtaggtatatcagattgtgtggtagggaatgctgctctgaagacatgacatttaagcagagacttgaatgacaagagggatccaaccaggcaaagaacagagagtgttctaggccgaggagacagctagagcaaagccttgtgatgggacagtctcaccatagcaagaatcaagaaggcctgcgtggctagaaagtaatgaacagggatagagaagtacagggtgtactggagggatgtaggcagaggcccaacaatgggctggcctctctgttcct

SEQ ID NO: 89131 - DNA, 601 bp, Human
ctgctgtgcccatctatcagcaggctccgggctgaagattgcttctcttctctcctccaaggtaaactcaggagctatgaagtgtgggcatcaagctgccaccctctgccaggctgcctgtctgcctgtaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcarcgatctgtggccttaacactgtcacctcttggagccttaattacttcctctgtaaaaggaaagttaagttgcctttgctgctcaaaggactggatgattttagaatcccctttattataggatccaatgtgacagtgagttcatctttaaggatagatgaagccatctggagtggttgttaaaaatgtgggcttggtggccaggcgtggtggttcacgcctgtaatcccagcactttgggaggccgagacccacggatcacgaggtcaggagatcgagaccatcctggctaacacagtga

SEQ ID NO: 89132 - DNA, 601 bp, Human
gggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagttaagttgcctttgctgctcaaaggactggatgattttagaatcccctttattataggatccaatgtgacagtgagttcatctttaaggatagatgaagccatctggagtggttgttaaaaatgtgggcttggtggccrggcgtggtggttcacgcctgtaatcccagcactttgggaggccgagacccacggatcacgaggtcaggagatcgagaccatcctggctaacacagtgaaaccctgtctctactaaaaatacaaaaaaaattagccgggcttggtggtgggcgcctgtagtctcagctactcgggaggctgaggcaggcaggagaatggcatgaacctgggaggtggagcttgcagtgagatgagattgcgccactgcactccagcctgggcgacagagaaagactccatctcaaaaaaaaaaaaaaaaaa

SEQ ID NO: 89133 - DNA, 601 bp, Human; identical to SEQ ID NO: 89131

SEQ ID NO: 89134 - DNA, 601 bp, Human; identical to SEQ ID NO: 89132

SEQ ID NO: 89135 - DNA, 601 bp, Human; identical to SEQ ID NO: 89131

SEQ ID NO: 89136 - DNA, 601 bp, Human; identical to SEQ ID NO: 89132

SEQ ID NO: 89137 - DNA, 601 bp, Human
ttttttttctcctttgtttcaagttttaatcaaagcttgtatataagattattcctgcatcttctcaattgtttcttccttgtatttgcccttttcctttcctacttggcgagatttggctttccgttcaaggatctttttgctgtctttgtccagttttagcctagtgataaccaccttgctggagtgaatgcctacgtggacagttgtgccattagccttttcccgctgcacccattcaatgtagataacatatttcttcctgtaaacctggaccactttgccaatttgctgaccttcrtagtgtcctcgtacaacctgaacttcatcgtcctttcggatgggcatggatcgctcgttgtacttctgtctcagctctttggaaagaagggaagacataatcttccttcgaatgtgggaaggtgcgttgaaatgccttttgcgattcttgcttcggtcggaagtcacaaagggattaaacttcattttggccgctcccgcttcggtgatcgatcttcttttcttttcttgcaggcttcacattccttttgactgtggcatcttctcacttgctgtccctatgccagaatgttgtcccttc

SEQ ID NO: 89138 - DNA, 601 bp, Human
atatcctaaaactttaataaagtcctactgatggatggactagtttcccagagttgtctcttaccaactctttactctcggagctctagtcataaggctcttcttttttttctcctttgtttcaagttttaatcaaagcttgtatataagattattcctgcatcttctcaattgtttcttccttgtatttgcccttttcctttcctacttggcgagatttggctttccgttcaaggatctttttgctgtctttgtccagttttagcctagtgataaccaccttgctggagtgaatgcctaygtggacagttgtgccattagccttttcccgctgcacccattcaatgtagataacatatttcttcctgtaaacctggaccactttgccaatttgctgaccttcatagtgtcctcgtacaacctgaacttcatcgtcctttcggatgggcatggatcgctcgttgtacttctgtctcagctctttggaaagaagggaagacataatcttccttcgaatgtgggaaggtgcgttgaaatgccttttgcgattcttgcttcggtcggaagtcacaaagggattaaacttcattttggccgctcc

SEQ ID NO: 89139 - DNA, 601 bp, Human
atccttcctgatggtctcttcccttcaattttcccccactcccaattgtatctatccccctcactgtagtcagggtgtttgaaaaatatgtcagactgtgttcttccttagcttttaaggtttcctgttatttcttgaggtatatcctaaaactttaataaagtcctactgatggatggactagtttcccagagttgtctcttaccaactctttactctcggagctctagtcataaggctcttcttttttttctcctttgtttcaagttttaatcaaagcttgtatataagattattcctscatcttctcaattgtttcttccttgtatttgcccttttcctttcctacttggcgagatttggctttccgttcaaggatctttttgctgtctttgtccagttttagcctagtgataaccaccttgctggagtgaatgcctacgtggacagttgtgccattagccttttcccgctgcacccattcaatgtagataacatatttcttcctgtaaacctggaccactttgccaatttgctgaccttcatagtgtcctcgtacaacctgaacttcatcgtcctttcggatgggcatggatcgctc

SEQ ID NO: 89140 - DNA, 601 bp, Human
atttaatacaggtaggttgttttctttggtgtctgtttctctcaagaatattaatgtttatgggttctgttatatttattttggatttgcatttatgaaattatttcattgcaaagattgtttctgaacaatagctaaggtttgctttcccaatatcgcaggtttgattttctgtcattcatttgtcatcatttaaaaatcttattgttattttttaaagtttccttattgtcattaaaaaaaactgcacctaagtttatttggataagtatagcactaagtctaatcagtgacatttaaktttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaacttatttctcctctgtaactgaaatgtattcttagaccaacatctccccaattgcc

SEQ ID NO: 89141 - DNA, 601 bp, Human
ttgtcattaaaaaaaactgcacctaagtttatttggataagtatagcactaagtctaatcagtgacatttaagtttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtrcaaaagatctctcgaacttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtcc

SEQ ID NO: 89142 - DNA, 601 bp, Human
tgcacctaagtttatttggataagtatagcactaagtctaatcagtgacatttaagtttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaayttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtccattcatccactgataag

SEQ ID NO: 89143 - DNA, 601 bp, Human
tatccaaaaagttattgtcaagaccatgtcataaaatttttatcctgcattttattctagattcataattttgaatcttatatttaaatctttaattcattttagttgatttttgtacatgttgtgagatagagtatagtttcattcttatgcatgtggatatccagttttcccaacaccatttactaaagaggctgttctttctccattgtgggttcttggctcttttgttgaaagtgagttggcagtaaatgtatggatttctttctgggttctctttctgtttcatcgtctatgtgtstgtttttatgcttgtaccatgctgttttgattactatagctctatagtataaaactataactctgtactatatttcgaagtcaggtagtgtgttacctccagcaatgttctttttgctcaagattactttggctatttagggatttgtgtggttccatacaaatttttattttgtgaagaatgtaattggtattttgtagtgtctttgtctggcatttctatcagggcttttctggctttgtaaaatgagtttggaagtattccttcttccatttttggaagagtttgagaagaaacggt

SEQ ID NO: 89144 - DNA, 601 bp, Human
ccatgctgtcttcccttgtggctaaatgatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaattkttttgccttttagccttcatactgaagttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagttt

SEQ ID NO: 89145 - DNA, 601 bp, Human
gatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaatttttttgccttttagccttcatactgaakttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagtttttttcttcagcatgttttataatattc

SEQ ID NO: 89146 - DNA, 601 bp, Human
tgacgggtggtttttttgttttgtttcattttttatttatttattattattattattattattattattagagacagagtttcactcttgttacccaggctggaatgcaatggcgtgatctcagctcactgcaacctccatctcctgggttcaagcgattcttctgcctcagcctcccaagtagctgggattacaggcatacaccaccacgcctggctaattttttgtatttttagtagagacgggatttctccatgttggtcaggctggtctcgaactcccgacctcaggtgatctgccygccttggcctcccaaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttca

SEQ ID NO: 89147 - DNA, 601 bp, Human
tagaaagtcaaatagccagaacttgactcttagtccagaataagagcaagtggattaggaatagttgtataatttatgcagaaatgttattggatagacagtttaattcagaaattaaaaatacaagctctagccatagactacaagagttcaaaccctagctccactgcatactggctttgtgaccttgggcatcttaattaatttttctgactatcagtttcctcctatataaaatggggatgaaaataatactcccatcatagggttgtttggtaaaggtgtcaatgcatgtgaagtygttagcagagtgtctggcactgaataagcgctctataaatggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccatttttttttttttttggtcctataattttactttctctctccttcatt

SEQ ID NO: 89148 - DNA, 601 bp, Human
ggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccatttttttttttttttggtcctataattttactttctctctccttcattccctttagcctacacacatgctcaagattcacatatctgawaatgcctagcaaaattccatacatcgtaggttcttaaggataccagttttctacctttatgctctaaaaatttcttcccctactttacctctcccatcaagctatcattctgtctcctcccttcacatctctaccatacttatttaaaaacgtaatctggaccctgacatctgttttatcaactcccattaccaactcaattcctttcactctaatttccatcctttgcatactattaaaattgtttttactaaagtccccagatacttcccgatgtacaattacgagggttattacaaa

SEQ ID NO: 89149 - DNA, 601 bp, Human
catgctttttagtattacatagtttcaagcatttgattatttcattgtgtcttattgtatagttgcatctgaagatttttgtactgaaatagaattttttaaataaattactgtcatttctccattatattatagttgacaaattttattaattttaaaattatgtaggtaggtatgttatattcttatttacactttgagacagaaaaaaaggaatattataaaatatttgttatgaactggggtaatactgattttaaaaaacaaatgtgcagtaggactctatcaacattctctattyaaggtggaatgctaacaaaagtacattctactgatgctacatttcaggaaggctgtttatatgtctccttggattttgttttataaactagtgttgagggatttttataaacttccaaagcacaggtaatacagagtaacagtaagcacaaaaagccaccaagtaaattaaaatcgcaactaagtttctaaactttattcagctacattccattagcatttcaaagatattaagaaaacacacctgaggaaaatgaggggcttgaacaagattttggacctatatccaaaataattcagg

SEQ ID NO: 89150 - DNA, 601 bp, Human
ttcttagtaagaaaatataaaataacaatgaaatggatttttaaagctctcttctagatttgttcaactatatacccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtytgagccctcatctatattgtaagagtctcttaggaggtgttcccacaacgattttccatttatggccagcccatcgtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagata

SEQ ID NO: 89151 - DNA, 601 bp, Human
ccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtctgagccctcatctatattgtaagagtctcttaggaggtgttcccacaacgattttccatttatggccagcccatygtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagatacgtgcttccatttcctgttgttttaccttagtctgtggtgttctcccatctgaaatgacattacccccatctctg

SEQ ID NO: 89152 - DNA, 601 bp, Human
tatagaggagtagaaagtctcaaagatgttatgcagaatacattttagtacagggtttaataaagtacatattaaagtgagatacaagtgagctaagatcaaaggaaatagaacttgtatgggaatgacagaaaaggagttaagaaagagataacctctagactgtgccttgaaccaaagaaggatttgcataaccagagagttggtaaaaagtcattccacactgaatgaggtatcatcagagttttgtggttaacagtgaggttggtgtgattgcttggtgtacaatatattgtatatmctacaacttactgtaggatacatttagtggtatggctggaagagaaagcatgtgaccccgttttctaagaacttttaatgccatcctaagcaggttttatgctgcaaactctaatcctttgtgggctttaaggaacaaagtatgacccaacttttttttctttttggaccattaaagaaatagctagacatataagcatccaggcatggcaaatgcttcagatatatcacagaagattatgcctgaaaagagggccagtggatttagagctctttgttgaccttggaaagccttgtttca

SEQ ID NO: 89153 - DNA, 601 bp, Human
cagcctaacagtgtcctctgctcggtgtctcgcaaggctgccatcaaaatgtcaactagaccacagaagagggagtccaggcttttttccaagctctttcagactttttggcagaaattctgttccttgaaattacaggactgagaccctcagttcctaaagatgactctgccatatgcagtttacaacatgactgcttcttcaaggccagtggaacatctctctcacctcaggaagggcctagtcatgctttaagggcttgcaactgggctcacccaggacagtctcccttttgatgaaytgaaatacaacctatttgggaatttaattacatctgcaaaatcctttcacctttgccacatagcacaatccattacagtcacggatctttcccatactcaaagagaaggcttacatagggcatgtatgcaggagagggtagagtcttgaaaaccatcttattaatagaattctgcttaccaaagatttggaaagagaatgaatgtatgacagagaacaaaagaattgttactttatgaaaaggcaatagattaccttttatctaaatagtgtcaattggcactactctattttttacaaa

SEQ ID NO: 89154 - DNA, 601 bp, Human
taaaaaatgtagaggagaatattttatttaaaaaagaaagggctgggcacaatggctcacacgtgtaatcccaacactttaggaggccacagcaggaggatagcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgarcaacagagtgaaaccctgtctcaaaacaaaaacaaaaacaaatggtaagtaaaattctgagattctagaaaaaagcgattcgtttactgaggaatgatttgtactggcaacttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtattttta

SEQ ID NO: 89155 - DNA, 601 bp, Human
gcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgagcaacagagtgaaaccctgtctcaaaacaaaaacaaaaacaaatggtaagtaaaattctgagattctagaaaaaagcgattcgtttactgaggaatgatttgyactggcaacttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtatttttagtacagatggggtttcgccatgttggccaggctggtctcgaactcctggcctcaggtgatcctcccaaagtgctgggattacaggcatgagccaccatgtcc

SEQ ID NO: 89156 - DNA, 601 bp, Human
aaaaattcatgtttttataaagcataggaaaatgactaagtacaaaataattggtgttggtgaaaacagaaaaaaaatgtatctgcattaagaaattagaaatgtattttttaaactcaaaagtagataatgtgtgctgtgggtcgaatcatgtgccccatactgtatgttcaagtcctaacccttggtacctatctgcaaatgtgacttctttagaaatagatcactttttttttgaagatcgaatcaagttaaggtgaggtcataccgaagtaatgccttagaagagaagagaccagcrtccttagaagagaagagagatacacagggagaacgccatgtggcaatggaggcagagattagagtgatacatctataagcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctg

SEQ ID NO: 89157 - DNA, 601 bp, Human
gcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcgatgactttaccatctctgcccaggatcattgtcacccaccrctcctgaaggagagaatgtcccttaacaagaagagggttatagagcggcttgggaagctagacttcatctacttatcatcttctcttgggctagttatgtctactttcgattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatattttttt

SEQ ID NO: 89158 - DNA, 601 bp, Human
ttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcgatgactttaccatctctgcccaggatcattgtcacccaccactcctgaaggagagaatgtcccttaacaagaagagggttatagagcggcttgggaagctagacttcatctacttatcatcttctcttgggctagttatgtctactttsgattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatatttttttaaatcatggcttctacacagaggtaaaacaatttcagaaattgaagatcagaaattgaagatagagagatttattaaccaagattattcaactgccaagtagcagggc

SEQ ID NO: 89159 - DNA, 601 bp, Human
tggctggagaagcctcacaatcatggcagaagatgaaggaggagaagaggcacatcttacatggcagcaggcaagagagcatgtgcaggggagctgccctttataaaaccatcagatcttgtgagacttatacactatcatgagaacagcaggggaaaaccagcccccatgattcaattacctcccatcgggtccctcccacaacatgtggggattatgggagctacaattcaagatgagatttgagtggggacacagtcgaaccatatcaaatagtctccaaaatgttcccattttatcrttttttcatgtttgttttctttatgacttgttaaatagaatttcttaaattgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcga

SEQ ID NO: 89160 - DNA, 601 bp, Human
ttgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaamctaaagtcactccagagtggcagagttgtcactttaaagataggccttaatgtaatgctaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggagggaaggaa

SEQ ID NO: 89161 - DNA, 601 bp, Human
cagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaacctaaagtcactccagagtggcagagttgtcactttaaagataggccttaatgtaatgytaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggagggaaggaaatacaggatgggggtggctaaattatacctaataaagcttagaatgtgatataaattt

SEQ ID NO: 89162 - DNA, 601 bp, Human
tctctaaacctaaagtcactccagagtggcagagttgtcactttaaagataggccttaatgtaatgctaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggarggaaggaaatacaggatgggggtggctaaattatacctaataaagcttagaatgtgatataaattttatgacatgaaaagcataatcctgtatactctatcataaagtaaaagaaagttgttatatattttacccagtttcataatgaactcttacaccacattttcaattgtgttaaaacaattgatcaattcaccttgattccattctgggcactttaacgtactgcatcgaaagacttcatactgataattattagtgttctcttttcctggccaaaaattaagatgctttaattaa

SEQ ID NO: 89163 - DNA, 601 bp, Human
tatgagcaatgagttttctggccgaaggaatgactctgaaattgccatacctctgtgtagaagcaagccatgctttaaaaaatgacactttggtctttgcttgaaaactcaaacataaataaataacttctaacctggctttgacttcataagaacttcattattgccgggcgcggtggctcacgcctgtaatcccagcactttggaaggccgaggcgggcggatcacgaggtgaggagatcctgaccatcctggctaacacacggtgaaaccccgtctctacaaaaaaaaaaaaaaaaaattagccaggcatgttagcgggcgcctgtagtcccagctactcgggagtttgaggcaggagaatggcgagaacccgggaagcggagctgcaatgagcccagatggcgccactgcactccagcctgggcacagagcgagactccgtcaacaaaaaaaaaaaaaaaaaaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaata

SEQ ID NO: 89164 - DNA, 601 bp, Human
gaacccgggaagcggagctgcaatgagcccagatggcgccactgcactccagcctgggcacagagcgagactccgtcaacaaaaaaaaaaaaaaaaaaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaataattatgcaattttgttaattctgagaccaaagcaagctgttctggggagcaactcaggggaaatccctyaaactagcttctatcactgtctaattaaattcaacatgatttcttatagatcatgtagtaggataaatataggtgagataccaaatgaacataatacatgattccttcagttctagaaatgtttaacagagtagtttaagaggatttcatgaaaagtaaaaagaatatataacagtagactaacactttttttttttcaggaaagggaaccacatgagcaaatagatgtggcctgagcagggcataattgagatacgtggaaagatcagtttggttgcagaaaatcagcccctgcaccat

SEQ ID NO: 89165 - DNA, 601 bp, Human
cttcctcatgagagaaacaatttatgggaaattattaagaactccaggattattagcatcccacctgcaattgagaaaggtaaaaacatatattcccttaatacatggtagattgtttagcaaccacctacacattggccgtggatctctaaacatttaatgagtgcctgctgtgtactaaacaaccttctagagtacacaacaatggcagtggaagacatttacaatacaatagatgctttcagcacacaaacatagatactcaaaaggctcacagttataaaagaaaacaaaaaaaaaataagagttgaaaaacagcttccagagcagtatttcaaaaaccgcaggaagctatagtgaaaatctaggaagatgcacagtgaaggaacacaaagtatgaaagtaataagagccatcttggctgctgaaaatatttctcttaagaaagaacatcttgaattacgtgttcagaaaatgaaggtcaataaagatcttattggttagaaaaaatagcgaagaatagtccgaataattaagtcaaattttaaagttaacttacacagaactaagcccatttgacccagttggcacagtccattta

SEQ ID NO: 89166 - DNA, 601 bp, Human
acagtaagattagattgattaaaataaaaatatattagaaaaaaactaggactcaacagacggagagattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggrgaggaatttggcagtggataggatgtaaatgagtaccaaagaagatggagaaggctaactttaccgaagactaaaatgagagtcaagaggaaatggtatgttcaacaaaatgcaaataggcaagaaaggcttgattctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaa

SEQ ID NO: 89167 - DNA, 601 bp, Human
agattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggagaggaatttggcagtggataggatgtaaatgagtaccaaagaagatggagaaggctaactttacygaagactaaaatgagagtcaagaggaaatggtatgttcaacaaaatgcaaataggcaagaaaggcttgattctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcaga

SEQ ID NO: 89168 - DNA, 601 bp, Human
tattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggagaggaatttggcagtggataggatgtaaatgagtaccaaagaagatggagaaggctaactttaccgaagactaaaatgagagtcaagaggaaatggtatgttcaacaaaatgcaaataggcaagaaaggcttgmttctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaa

SEQ ID NO: 89169 - DNA, 601 bp, Human
tgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaagcatatggctattccggcttagagttgttgaagggcaaccactatgcaaattattccctcttctctttacctctttcytttttttttttttttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggct

SEQ ID NO: 89170 - DNA, 601 bp, Human
tcatcttaattaatcttcatgcaattctataagatgaatattatcattatttccattttagagaaattaacttacccaaagttttaccaataatatgtatctaggaagatacaaaatctatctaaaagtggttgacaaaaaataccactgcataggtgaaaggaggattcaggacaagagttgaacatcccttttatagaagtccttccaggaaaaaaaggaacatggcttggtgtgtctgacttccagaatatgatacctcccagtaagaaaaagctcttatttcttgttcttactcacyctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattt

SEQ ID NO: 89171 - DNA, 601 bp, Human
agtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttargcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactca

SEQ ID NO: 89172 - DNA, 601 bp, Human
tgacttaaccccaagtgagtagaactcaggctgttagtgattgaggcctcaggcttggtaatttataaaatatactttgcttttctgttttatggaggaaaacctgcctacttccatgctttggaaaaactgattcaaaacgtgtctaatatgctgacttcaactaagtgtatagtaactgataaatatctcctaatggagttttattttttttttccaataacagtgttatggtagttgaatatatgtttttcttaacaagatagatgattgatagatagatagatagatagatagatagatatatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaata

SEQ ID NO: 89173 - DNA, 601 bp, Human
cttaaccccaagtgagtagaactcaggctgttagtgattgaggcctcaggcttggtaatttataaaatatactttgcttttctgttttatggaggaaaacctgcctacttccatgctttggaaaaactgattcaaaacgtgtctaatatgctgacttcaactaagtgtatagtaactgataaatatctcctaatggagttttattttttttttccaataacagtgttatggtagttgaatatatgtttttcttaacaagatagatgattgatagatagatagatagatagatagatagatgtatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataatt

SEQ ID NO: 89174 - DNA, 601 bp, Human
ttaaccccaagtgagtagaactcaggctgttagtgattgaggcctcaggcttggtaatttataaaatatactttgcttttctgttttatggaggaaaacctgcctacttccatgctttggaaaaactgattcaaaacgtgtctaatatgctgacttcaactaagtgtatagtaactgataaatatctcctaatggagttttattttttttttccaataacagtgttatggtagttgaatatatgtttttcttaacaagatagatgattgatagatagatagatagatagatagatagatakatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataattt

SEQ ID NO: 89175 - DNA, 601 bp, Human
actcacattataagattattgtacatattaaatgcattaatattaaaaatttagaacaatggctaatttattgttgacattcaataattttaaggattattatcatcatcatcatcatcatcaccatatttagtatacattcactgcaagtaacaggattcttaagcagaggtagtggtcattagtactgttcaaaaagtatttctgactgcgcctgcttaggggcacttggcagaattgcactttttttactctcttgtgggtagaattgtgtgattcattctgacagggaagttgtgartggaagtgatatgcttcacttctgggataagcatttgattgttgatatgagatcatccagacctcattcttctttcaggaacagaaaccagcaattttgcaggtgctcctgctccatcaacccaggtctctaagtgactgcaataaacagaagttctactgatccaccgtagacctgtagcatgagtgagaaataagcttttgtggtgttatacccctgagacttcggattgtttgtgacattactggtgcataatctaacttatcctgactaatacagccaccttacacaataacgcat

SEQ ID NO: 89176 - DNA, 601 bp, Human
atccataaatgtggtgtatgttctaactgttccaccaaaagccattgcccagtctctctctctctctctctctctctctctctctctctctcacctcagaaagcttcccaattctctgagacacaacaatattgaaattaggccaattaataatcctgcaatgacctctaagtgttcaagtgaaaggaagagtcttgtgtctttcactttaaatctaaagccaggaatgattaggcttagtgaggaaggcatgttgaaacccaagacaggctgaaagctagtcatctcgcacaacttagcmaagttgtgaacgtaaaggaaaagttcttgaaggaaaggtgctactccactgaacacacaaatcacaagaaagtgaaacagccttattgctgatgtggagaaagtttcagatagaaggtcaaactagctacaactacctaatttgatgcctaatccagagcaagatcctaactctcttcacaactctatgaaagctgagagaggtaagggagctgcagaaaaacagtttgaagttggttcatgaagtttaaggaaagaagttgcctccagaccatcaaagtgcaaggtgaagcaggaagtg

SEQ ID NO: 89177 - DNA, 601 bp, Human
tgaatatttttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtayttacacaatatgagaatattatattttacgcagggtatacccatgattcatctttaaattaacttcaggaaatctccaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaac

SEQ ID NO: 89178 - DNA, 601 bp, Human
tttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtatttacacartatgagaatattatattttacgcagggtatacccatgattcatctttaaattaacttcaggaaatctccaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcaga

SEQ ID NO: 89179 - DNA, 601 bp, Human
gtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtatttacacaatatgagaatattatattttacgcagggtatacccatgattcatctttaaattaacttcaggaaatctcmaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcagatattataataagacaataactcaatttcagacttgtaaacaaaggtgacattaatctattgaaatgtgg

SEQ ID NO: 89180 - DNA, 601 bp, Human
atattaactaaatctatttatcatcttgccagtggtactacagtgaggtcacacttttggtgcagaacaaaaagaagccaggaatctgttaacagcatcccattgtaacattgctgttttttgttttgttttgttttgttttgtttttgtttttgagacggagtctcgctctgtcgcccaggccggactgcggactgcagtggcgcaatctctgctcactgcaagctccgcctcccgggttcacgccattctcctgcctcagcctcccgagtagctgggactacaggcacccgccacaacscccggctgattttttgtatttttagtagagacagggtttcaccatgttagccaggatgatctcgatctcttgacctggtgatccgctcgcctcggcctcccaaagtgctgggattacaggcgtgagccaccgcgcgaataaaccgagaaagaaaagcatctgactattaacctcatatacttttggaaatggatgtttgtgtccacatcccctttgatatactgggttatggccttggcggtgaaaattccttactgtatatagtgggttaaaaaagtaggatgaatgctaacaaatgtt

SEQ ID NO: 89181 - DNA, 601 bp, Human
cctcatatacttttggaaatggatgtttgtgtccacatcccctttgatatactgggttatggccttggcggtgaaaattccttactgtatatagtgggttaaaaaagtaggatgaatgctaacaaatgttttaggatgtatcacaacatctgaattctcccttctgatgcttagcattttatttcacaaaaggcaaggttactaaaagaagaaaaaaaatcaactgtttagatgaagaagcaaaattaattagtaaatataaaaagtgattatttgagttttgctatgacaataaacaagatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaactgagagttcttccaaggatagagtgtg

SEQ ID NO: 89182 - DNA, 601 bp, Human
tttgagttttgctatgacaataaacaagatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaactgagagttcttccaaggatagagtgtgtaaatgctgacctacattaaatacaagtgacatggatttctgggcatgtgggacgccttggtaatttgagtgacaaatcacatatggtgcgtttactactcttttgtggctttaaagttaggtgattttgactctaaagcatgaaagttcaaagagctgttaagatttctctgtgatgtatgcaagggttttcttaggaataaaaagtctaaaaaattcccaagaagacacttatgtgtaataaaagcataaagaaatgtacaggaataaaa

SEQ ID NO: 89183 - DNA, 601 bp, Human
aaattctgttgtgttctagtattactgtctttctgaactaagactgtcttgtgctttggttgataggaagcagtgagggtcctgcctttcccaggtttgaactttctcaggtggttgagatcttccttgcagctcctaaatttcattatatttttctctactccacaatccccatccagtaataaaaatctattcaaaagttgaaattaggaattcttccatttacatctaagcgttagattatttttctaaggaaaaaattaagattctgtttttacagaaatctcatatttttttttttagtagacttgggtctcaagccattctgttaaaaggggaaaggagtaatatcattatattaaaatatccaaccatatcatgagatcaaaggataaaaacatcttgaggatcatttggtgagtccgtctacctgcagaaatcctgcatgtctgcatcactgtgaacagctcagtatggctcaggggtcacctcgctgttggaacttcagtggtctcacatagtccctaaatccaagccactgtcattgttcttgggggttgtaaaggccattaagtgctcagtagtcttataaaaacatgca

SEQ ID NO: 89184 - DNA, 601 bp, Human
catctgctgttgtaaaatctttggtgttgattggtgtggactgagatgaggaccagagccaagatcactttttacaagaaatattatacaattctgccccttgtccaactctataaattactagaagtttctggaagtgtgtacatcttcaagctcatcttaatcatttccacatttgtattcttgagattatacctgagattctcatccacacaatccttaattaaagcagctgactcgcttctcacaatataggaaaatgggggtgccaactgctttctctgccaacttctgagtactrttgaagctgaactagctcctcaacgcttcttctccaggaaatgtactgcaactctcatgctatttagcaccttccctcctcatttcaaaaattgtgctgatcagagacattcagaaaaagtgcaaaagaacaaaacagctccaaatagctttccacagttctgcactgtattctaccctctgttgatttccctacaaaacagataggcaaaaaagcagctcacaaaaaagatagagtacatagaaaagagaaaaccgaggcataagacagcactgtgtgcttcaagaaagtcctggagca

SEQ ID NO: 89185 - DNA, 601 bp, Human
gaagaaatcttttgggagcaatgtcttattttggcaaagaaaaaaaaataaaggggattctacatccttaagggagatctgtgaaaacctacaatagcaagagtcatgcagggccttgtggtcatgtgcttacagttgcagtgcttagaatacaaactctaaacagaagaggcatatgatggtaaaagaaaaaaatcatgaagaaaaagtaactgtgtaaaagactgacaggtatagggaagtcccttcagacgcaagaacagacaataaatcaaggatcatgggagttgtagaataaagwtgacagtttaaaagccaggaaacaaaaagaaaaactgctgctacactttgaaaattggacagataaaattgccatggagagaaactgattgacaaaaacagagcaaactacagattgggaggaaaattaataagcttggtctgtagcagcacaaatccattggataatcaaagaaaaatgtcccgtggatacttaggcaagtgaggggctttgttttcactgttgcctacctgtcactttgtatagtaatgaaattaatgagcctgaatcttccctttcatgactgtaaagactcaaacg

SEQ ID NO: 89186 - DNA, 601 bp, Human
taatactaatttatttctaaatgattccaagtatttctattgtgtttgtattaatatcagtgctttgtgtcatgaataatctacagagagccaagatttaagtcggtgagaaaaacatttcttgtatgggaagagagtttattaagatacattttatacatttgcacacatttatctctttttttcttaatgcatctttttatacccatctaacataaaccactcaatgtattgtatcacatagtcaatatttctaccaatggggagcagattttaacagatgtatccgatatttttattkaaaaatccatcaatgctaagtgaggcatatggtaagccttgaaaaggaagtattatttaaatgactggagaggaagaagaatagcatttgaaaaaagaaagaatgcactttagaaaacacaggagtagaattgagcagggaacaacttacccagtctgatgagaatagaggtgagtgtgggggaacagtgagaaataaacacaaataagtaggatgggctaaatgacagaggactttgaacactgtgcacaaaataattgataattatatattggaaagttttatctgattacaatgaac

SEQ ID NO: 89187 - DNA, 601 bp, Human
taaaaacactcaaaattataaattcatagagcttatgaaataataacacagtggagaatacaaagcaattaatgatccacatgatgaatggaacagttacccacatatcaatattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtrgtacctattcttacatcacagaaaacagactttaaatcaacagcagtaataaagacaaagaaggtcattatataatgataaagaatcaattcaagcagaagatataacaatcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaa

SEQ ID NO: 89188 - DNA, 601 bp, Human
atattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacartcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaa

SEQ ID NO: 89189 - DNA, 601 bp, Human
gtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacaatcataaatatatacrcatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaaaacaagtctcaataa

SEQ ID NO: 89190 - DNA, 601 bp, Human
tttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccgaagccaaaatctaaacctgggttaagagccaccgaacacatgagcatcacccacatctggagaacttcagtgcatacattttccccatgcttgattttcaaatcacca

SEQ ID NO: 89191 - DNA, 601 bp, Human
aggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccraagccaaaatctaaacctgggttaagagccaccgaacacatgagcatcacccacatctggagaacttcagtgcatacattttccccatgcttgattttcaaatcaccaagtacttttaattaaccttcactattgttatgatttgacatttgttgttctatatatacaactaatatctgccccataccatgccagaacataagaatacaacacctagtattttatagatgagtaatagcagctgccatttattaagcttttgccatgtgccaggcactgcatcttattatttaatactca

SEQ ID NO: 89192 - DNA, 601 bp, Human
aaaatgtaaatgtacagattttttatagaattaacattttcaattatcaatgttttcatcaaatacaaaagttttatttattcccaaatagcaaaatatataagcagttttataaattcctcttatactattaattactattaatcaaactcttaaacctgaatctccttaagaacaatttaatcaggtgttacaacaggcattttaagtacatttgcgttgtttcctagttcattacacattcagggacattaactccccttcccagcttcagttttaaactctttttcctcaaagacamtatagtatctattgataataatttcacaaaggctcatgttttactccctgcatttttgttctgttttggagctatggaatggatgaaatgcctgtactcatactcagagagttttggcctgagctcggagtagcaagggtttgatttttctggcaatttctaatcacagtcacaaaagccaatgcataaacgttcaactacaggtgtctaataaagatttttctcttcagttaatttaagtagaaactaaaatttccaggcatgtcttactttatttccacacttttcatagcaagcagg

SEQ ID NO: 89193 - DNA, 601 bp, Human
aattatcaaaaatttagccctatttcatgcagaataattgcagagatggtcctgccttctattcaggtaaaaaccacttagggagaaggagatttaatatatcagctatttcaaattgcattgggctgaaacatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattacckaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaa

SEQ ID NO: 89194 - DNA, 601 bp, Human
acatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattaccgaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaagtggtttgtagctaaccaaatttgataatgtttctacaccgatgtatatcatgatggcaattttcaattttcaaaactcactgaaggctcctaagaaatttccagcaaacaaaggggaggcatcactgac

SEQ ID NO: 89195 - DNA, 601 bp, Human
gctttctaatatttccatttatagtacacttaagttttaggttataaagagtattcaattggtcagactgagttttgagagttcaatacaattgattttgttcttaaatacaaaacgaattcttatgccaatttgtttttgacagaactgcaaacttaactctttttatcttttgatatcaaacagactcttaatcaatttaattcagcctagcttttggtggagctgttatgaaaataaagtggtaaactgaaattggaagtggggtgaacttttctctaaacacggatttgctggtggyatgtttttttcctctttttcataccatgataaatgtatatgtgaaacacagggaatttaaattttctgaggatcattactgaactatctttttcataggaaataaggcaacaaaaggccatgcattttatattaattattccactgcatgtagcgatgatattttatatgatgctgagcatctctttaaactacatgaatgtgaaacttggcctggttagtagcatgtttatctttcctctgaaagcagcagttttatcagagccaaatacaacaccaagttgacactttctttgcaaca

SEQ ID NO: 89196 - DNA, 601 bp, Human
ataaaataaaataaaataaaataaaataaaataaaataaaataaaataaaataaaataaaataaaataaaataaaattaaaaaatctgtaagacatagcccttctccaagtaggaaagttttaaacctctccagttcattttgcttctctcatctttttgggtaaagaactgatgaatgtaaaataaatacagttactagtaatgcagcatgtgctaatgatttccagtttgatgagaaatgaacaataaataaatgaaacactaatgctcatctttgataactaacatccaaagtcagtratgctgtgagagctctaagcagttgcagaaattctgtgctttatttaggaattgacagttctaataatgtcttcactttctaaagtttccagagggttcctcatgaaggatgtacaaatatactgtcatattaaaaataattttttgatcagcttcattatagccctggctagttattacataatacattctagaaaactacattattggtttacaggttcaggtttgtagttataccatttttagttaattacatctgatatttgtggtcatttctatcacttctatgaaaatttgagc

SEQ ID NO: 89197 - DNA, 601 bp, Human
cttatttaaaatctggtttttctgtacctaagcagtgaatttaaagtagcagtaaagacattctggaaatactcagttcatgaagagtatctgctcatgaagcttaatcactatagtcaacatactacgaaacgtaaaatggaaataaaattttaaaaatattgtaatagtaatcacagttgttttattcatctatttattaaccttaacttaggtcagcagtttctgaccaaaacttagtaaggaaattcttaaattatatgagctaatgtattggggctttgttttgtattgcattacstacattattatttctttaaaaaatgctaataattttattagtaatttctataaaaccaagtataattattgaaatttttgaattctctatacatttttatcaagtttcattttatttcagaaaggttgatcaaactatacataaatccaaagtataatatattctgctatattaaaaaatacttcaatttttctagagaactggttagacattgtagattactcatcttgaaatgccaagaggcaatatgatacaggaatggaagtataaaagactttaaagaagcctggctttacaatg

SEQ ID NO: 89198 - DNA, 601 bp, Human
acatttgtgtactggatctagaaacagcaaccctggacacaaacaaacacacatgcccacaggaactctttctaaaagcttacaaaaggccacacacactcataaactactgctttaaaatgacaacgaaaaattattttatttctcatttttccacaatcattttgtgttttctgcataggttatgtagctattacacagaaataaaatggtactttttccttgattgtttctgcatatcacagacagttcattgtttctcctaaagatacgagagcatgattggtcaaacatcaaatayaattcacaaagcctgatattaaatccattttttaaatgactcacatttttatgctactcctcacattgtttattcccagttttaatagtttagcccagtatttttccatgacttgaaaagggaagttcaatatgtttagtgcatttaagcttcataataatcaattgtatctgattatgcgatgcctgcctggcaccagcatttttctctgcaaacatttcagtagaccaatactagaaaagcaaacaacccttagcttctccaaattcctaaaacaactcctttcgcagtcactcttta

SEQ ID NO: 89199 - DNA, 601 bp, Human
ttttagcgaccaaataatgtgcaagcaatttagaaagaaatgggaaggaacatggatagtgtaagagcctcatttggaagtgactaggcccatgtttaaaaggaagtgatgtggaagagataaggtgtaccaggaagagccacaacaaaagcacattgttcccactattcgattctatccccaggtggaaacatcactggtgaggtttccatttggcttgatcgtgttccgcaaatttacacaatcaaagccacctcactggtttccgttcacttgccggtttgttttttcagtgatgcayggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttcaaaatcatccttggtaatcagtatataattcttcagtgtgcaaaaggctaccaatatgtatagccccaagctgaatctttgagattttcttctctttaatctttcaaaaa

SEQ ID NO: 89200 - DNA, 601 bp, Human
acatcactggtgaggtttccatttggcttgatcgtgttccgcaaatttacacaatcaaagccacctcactggtttccgttcacttgccggtttgttttttcagtgatgcacggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttyaaaatcatccttggtaatcagtatataattcttcagtgtgcaaaaggctaccaatatgtatagccccaagctgaatctttgagattttcttctctttaatctttcaaaaaataagtatttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggt

SEQ ID NO: 89201 - DNA, 601 bp, Human
atagcatttcaggaattatacttgtttttctttacttgttcattgtctatcttcctcactggactgaaactccatccaggcagcaaccatgtctatggttcctcaccaagtgtaatcacagaggcaagaacacaataggcgtgaaaaactatttttgaatgaatgaatggagatgtttattgtattgtaagaaatgtgtccaaacgccctttttaaagtccgtgttaatagtcattgtgttcatattttacaaatgaaggttaaagtattctgaaagctaatcagcaaaatgtcctagctstgaatgctgaagatagtttagtgcctttctgggtttttttggtatgtttctttaaagatagaggcagtacagatgcttagcaaaatcaaccttgttattgtttttgtttttggttttgaaaatgataatagattttgtctcaacaacttttgtttgtttgttaaaggcttatttagtgtctccctctttgtaaccctctttttcatcctgtttccataatgcacatggagctcatagattaccttaatttttatttaaatgtaagactgaaagctatggtgtaagtctctgcctacatca

SEQ ID NO: 89202 - DNA, 601 bp, Human
ctacaagtgtatcatctgcacatacacaacagtaaacgatatttggaaactgtaagcctggaattaggagacataactattccttcaagttttatagaatatcacttgggagattccaaaaccatagctattacatggcaaacctaggataagagcagtagtatgagtgctggcagaccagctgccactttcctatacagtgaaaaaggccggtgaaacaagtacaggccagatttttaaaaatcatactttctcaaggatctccacaaactggagggtgtcctggctgtctgtgtgatascctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagc

SEQ ID NO: 89203 - DNA, 601 bp, Human
gtaaaataaattatatacctatgtgtttgaaatttaaaagttatttttcaagcataggtctgtccaatgccaaatgaattcctaaaataaacaatcggatacatcgagtagctattcactttcactattttatggggggaaaacaatccattgtttacagaaccgtttaaaaagtttaggagtattttcactctcactgcagggctagtgaacatctcagtatctttgtcaccacttccttccatccttcccagatttcaagtgcccgaaggcaaagtagaatgacccctaagcttttttsgaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaaccc

SEQ ID NO: 89204 - DNA, 601 bp, Human
gaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaacccrgctcaagtcaagctatctactcacaactttaaaatgcttatagggcactgttgtcagaggtgactgtcgggcgaagtgtcagagccctggcatcaggaagtgctcaactcacgtgttggtaaaaagaatttaccaacaacagcataggtttgaaaaggaaaagtttattggaaagaaagaacactgcagaagagtgcagcagtgcaccgcagtgagaggactgagtgcactgctgtgggtttttccttaggggtattcatggaccttaaggcgggagcttaagggtaatttggaccgtat

SEQ ID NO: 89205 - DNA, 601 bp, Human
tattcatggaccttaaggcgggagcttaagggtaatttggaccgtattagtcacatagatcatgataaatgatcaagtttgtagacattttggtgtgttaatgtcagcaagggttgtaaaatgagttttggaatggcattactgatataagatactgagctgtgaagaattgccccaaatttaaaaatttttaaagaatgagaaagctaccaaaaatgtatggttccctaaatgtactgcaatgggaactatggcactgaccattctcctaaatttccatttctatataaagagatgtatrgaaattttaattacttagaaagattgaaaaaggcctggaaccagaggccaactttggatattaggaaagtctaattacttctaattttcccagataaggagttgtgcctccggagggcctgtttaatagtcaccgggtgacccgtactctcttctaaattcctcaaataaggagtttttgtctccggggccttttcaatggtcaccaggtgattttcactctcctctgtgacctggtttgtcctcgaatggaaccctgcttccagcatcccttctgaaagccttctacatcaatatttct

SEQ ID NO: 89206 - DNA, 601 bp, Human
attttggtttaaaaaatgccatttttgtttctttttggtaaacagtgctctctatttcctggaaaatcacgtatagtgcaaatttacctttactcatgtttaaggtcacaccattgagtatctgcttaagtcaagcactgtgctcagtgtgtaactcatttactcacaacaacactgtggggtaggcgccattattatccccaatttataggcaaagaagctgaaactcagagaagttggaattccacgtggccaagtagctaataatggaagggctgagattcagaattttgtctgaccrtaaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccagcatccattcaacaccactcccaagtctcttagctgctcccaagatttctgggccactctttccatgatatacatatgcatgaaaaatctcatataaaattca

SEQ ID NO: 89207 - DNA, 601 bp, Human
tccccaatttataggcaaagaagctgaaactcagagaagttggaattccacgtggccaagtagctaataatggaagggctgagattcagaattttgtctgaccataaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccrgcatccattcaacaccactcccaagtctcttagctgctcccaagatttctgggccactctttccatgatatacatatgcatgaaaaatctcatataaaattcacatgcttctgttttcaagtccctctattccccatcctttgctttattccattccacaatagtgcaagttcctggaaaaacgcaataatgtcttccatctctttcatcaccttcccttttaccaaataggatgaggagcatggagtagaatatccatccctgtaattatacctaaaacactaaagatcagtgaagtgt

SEQ ID NO: 89208 - DNA, 601 bp, Human
cttaacagacctgttttctgagttctaataacattaggaaaattacctcacagggctgactctcaatttgttcattcacaaaatggagataataactatatttcagggctgtgaagatatgaaataacttacgtgaaatacctagcatatagaagctgttccataagtgatagcctgttgttgacattgactaacatttattgagcacttagtatatgccaggtgctgttgtatgcacttcatatgtattaatccgttaaatccacagaacggtcctttcacttaggtactattatcattwggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttcttagtgaccccaggaaaaattgccccagcttaactctgtaacctgttcaattttaccctcaca

SEQ ID NO: 89209 - DNA, 601 bp, Human
tcatatgtattaatccgttaaatccacagaacggtcctttcacttaggtactattatcatttggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttctyagtgaccccaggaaaaattgccccagcttaactctgtaacctgttcaattttaccctcacatgcaattgagaagtgttcttaatttataacagcaacagcttctttcagaaagctttcccacctaactgtaccaatctcacctataagcgacatcattggctcatttctctaccttgaatttcactctggataaatttagaagtcaccttttgtaattttacacattttctttaaatttttcccacaacataaacctacaagattcttcttttttcttaacagcttgcaaaagtggtcat

SEQ ID NO: 89210 - DNA, 601 bp, Human
tttgtcaacacacatataaaggacatctctggctgttccagcaacagccagaacttgtttctgttctggattaaaagcagctggaaagtagaatgcccatgttcaccttgacagctttctgttccatacttatgtttccctatcctaatgccaaatttctctgctgctgttaatgaaactttactacatcataatgggatttttcaatgaaattgccatatgacctatctcctgtgttacagtcttgaagagaactaacagcctttggctttaacttgcttggggaaatcaccagtgcctrctgctttttctcctgatacagcctacaaaatatatccattttctctatcatctgaggttcacatcaaactctttatttctgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagat

SEQ ID NO: 89211 - DNA, 601 bp, Human
aatagctcttctctcctcaccatcttctgtgtgacttgccttagtctatcccatgtctttcatgtcctcctttttggttcccctccccccagtgttgggaccccttggctcacagatagattgtgtgccatcctcactgataggtaaatagacatttacagtcaatattgcagtagacaaagaagatattatttatccattttaatggtgggaggagaacatgctcagagtgcacctaggagctgattagtggcagaactcaggtctgctgggcattccccacagctcctcttttatgacrgctccctgacaagaaggaaaactttccttgggtaatgacatctccaaattgcgtggccattcctattccctccagagatttcttcttggatactattgtcccagaactaaaaagagaaaaatactctttggatagaacaacatcctagcttctgagctttctgcatcaagaccccattttccccatgatgtcctctcaagttaattaggatgcactagcagaagtagctacagagtgacagaacttcaggatacaaagtccttgcagtcattgagtatcattagtaaaaaggtaatgctg

SEQ ID NO: 89212 - DNA, 601 bp, Human
ttcaggagtatgagagtaatgcaggaataaaatgaagttgaaaaatgctaccacccaaaagatatatttaaagccacatattatcttattaaaattaaaaacctaacattgtccttcatataagtgaagactgttttagtatttttactaatggggactatgcaaatggtctgaattttcatttgagagataattgggtctccatttgtatgtcacctctaaacaagactcccaacctcagagaaaaaccatctactcatcaaagaatctgttgccaatttaacacatagaaaaatcttcytacaattaacataaatagaatgtccttttaaaatgtcacagcattaattcaggtacttttgaaaaactcactcaagagtacagtgtttccatcaaatgtatgaacttagccccatttgcaaaggtcactaaaatgaacccatctttttccacataaaacgatgtatggggctacagagccattaaataaatattcattttaaatcaagctttttatttatccattggagatgacctctgttctaattatctataatgcttttcaaaaaggaaaggtatttttgtcgttgtctagtaaatc

SEQ ID NO: 89213 - DNA, 601 bp, Human
ctcacagagaaatagtgattgctgtagcaaacttcccaatctttgtaccatcttcatgaccaatgcatttattaactgggctgtcaggagtgttgatggcttatagctcataactgagttcccccttcctggcatcaccctcagctgaaaagatgctcacccaagatgtaggagcagcccacatccaatgtttgggggattcaggatgataaaatctcatccttgttgccccatttccaaatatctttgaagaactctcccagctccagagttccccatagaattgactgaggtcttgatrtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagaaagctgcatgttctcattcagtaggcatagacactattccaatgctgggaacacagcagtaagaaaaacaagtcttttctcttatggatctgatattctggtgaggaaa

SEQ ID NO: 89214 - DNA, 601 bp, Human
ttgggggattcaggatgataaaatctcatccttgttgccccatttccaaatatctttgaagaactctcccagctccagagttccccatagaattgactgaggtcttgatgtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagraagctgcatgttctcattcagtaggcatagacactattccaatgctgggaacacagcagtaagaaaaacaagtcttttctcttatggatctgatattctggtgaggaaaacctaaatagacataatagaatgtcaagtaatgacgggtgctaagacaaaaaagaagcagggcaagaggagaggtaatgtttgtgtttaggactgcattggactacattagatagagtggccacagaaaaagtccctaaagaggtaacatgcaagcagaaagctgaataaactaatgaaacaattcatacc

SEQ ID NO: 89215 - DNA, 601 bp, Human
aataaccctatgaatgaaggcatgtggtcaggttcaaaatatattctaagggttgaagaagcagtgaaacaagagcaaatggtttagacatttaggacagaggcaaaatgtaaaacttcttgaaagtcaggaagaggggttcagacctttcaaacattcacttggcattagtatgtagtatgcattgaattttgaagagactataactaaagaggtctttaatcagactacttcagaaaatatgacagaaatgtcactagggcttaaccacaatggaactgatggtaaaaatggaggtggcggtgattgaaatggtggtgttggtagtagcagaggtcatagtgtaggatggtgaaggtggtagtgatagtgacaagtatcatatagagatggtgctcatattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaaga

SEQ ID NO: 89216 - DNA, 601 bp, Human
tctttctcttttgaaaaatggatataatgaatacaccccccccccaaaaaaaaaacgggggggaattacattttcttacctgttaaattacatctaggcacctatttccacactggagactctggctgacttaacatatatgtcaagttatagataaagacacatatagtcataataagggtattacttgaaagtgccttagtatatggctttctgtagctcattcctatgttaaaagtctatctgcagaagtctgacataactgttgccttctgtagaatcagaattcacattttattgkgggaaacactaaaataagtcttgatttgccatatagctaattctgcatgtcagaaagcactctagagcctccagtatctgaggggcatacaacaaactctctctcttgcactctctctatctctatctcatgcttataaatatgaatgcaaattctacttatgttgaacaataatttggttcttaattaatcaccctagaaaataaaacacttaaggcaggagaatcagtaggagtcttttccgaaaaaaaaagtaaaattctctataccatcatcattgtaaacacttgatcagttgtt

SEQ ID NO: 89217 - DNA, 601 bp, Human
ataatcctcctcttgaagaatttacaatatatatgttaaaactctatttacttgtatttgaaaaattgctaatactttcttattggttttcttagcaagagaaattgggtgatatctgcttctcccttcgctacgtacctactgctggtaagctgactgttgtcattctggaggcaaagaacctgaagaagatggatgtgggtggcttatccggtaagcctgcagtgtttattgatttttttcaaatgctgtttcgtcgtggataccaaatgcatggcgcacatgctgcgactccccactycttaattgatcacagttctctttcctatggagcctggaagcagtctcagaattcatcccaacacagtgccccaggaagccactctcaattcataggaattagcatagaagatgaaatctattttccttctttggagccaaagtatcaattgtctttttaatggcattgaaagctgaaaatgtttgcttcttttctgaaagagagtgttcatgacagattataattttgttgagcttagagggggtttttggtcaaaattcacccacgatataaaaaacaatgttttccatgagacttatt

SEQ ID NO: 89218 - DNA, 601 bp, Human
ctaggcgagcaaaatttaccctgtccccctccctccacccacacacactctgttttctggaagatgccattttttaaatgttaatcatgggtttgtcttttctctagctccttttctactgtcctagaaatgtaatttgggaaatgcagccagatttaaatatttgagatcatttaggaaagagcaactcacccaacctcaggtaactactagattccaaggagaaaccatgaaccagcagaggtaggtcattccctcaggcgatatttatcaacatgtgatattttgcataaccccatcraaatcacctagggtacttattaaaaactaagatttcaaggactaattcaaaccaagctgtgactgagtatctaggggtgggaacctggaaattgccttttaaacaggtcctccccgtccatacacacatacccatgttatttttatgcatcttaaatttgaaaactacacttcagaggcttaaaatgctatgtcataattttaactgaggcctaggtcagccaagttccaagttagaatttttttttttttgggtcagtaacatagaatacatcttttgctttatataatggaatttcct

SEQ ID NO: 89219 - DNA, 601 bp, Human
agagattttaaaagaggcagtgaatgtttatgaattatgcaagtctgaactttcattttaataactccattaaaatataaaaaccttaaaagcctcccatcaggaatttaactttatagaaatgctttatatgtgccctgaccttgccaagaggcaggcctaaggcatgatttaacagttactacaaggcaaagcctaataataaatacctatctgaaaatgccagcatttgtccctgcctccttggcctccagtggagttgcaactcagccataaacaggccctctcctgagagacagcrgggcgcagcagaaagggagcagcaactggccctggaaagcctggatcggaagcctttaacctttctgatcctcagtctgttcatctataaaactagggtattagagacagccatattgttgaataaacaaatgagataacattaggtgaaagctccaggtagaaagcactatataaatattggttatttctaagcaaaagacagttcttggttaactcttaatttttgtcaccatatcctggctccaggagaatgtgtgttcctatatggctgatataaataatactgtgtgtgtgtgtg

SEQ ID NO: 89220 - DNA, 601 bp, Human
gggggagagaggaatatcctctcctacaatttgtgcttaactagcttaggtttgtccgatgagatcagacatcttttaatgttgatgatgttcacctatcagtaaaactttgggagcacattcctctttatacatttacttgtaggtttgtaagtgtatatagaccactatagtaatataaaatggacattataaacttaaaagtcaaaaaatgtaaaagataaagcaaaagtaaacattttacaatttgctttatgaatgataaaaatgttattctccctttaaaatataattactaatwtgttaataataaatatgcctcacttttctttaagatatctgtttaactttgtaatgtagcaattcacaagcataatattagattccatttatttcaacacttagttttatagatggtcacatcaaaaaaatgcctcacaaatgcacaatattcataatatttaatatgaacttagtttggaatttacagaaaatatgtcaatatatcacatcgactgaagttttttattttttttaaatcaaaacttttaaaagcttaaaacttttaaacttttagagaagcttttagccagcttctcta

SEQ ID NO: 89221 - DNA, 601 bp, Human
atgccaccctcaggaaaccttgagtactgcgtgtgaatcatgccagaacaggggcacctctgtgatactgtacatcagacctcagtaaatttccaatcctttatttttagaagaagaaaataaagtagaaactctggtattttcttctggggtgccagaagtaaatatttgaatttctactttattttttccacactggagatcagagaaactaaaggtttcaagtttataaaccaaaagtcggccagcaaatacattttcctttcctttctcttaccaaagagaaaaagatgatatcatrttgattaagttttgtctttatagaccaactattcattaaccagaaggacagatcattgttatttattaatgtgatacctaatttttattttaaaagggtacacattctaacaaatggtaatttcttcataattttcaaaaataatgccgggttttaaaaagaaaaacagatgatgtaaagaggcactaaaccagattagtttcaggacattcaatgtcaccagaaggataggaatggctggatgttgcacctataaagggaaacactggatgggtagcaggatggctgctcacaaggatt

SEQ ID NO: 89222 - DNA, 601 bp, Human
gtgaggacaaccagaggtcactctcggcgccattttggttttggtgggtttggctggctcctttactgcaaactgttttatcagcaaggtctttatgacctgtattttatgctgacctcctttctcatcctgttacttagaatgccttagccgtctgggaatgcagcccagtaggtttcagcctcattttacccagctcctatttaagatggagttgctctggttcacacacatctgacataaatgggcaattttctagtttacattgcagtgagctggaaatgaagcaaaatctttccamtgcataattcaggctaacttttaacttaaattcacaggtagggtaaatggcccatttcattaatgatttacaaacgtctgcatgcctccttatctaaattgccaaaatacctttatatttcactgcccgatatcacattataaattgtaaatatatgacttatctattcattagatttccagaactcttattctagggcaaacaagaaagcaataaaatccatgttgaattttagctcatatttctccttattgttcaatttcattcattcgttcaacaagtatctattgaatgcttact

SEQ ID NO: 89223 - DNA, 601 bp, Human
ggtaaaactgtacacctaaactttgtaaaactctgtagttgagactgtctcaagttcctgttgaatcagataattgttatcagatccccttgaaaaagataaaaggaccaccactgttacaaagtacagagcaacaaaagccaaggcccagttaacagcacttcattgaaatgcaagaggcatctctgtgtacttacttcccatcttagacacaggagagcagggggtttgaaggatttgaattctgaatttctgttagaataacatctgccaagaataagccctgaatgtactacttttmcctgtagagaaaaatgagcttatcactcaggtctttgtcgagataatacctacacctgttgtcaggctaaagatttagatagtcctggatgaaattccaggtctgctgtgtgagtgttagggagcatggttgagctacaaattgcgtggaagcaagctgattttaagttgccatggcaaagaaaatgcagagaatgagcagcttttacattaatgttttctacatcttgttaggataggattgtccagctgaggggtgctttttttgtgcttctactgacatgaacagataaaataataa

SEQ ID NO: 89224 - DNA, 601 bp, Human
tcactttttaaatgatggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgayatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaa

SEQ ID NO: 89225 - DNA, 601 bp, Human
atggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataa

SEQ ID NO: 89226 - DNA, 601 bp, Human
tgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacrggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataatcttacaggaccaccatagaacatgtggttcatccttgaccaaaacat

SEQ ID NO: 89227 - DNA, 601 bp, Human
tatttccacttcctccctaactatgaatattttcatgctgttcaatatggtacaatggcaaaataagtttatatagtatagatggctattcaagatatagttatttaaataaaaagtgggtttttttcctaaaaacaaaacaaaagaaaatctccttttgcttttctaactaccctttatgtccattttgttgttgtcccttgcagaatttacagtattagacaaaacacacagtggaagatcagaatttaattagatttgtttgttgttgaaacagctttcaaattctttcatcttatarggagtgaatccctagattactcacagacacatgaaaataaaaaactacagaagaatgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtgg

SEQ ID NO: 89228 - DNA, 601 bp, Human
tgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcaygttaatctggaaaatttttcataaattaaggaaattgagtttaatagttacagcaaattctccacatgcatcatgtttctgtactgagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcata

SEQ ID NO: 89229 - DNA, 601 bp, Human
gagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttakgagggcacgtaatcagagtggctgtacctgaactaggtacaaaaatgcttaatactcagcttaacactagcatgtaaaatgtatgtgaattcagcaaaacatattttaaatgactttacattccatttctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaaca

SEQ ID NO: 89230 - DNA, 601 bp, Human
cttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttaggagggcacgtaatcagagtggctgtacctgaactaggtacaaaaatgcttaatactcagcttaacactagcatgtaaaatgtatgtgaattcagcaaaacatattttaaatgactttacattccattkctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggt

SEQ ID NO: 89231 - DNA, 601 bp, Human
atataattctgtaattcttagatatcaaaaacaagactatttgaacagtttagtattaaaataagtgacaacttacattacttaggagggcacgtaatcagagtggctgtacctgaactaggtacaaaaatgcttaatactcagcttaacactagcatgtaaaatgtatgtgaattcagcaaaacatattttaaatgactttacattccatttctatgtatgttatagacacaaagttatggcactgagatgaatcactacttttgacaaacattttttgacactctcacctgggagatcyggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggtgtttaatacccaaatctttgaattattgttagattatttactatcttttgctagtagttattcccaccaagcaatttataataagcag

SEQ ID NO: 89232 - DNA, 601 bp, Human
ttttttccaaactctacatagataaggattgtataatcagttactggaaatgcattcttaggattgtttgcataatttattttctatgtatttgtggatgctcaatcaagctttatgtatattcattgattttttcaaatctgattgccctagttatgcgtgtttattccccccaaaattgtcagccacagttaaaattaaaattatgataccaaacttactggtggtagcatgctataatttataattcaagatggtatcagagccacattatatactaaactggttttgtatatgcagkttatcataggatttagaacaaatcagtgtattaggccagagttaccaactgaagggagcatcaaccaactgtggttatacaattacccattgttgttgttgttgttgttgttgttttttaattcaggaaaatgtgttgtatatgaatatactaaataaaggaaataaagctattaatagaatgtgccactggtgtcttaggtgaaaacatacaccaagattcataactcccctaaaattgttattgtcagttagctggataaagtggtctatgactaagttaaaaagctagaaaaatctt

SEQ ID NO: 89233 - DNA, 601 bp, Human
aatatcattgctgcagtctctaatactgctgcagtgctgcctagctgctactttaaaccaacactggctcatctggggccttgaattaccccttaaaggttgtatggtgcattaccctgctattttaaaattactttaaaccattcctaaagaaaggtaccacatccttctccagagaagaagttattagattctttacaaaaacacatatttatttaaataataaatttccaacaaaaaattcacaattataagattcctttgaaaattaccagggttttccccaaatacatttttgggtttttttttttccttccttagtattcattagttttcttttttctttttcttttttttatactttaagttctggggtacatgtgcacaacgtgcaggtttgttacataggtatacacatgccatggtggtttgctgcacccatcaacccatcatctacattaggtatttctcttaatgctatccctctcctagccccccaacccccacagaccctggtgtgtgatgttcccctccctgtgtccatgtgttctcatttttcaactcccacttactagttttctattgtatgaactatcttcca

SEQ ID NO: 89234 - DNA, 601 bp, Human
gtcactactatgcatcacgagtgcctttacctatgtccttttcctcttcaacctatatacacacagactttttcctgcttctttaagggggaaaagtctgctaattcaggtgagggactatgtgtttgaaaaagtgttttcaaataaaatacttggccagtcacagtggctcacatctgtaatcataacactttgggagggtgaggtgggtggacaacctgagtccaggagttcaagaccagactgggaaacatggcaaaaccccatctccactaaaaataaaaataaaaaataaataaawaaatagccaggtgtggtggcacacacctgtagttccagctacaagggaggctgaggtcagaggatcacttgagccagggatgtggcggttgcaatgagccaggatcgtaccactgcactccagcctgggcaacagagtgagactctgtctccataaataaataaataaattttgtagtggtagaagtttctaagcagggatttccatgttctactcatagaaaaacttacagaacaagcaggtactttaaaccccaacttctagggctaactacgtcatggaaattattctataaggaca

SEQ ID NO: 89235 - DNA, 601 bp, Human
gaaaagcagacactcccctcacagtgcttgcaggcacctcttttagctttttttttattttcaatttaccctcttgtctctagatgatacgctgcttggtgaattttgtttcagcgttacccactgactccccgccatggaaaatgagggtttagctcttttctatgcacacacatatttccaatatagttatgccataattttgtctagctcaatattcaattcacattattgggattatgtggaaactgcacaattgagccctatagtaacctttcaacacttttcctttctcatctarcattgtttaattgtcccattggcttaattttcatgtgtttattaccaattcaatcccaacctcactgctgattgtctaaatctctctcaaattgctcatccttatgaagtagccttccccagaacctgacttgctacagtctagactggttgctctctaactcatcctggagattcctgccgtctgtgtgggagcttctaatgtcttcctctttcagtgttggctccatcttggtggcaaacatccagtagtaactaactgcctgcaaggtgactttgggaaagctgcttaacaactcca

SEQ ID NO: 89236 - DNA, 601 bp, Human
ttttagttgattcccgccccccaacagttttgagtagacagtaagaattacaaatgattacaccacttagaaaagccagagaaaggaataaatagatttatttttgttcagaatgactgatttgttgtgatcagaaaccaaaggattttaaaatactgagtacaaacctgcatatgaggtttgtaagacaatgggtagaatactggatgtcacaactaaaaatgaggccagtatcacggtaattttgcaagatgtgtgtcaaatatcaatccattgttgaaaggtgtccaattcatatatrccctaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatgttatttaaaaagtttt

SEQ ID NO: 89237 - DNA, 601 bp, Human
tgtccaattcatatataccctaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatkttatttaaaaagtttttattttctagcatatctacaaaaatcacatcaactctttgctattgtgaaaaactacatgtcataggaaaaacaagtaatgatataaacagatttcataatttgaaataaactatcagctgaacaaagattacattaagaacatacccaataatacagattgtagatgcacaagtaagaatttacaccggtttacagcaaatgaggacaggaggatggaggatactttactccccatttgatcccacatatggtatatgatttacttggagtataaaggacaaa

SEQ ID NO: 89238 - DNA, 601 bp, Human
tttacagcaaatgaggacaggaggatggaggatactttactccccatttgatcccacatatggtatatgatttacttggagtataaaggacaaagaaaaagggtatagggagactatcaggagaggtaaaccaatttaagctaatgcaaaacgaaaaaaaagacaaatgtttatgtctgatgacataaaattaaaagattactagttcagtcagtttaatgaagattaatctggtccagttaataaagaaaactgagtatatgtattgtaaccatgtctgaagaggcaatcctgaaagcattttttttttttctgaagcacaactctttatttttctttcttttttttttttttttttagttatactttaagttctaggttacatgtgcacaacgtgcagttttgttacataggtatacatgtgccatgttggtttgctgcacccatcaactcctcatttacattaggtatttctcctaacgctatccctccccaagccccccacccccgagcaggcccccacatgtgatgttcccctgtctgtgtccatgtgttctcattgttcaatttccacttataagtgagaacatgcagtgtttgg

SEQ ID NO: 89239 - DNA, 601 bp, Human
tcctgacttcttaatgattgccattctaactggcgtgagatggtatctcattgtggttttgatttgcatttctctgatgaccagtgatgatgagcattttttcatatgtctgttggctgcataaatgtcttattttgagaagcgtctgttcatatcctttgcccactttttgatgggattgttttttttctttcaaatttgtttaagttctttgtagattctggatattagccttttgtcaaatgggtagattgtgagaattttctcccattcggtaggttgcctgttcacgctgatgatrgtttattttgctgtgcagaaactctttcgtttaattaaatcccatttgtctattttggcttttgttgccatctgaaagcatttctttaagcttctctgtcagcctccctcttcttttccccactccatccttctctctgatttcttctgccttctggggaagaaatgaagactgagcaatttcatcagtatatacccctctactaagcactagcatcctgtgctgttccctcctgggacagagaagaccagaaacagctgctatgtcaatttacaccttgtctctgactaacctagaagc

SEQ ID NO: 89240 - DNA, 601 bp, Human
agatggagtcacttctttcacccaggctggtgtgcagtggcgcaatctcagctcactgcaacctctgcctcccagattcaatcaagtcttctgcctctgcctcctgagtagctgggattacaggggcccacgaccacgcccagctaatttttgtatttttagtagagatgaggtttcaccatgttgaccaggctggtcttgaactcctgacctcaagtgatcctccagccttgacctcccaaagtgttgggattacaggtgtgagccaccatgcctagccccagagctcaacatttattayggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaatatcaaagaagagaaaaattgatttaaactgatgcatatc

SEQ ID NO: 89241 - DNA, 601 bp, Human
tgagccaccatgcctagccccagagctcaacatttattacggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaaaatcaaagaagagaaaaattgatttaaactgatgcatatcatatcaaaataaatttaaaataacatactcagtaaagaactatccagattttcctaattttctaaattaataaatttagggagacatctttatagtttataagatagccattgactattttgttatcatactatggctgcaatatacccaataatactctgtatcctaaattagttactacacctgggaatataatttttaattgcttaatgcttacatacaaaattatctataaccatttctaagcagaatattttaata

SEQ ID NO: 89242 - DNA, 601 bp, Human
attcaaagaatggaagttttataaattctatatctaggctaaggggacataatcataggttaagtggagaaaactgtgactcaaatactttgtgtgacttgattgaaggatgatatttttctgacagtgtgtcaacaaatatttattgagcatttatttggtgccaggcattataatgttggtactaggaatagagagattaacatgatattttcccttcagcaatttatattctggaagagagagttaaataataaacataaaataattttgggtgctggtaagtgcaacaaagaagactaatagaataatgtgaaaggtaaatgaaggggtggacttagctctggtgaacagacaagtttctttaaaaaggtaacatatgaaaacctagaggaagagggtttcaggcaataagaaatgtgaatgctaaggtcctgagatgggaagaaactttatatatgttcgaggaatatccaggaagctggaatggccagaacttggcccagcactgggagagtgaaagggatgaggtctcagaggcaggcaggaaccagctggtgtagaggtttggaggccactggaagggggttgcttgtattcc

SEQ ID NO: 89243 - DNA, 601 bp, Human
tgcttgtattccagttgcaccagggaactagccatcagagattttgttttattttgtttgagacagggtctccctctgttgcccaggctggagtgcagtggcacaatcacggctcactgcagtctcgatctcctgggcttaagcagtcctcccacctcagccttccgaatagctgggattacaggcctgtgccaccatgcctggataattttatttttctgtagagaggggagtctccctatgttgcccaggctggtctcgaactcccggctcacgtgatccttccacttcagcctcccaragtgttgcgattacaggcttgagctaccatgcgtggcccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaa

SEQ ID NO: 89244 - DNA, 601 bp, Human
ccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaaaggaagcatcctgatagatttttccgagtatatgtgawctcctaatccaaacagcttttcatccaggaagtttccatcatgctctccactatccactgtaaattccatatcactatgcagaactgaggttcctgacatttttgtgtttctcagaaaatgttggtgcagctttttagtcttgtaaccgaatgaggttaggttatgttcatgctacaaacattagattccaaatcactgcttaaagctgaaagttaaccttctaattgaattaatttctacatatgtttttcctgttccaccaattatattccatttgtcatttgttatgtttcaggaaa

SEQ ID NO: 89245 - DNA, 601 bp, Human
agggcatgaataagaaggaatattcatcttttccttgttcttttcaagttttaaaagggtttttaatattgttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatayttccaaaaatataattccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactccc

SEQ ID NO: 89246 - DNA, 601 bp, Human
ttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatatttccaaaaatataattccaatcaaacttaaattggctttgtttatagtcggaacagtctatgttaactacrtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtgcccaagaatttccatttctaacaagtccccagctgatgctgaccttgctggtata

SEQ ID NO: 89247 - DNA, 601 bp, Human
tccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtrcccaagaatttccatttctaacaagtccccagctgatgctgaccttgctggtatagggccacaccctgagtaccacttgtaaaaatgatgctcatcagttctctgcttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatataccta

SEQ ID NO: 89248 - DNA, 601 bp, Human
ttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatatacctagtcctattcttggaacttcactttttctccaagaatacacaagtcattccctctccttcaagttcaaacttcctactcggctttctcactcctctatgcctaacttrtcctttatgtttatggacatagtataaactatagaaaaaagtaggtactaggacccatggcaagtcattaagttgagccacgatttcatcaaaatgtaaaggtaatagtacctacttctggctattgtggatggaaaaatgagatgatatgcacagaatcaagcaccatacccagtattcaggacgtctcccctcctactgcctgcaaaattaagttttttcctatcttcctagaacttctggcttctacagttattgatctccctgtcaactgcattccatgaaattccctgctaatcc

SEQ ID NO: 89249 - DNA, 601 bp, Human
atttcatttttgtaaagtcacggtcttgctatgttgcccaggctggtctcatactcctgggctcaagcgatcctcccaccttgaccttccaaagtactgggattagaggcataagccaccaaaactcaaacatttgtaggccaaaactcaaacgtttttaggaagaaagagattaagaaggtgggctgccctgggacttactgattgtgtaagccagcattgttggcctagtgagtgttttagcactttcagaatctcagagcccttcacagatcctctgacaggagttgaccctttggcwtgagtcaatctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagctttgggagataaaatctgggtttcaagtttgataaaatatttttcacagtagttatctaggattgatcaattctgaag

SEQ ID NO: 89250 - DNA, 601 bp, Human
gcctagtgagtgttttagcactttcagaatctcagagcccttcacagatcctctgacaggagttgaccctttggcttgagtcaatctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagcttkgggagataaaatctgggtttcaagtttgataaaatatttttcacagtagttatctaggattgatcaattctgaaggctctaatttctgttcttcaagctaatttaacacaaggcagcctgaacaataccactcttggatgggcagcctaagaaacagattttcgcaggtgtttcctctgtgctgcaaacctaaatagccccctacattcaatcacatcgatgccagaggcaggaaaaaaactgcaacaaaagaagaaaagagagcaagctcagtaaagctgaggactgctcaagagccgt

SEQ ID NO: 89251 - DNA, 601 bp, Human
cccatgaatggcagactaaattataatggtggtacttaataaaattcattctaccctcttcttaaaaatgaaaaactataaatagaactactgagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagwcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaa

SEQ ID NO: 89252 - DNA, 601 bp, Human
gagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcckacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggca

SEQ ID NO: 89253 - DNA, 601 bp, Human
caccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacragagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggcagcctgtatgtgagtgaagcttcagaactacttgaaaattgcattatttaactgtgtccagatggaatagagaacattctcacact

SEQ ID NO: 89254 - DNA, 601 bp, Human
atcaaatgaaatctgcaaagcctccatatactcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgacycttgctatatctcaggaattatactgaagtttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtat

SEQ ID NO: 89255 - DNA, 601 bp, Human
actcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaartttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcct

SEQ ID NO: 89256 - DNA, 601 bp, Human
aaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaagtttgacaaataaacgtctgaccacaaacaatcatagacccctgccctcarggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcctcatggtgcaattgaagacagtggctgtcccaaccaagtttttcctcttta

SEQ ID NO: 89257 - DNA, 601 bp, Human
agccaccctctagagttgctaccaccatttgttgggaaggcatgaagtcaaagaaaagtttgagacctgggatagttgtccccatttgtcataccattgggatagctctgatcgtcacattcttagaaatgcaaatactaagctctgagaagatacagtcttctttgtgaatcacctccatcccaatttttgacctcacttttaggtgggatgtatctacagcacagagtctgtgactctgagatacatcaaagactatttggtggcccctcctgaaatcagaagaggatgtaatttgctrtggtttttgcaactctcttacgcacagtccaagcaaagaacattatagttttagagtggatgtggctgtccttactctggtatactcacaggagaaggacattgctgtcttctttccttccatctttgatcacatcactactgtattgtgacctcttcttcccagaagaacaacagttttatcctcttaatcttgttcaaactgccttctaacactgaccaccaccaaaagatgttgcttcgagaagaggctgaatggagaaccttaaatgcatggggaatattcctgagtctcattgaa

SEQ ID NO: 89258 - DNA, 601 bp, Human
ggcaatcctgggtgagctactctgaacaggagatggcagtagcagccaaggatttgggcagccctttctagtcctaacagaggggatttcctattggttcattgtcgattctggactgcagttttgcctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaayaaacagatatgcccacttagattggcattagtgggtttattggaaggagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaattt

SEQ ID NO: 89259 - DNA, 601 bp, Human
cctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaacaaacagatatgcccacttagattggcattagtgggtttattggaaggagcaaggatcggagatacagtgcacattcttactgagactttgagcaagtcatttagcgaggtgattcagcccatgctytcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggc

SEQ ID NO: 89260 - DNA, 601 bp, Human
gagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggcacacaaattactttgtaatagctctaaattctttgctttatcctgagtctacaattatgcacttatccatgctcctgtcatctgtggtactgatttatggaacctctgttctctgatctcctcatttcttacctctgcctcctttaaaactcaagaaatgtggcagcaaggtcaaatttctcatcgggccagcattacattctcaggtgtaatcattaccg

SEQ ID NO: 89261 - DNA, 601 bp, Human
tccacaatggtctgtttaatccactagataattgctaagccttaattatataacccagcatactgtcccttgctataattccagaaccaccatgttgtggtttgaaacatctattaatttggtgcaaatattaattaaaaatttatttctagccaagaatatgatggatcaagtgccatgtattaaaaaaggaaaatataattaatcttaaccaatttcacttggagcaaaaacaatgtaactggaaagttttctggtaactgccacacactcacagacttttttcaaaatttgaaaaaargtatgtctaaattttaaagtattgcagtatcagtttggtattatggtagaggatttataagccatgcaactgcacaaaatttttgatatcgttaataaggcaaagatatattacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgcct

SEQ ID NO: 89262 - DNA, 601 bp, Human
gtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaatcctacagagatgaaaacatgaacatttgcattgattaaagagaaaaatgaaagaaagaaaaagtatyactctaaactgttttttttccttttcttactctgttcacttcacttctaataatgtcttacacttttgggggtgggaggaattaatgctgtgtgttcttttattgctcatatcttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctg

SEQ ID NO: 89263 - DNA, 601 bp, Human
ttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcartacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaacagaacgacaataataacaacaaaataaagcaggttatacaagctcgtatgcatctcagatgaagaactttcctctagtaataggctccttttcc

SEQ ID NO: 89264 - DNA, 601 bp, Human
ggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcaatacartttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaacagaacgacaataataacaacaaaataaagcaggttatacaagctcgtatgcatctcagatgaagaactttcctctagtaataggctccttttccctaaa

SEQ ID NO: 89265 - DNA, 601 bp, Human
ttttctataattaagcattacatttggcagttatgccctcaaaactgactatatcaacatttaaggtcatgtatttgtaggcttattgggggctgtatcaaaaaaaagtcactaatgagagatcatctacaaatccaagaaattcagcatgctagtgtagatgtgaaagtgtggttttcataatgctccaaatattttctttttctggataacttattttaaggagcccttcagtaaacagttctgatttgacagcaataaccaaccacaaacacaattagtcagtatattagataagccygagattggttgaagaataatgcaaacctcaaaataacaatgatgtaaatgacatagaaatttatttctctggaatatgaaataatgtaaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctc

SEQ ID NO: 89266 - DNA, 601 bp, Human
aaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctcgatggtcatgaatctagtcttgaccacctgcaagggaagctgggaaatgtagtcttttattgtaggtggcaatgtgcccagctaaaamttagggtgctaaaactaagggaaggaggtgaaatgggtactgaaggaggcaacacctagttttggtcatggtcaggttctctggctccttgacttgctatcattgtcagatcatacagtgacttagctttccatgcatattcatatttatttatataaatcaaaccttttgtgttttactaacataaatataaatatttgaaacaaacataaatatatgtgtttacatagaaatatatatgtaattgtagaaattttgaaatgtagataattagaaaaaagtgctaagcaatcataaaac

SEQ ID NO: 89267 - DNA, 601 bp, Human
attattttagagagtcagttaataattgcctgaccatcatctgatggttgcctgacattcctgggtgggggacgggacgatggtctctcctgtcctgctcatgtctgaccagccacctactgtaacactattgttaatcattttgagtttttctgtattataaaccacactgcaattaacatctttgttactaaatctttgttcatatccacaattacttttagaagatagtttttctgatcaaataatatgcatatcttaaagctttgatatgccaaattcctctccagaaaaattaacrttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccttttttattattgtggaaagatatgagaggagagaaagaagctcatgggctcaaatttggaaacactaacttcagactgaaaggaaaaagcctctggttctgaagataagtcatgtatgctaact

SEQ ID NO: 89268 - DNA, 601 bp, Human
taacatctttgttactaaatctttgttcatatccacaattacttttagaagatagtttttctgatcaaataatatgcatatcttaaagctttgatatgccaaattcctctccagaaaaattaacgttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccwtttttattattgtggaaagatatgagaggagagaaagaagctcatgggctcaaatttggaaacactaacttcagactgaaaggaaaaagcctctggttctgaagataagtcatgtatgctaactcagaatggcaacataaaaggagaggttatccttccatttcaagaggcagtcaatgaagttgtcacctgacctcttccaataaggtacccagatattttcctcctttgaagaaagaagccaccatgatcttggctcgcattgtgttgagtttgaaggacactgcttcatatgtgatt

SEQ ID NO: 89269 - DNA, 601 bp, Human
ttgaagaaagaagccaccatgatcttggctcgcattgtgttgagtttgaaggacactgcttcatatgtgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcaygtttcactacatttaaagccaatacagtaagtagccagatcacaatatgccaaatagctgtttgtagcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaa

SEQ ID NO: 89270 - DNA, 601 bp, Human
tgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcatgtttcactacatttaaagccaatacagtaagtagccagatcacaatatgccaaatagctgtttgtakcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaaaacttcaggtaattgcatgcctaaatagtaaggtacaaataaaaacaggaagaaaaaaataatcctc

SEQ ID NO: 89271 - DNA, 601 bp, Human
gatgtgcaaaacagacaaatctctggtctcatggctcaccacagaaaacacaggtacttgtatttttttgcagggccttgttaggttacctgtacccaaaggatttaggtaactcttcctttatatattttccattttatttatttatttatatagaattatttgcttgcttatttacaatttgtttgtttgtttaaattataaaagtaatatgtgtttatgacagagaagtaaaaacagaccagaagtataaagtttctctctcccctgccctacccagtccttccattaagagataacmaatgttaaagtgttgcatgtgcatcctttcagaaatttttcatacatgtgcaagcatagatttatgttatatataaatattatcacactattttactttttcatgtaactgctgtagtgatagcaccataatgctggtataaaagggactccaccagggcaatctggttggaaagatggtcttgaagctccattgcaaaacacttatgtaaaatagaatatcaattgttcatatcaaagaaaggaatgtgctggaaagtggagacagtaaagccccagcaagtaattccttggttttacc

SEQ ID NO: 89272 - DNA, 601 bp, Human
ccaattttccagtttgcagttaatgggagaggatgttgttttcttaaggctttccttgtagaaagaaagtgctgagtaatgcggccacagaactagttctgctagcttaagtttcaaagtctacctacccatttgcaactaggatccaagccaggctttacatgttcagctttctctgagcttttgataacgaagctgtttacattagtaatccagctaaactgtggagtggcatagtcccatttacattgagaatcatttttgttttagcttgtgggagtgtaaattactattaaaggarttccatttcaaatccaaagaacattctattgagaagaaaactaataagagagagggaaccacgaaggccaagtctgagctgctgacagcaatgcagatagaaagaaacaaggcaaggcagagaaacaagttcagggaattgaataagaaacggtgtcacagtcacatgatcacagtcatatgatcatgaaacaaaaggtatggtagatatttgcctggaagtcccttaggaaatgatggcagcaagaccagacggcaaaaacaaaaagttgaacatctttgccattttcatttcatgtcc

SEQ ID NO: 89273 - DNA, 601 bp, Human
acggcaaaaacaaaaagttgaacatctttgccattttcatttcatgtccaaatgcttcttagaaacatacaaccttattggcattaacattttgacattttatgtatagatcctcttctaaatagagtttaggtttatattcatattattgtagtaaaataacagatgatcactattttttcaaagattaaaaaatatgactcagaaaaatgcgagcattggtaatttagttttgggctttgtcaaatatcttttaaaaaactcagctaataatacactaaggcttctcatacataatttrtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagca

SEQ ID NO: 89274 - DNA, 601 bp, Human
ggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatrtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggc

SEQ ID NO: 89275 - DNA, 601 bp, Human
ttgggatgtatctgtgttgattaaagtaacgttgttactttttattgctgtataacatgccatggtaggtaaataccccagttggtcagctaatggatttttgaattgtttctaatctcttgctgtcacagacaatacaacatagctccttgtgcaaatgtgggtgagtatttctagatatttacataagagtgggattgctggaatgtagggtatgcacaatttttaaatttcctagatgtattaaataacaccccaaccagaagtgtgtgagctttcctattgctcatatccttgccaygttggcactgttagacttttaaatgttcagccaattttaactggtgagttttcccttaaaaaccctgaagagggcagcatatcctggtaattgctgcatcttatacctgcattccagtttatgggtccctcccttctttactggttgaaatcctttgacctcagttactcttcaacccactctctcacctcagtcagctctgggcagtatcttagaaggacagacaatataacactatctcaaagctgaaagttacctccagctttttcattccacattcctggcacacttctgtcctct

SEQ ID NO: 89276 - DNA, 601 bp, Human
ttttaatttataacttttaacaattagacatatggcacatggacttggatttgtagtgttaatctgggcaagtaaaacagggaggtctgagcctgtgatttacaaaagtctacatatcagagaattccatttcatttaaaccatcttaagatatatggatttcctatttatgaaaatcacattaggttaatcacgaatttccattatgcacaggaagactagagaaagccaagggaaatagtaagttcaaaggaagacagtccctctagtgacctctttccctctctacctaagcataccrctatccaaatatcactgaatgtatgtcttatgaaactgtatatctctatgtagaggtggaaggagaaaaaaacatgaaagatgatgtttagaattaacaaaacgttagttctctagctgtaaaacttgtttgtactccctgactataaagcctcaaattcaaattgagcatttccagctgagtgaaaggtgcctgcctgctctgagttcctgtcacagttattgctgtacataagtcatttggcaagaaaacacacacggtcttaggctatctttcctactacaaaaaatatggactaat

SEQ ID NO: 89277 - DNA, 601 bp, Human
agaattaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgg

SEQ ID NO: 89278 - DNA, 601 bp, Human
attaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgggat

SEQ ID NO: 89279 - DNA, 601 bp, Human
ctgagtgagcctgagtaagccactgaagaccaggaacccgtgtagtcatatgacgtataagataccctctattctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggctwaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtat

SEQ ID NO: 89280 - DNA, 601 bp, Human
ttctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtattgtacttgcccctctactaagggtggtgctccaaccctcacactgatatgtcaactgcccataaccatgcc

SEQ ID NO: 89281 - DNA, 601 bp, Human
tctttgccatatccttgttttccagcttttgtatatgcatccctacatttttagtcaagaagctggcagtcacatgctgtccatttgccaatgttggaaatgactgttggaattcaatggtttcccccaccactaagaaaaatgcttttcatttaattcataataacaacagtttgcatttatgttttttatctgtttcaaagcactcctctgccaccattaatgaactaaatcagcctttgctattttatgatctgtctcattaaaatggagttgattttctctgtggtagtcacttgcrtaatgttgttttcttctagcaaaccctgcacttaactaatgtaaattcatttttaaattgtgtgtttacacagaaaattttccccaaatatatttttaatgctgcatcctttcaacagcattacagggagtattttattctatatagacattttaaactataaagacacttaaatgctttaatgtagtcttctctaagtacttgtaaattatttataaagaccccctcaagtaaatgtgttgaaactgccagtggtagaaacagaaattgtttgctctgtgagccctattaatacttaat

SEQ ID NO: 89282 - DNA, 601 bp, Human
gcagaatccctggcctctagtgcctaatgcctatagcatccctccctctctcctagtaatgacaatcaaaaatgtctcagacattgccagctgtctgggagggaaaacagccccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgawttttaggggacaattcaaaatctcttccacacagctgtacttttgaagctttctatcatattagccagtaagttacctttacaatttaaacaatttggaataggtttttcggtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaa

SEQ ID NO: 89283 - DNA, 601 bp, Human
cccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgatttttaggggacaattcaaaatctcttccacacagctgtacttttgaagctttctatcatattagccagtaagttacctttacaatttaaacaatttggaataggtttttcrgtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaagagaaatatggtagaaacggaaaggccatggtcacaggagcccacggtcactgtagtagttaagaaaaaaggcaatataattatgctaaattaccaaaatgaaaactgcag

SEQ ID NO: 89284 - DNA, 601 bp, Human
ttttttctttttggtcatcattgctttctgatattttttctataatgaacatgcattacaatatgaaatgaaaaaatgtttaagaaaaacagtagagattttcctttcaaccgtgagcattggtttctagtgacctgaaggtacaacattcatccattagtaatgggagctgtaaatgggaattgtcttgcctctccagtgacttattaatctttgcctaatggggctttagggaacctgctcaggggatctttatgctccttttcccattacttcagtgtgtaccggtctcttctctttkcctcgaacacttgaagttcttctccacctaggaatatttaggctcagttggcctcatctcacccttcaaccttcacatctcagcttaaatgttaattccatagatgccttaacagagcaatctaaaacctaaattcccttcctactttactactcaccatatcatccttggtatttcctatattatctctattctgcttttctcttacagagcactcttgtcaacttgtagtttcatgtcttttgtttctatataaacttagtctattttcccccacagtctgaagtttcattgtgaaga

SEQ ID NO: 89285 - DNA, 601 bp, Human
acagcagaagcagcagccactcaggagcctgagatattctctgcaaactactgtgtgggcctcagcaagacattcacctccttgtgcttcagaaagctttgcccaaaaaggacctttttagttgttttcttgctatggcaatgacatgaagtccctttcagctcaaaattcctataattttctgtttaaaaactccaatacaaaatatgttaactggctgggtgcagtagctcacacctgtaatcccggcactttgggaagccaaggcaggaagattgctcaagcccaggagttcaagacragcctgggcaacttaggaagacccttcctctacaaaaaaatttaaaaattagctaggtatggtggtgcatgcctgtggtgccagctattccagaggctgaggtgggaggatcacttgggcctatgaggttgaggctgcagtgagccaggatcatgctactgccctccagcctggacaacagaccctttctcaaaaaataaaaatttgggagactgaggtgggcagatcacgaggtcaggagatcgagaccatcctggctaacatggtgaaaccctgtttctactaaaaatacagaaaatt

SEQ ID NO: 89286 - DNA, 601 bp, Human
cgcgctggagcggcatggtggccataagacgccccggagggacagctcggggggcaccaaggacggggacaggcccaagatcctgatggacagccccgaagacgccgacctcttccactccgaggaaatcaaggtgcgagcggtgtggaggaacccgattccccttgactaatgttgaggagaggaaccctccactagattcccgtcacatcctttcgaaaaacaccagaacggagagggaggtggtacattacccggtgcacttaaaagccagatggtcctgtaagagttctcttagcgktccaagaacctgtgtctaattaccaatatgagaaagtcaccctgagggaggaggtgctcacttggtttaacatcattaaggagaaagcagctctgggacagagtttcaaattcttaattaattcagagtcgagctaacagtaattgagccccagcttctgcttttctcttaggtgtaattaattgcactgctttgagacaaattccctcacctttacacaaactggagcttttgtaaaagttagtttgggaatttatccattttggaggcaaaccaggtacatatacaagctgaaagtag

SEQ ID NO: 89287 - DNA, 601 bp, Human
aggtgctagaagcctgcttaactccctgaagagtcttttccagcctgaaccttctgctctttttaagtctttggcttctgactgggaaaaaatctaaaaggtgcatgactacatatgtcatccagatagatttggatgagtttatttcttattctggaatacctcagttatacggagcttaccacactggaggttatcatttatcctaatgagggttcagtctttgtcttgctttattccccagtccctagacagaactttgtgagtagtttttcccttcctcaaaatctggatttgcctrttttcaagttgacagctctagaattgttcctcttaaattttcatgtacagtcatacatcacttaatgacagggacatattctgagaaatacatcattaggtgattttatcattgtgtgaacatcatagagtgtacttacacaaacctagtctgttctcatgctactatgtagaaatacccgagactgggtaatttataaagaaaagaggtttaattgactcagttccgcatggctggggaggccttaggaaacttacaatcatggtaaaaggcacctcttcacaggacggcagaagagaa

SEQ ID NO: 89288 - DNA, 601 bp, Human
tactgatacatgtaattttaagccacttacaagctttttagtcaaatttccacctagggaaaggaaacggacccctcactgatacgaagctaattccacgttctctacagacttctgtttctacacttacttcctcaaaatgttatttactccttatggctcagttttctgcacttcatgcttttctcagtttcttgctgtgatatggttgggtcacataaacggggcttgtcccctgaaaaatgacattgagggaattggcagagctggggcatagcagattttccctggaccagtcccrggatctggcgaccagaaccatcccacgcgttctttggatgatggcttggtaccttctggctggccaaacgtcactatccagtgttctagcattatgaaatcctgctcttgtagcagcttctcagtgtatctgaataatccagatactcaagcaagagtttggaaggaacttgagtgtaatggagttaaagagcctttagatattgggctttcaattttcccccccattttgaaatgtgcctcgtttagcctgttttctccacggcctctgtgtaaacagactgcctcatcttctgttgca

SEQ ID NO: 89289 - DNA, 601 bp, Human
gcctcatcttctgttgcattgcggccgggggtgcccataacttggacttagctactcaatcctcacttagcctccagcttctttgtggttttgccagcccagcctgaagggagaaggaagtcttattctgccgtgcgtgtgggattaagttatcgagaatagcctccttgtgatctgacgcagactcactggctgggccgtgtcttccaccagggcatctgagttgactactgagttgtatgctagtcacccagattccaaaagggttttctcctctcctctattctgcactcttggaacsagtgcatccttcaagagaatgtaaatctgcattgagggaacaagagacaaggaaaatgagatgatgacaacataagtaaggctgctcctagaatgcctgattttcaaagtaaagtcctgttaccatctcccaacagagctgtccagttctcccccaggaccctaccatcaggagccctacgtctgcaaacccgaagagcgctttcgggcaccccctattctccccccacatctcctccaggtcatcctgaacaaggacacggggatttccgtaagtatgtgggcatctgcccggaccatc

SEQ ID NO: 89290 - DNA, 601 bp, Human
acagggcttgcctttctcaggtcacctcctgtgctgggagtgcccctgcagctgggtagccatcctggtataggcccagaagaggccagtggtaaggacagcacgcctcagctggcagggcccaccatctttccagcactgagttggcaacagtctcaaataggtcacaggtgaagagtttcaaggacatgtagcttctgccttagaagcacttagttgacactgcttcccttagctctaactttacaaaggttggtgggtaagatgactttcagtgccctcctaagctagtgaggtttgtttttttttttttttttttgagacggagtcttgctctgttgcccaggctggagtgctgtggtgccatcttggctcactgcaagctccgcctcccgagttcacgccattctcctgcctcagcctcccgagtagctgggactacaggcccccgccaccacgcccggcaaattttttgtatttttagtaaagatggggtttcaccatgttagccaagatggtctcgatctcctagcctcgtgatccacccgcctcggcctcccaaagtgccgggattacaggcgtgaaccaccgtgcctggcca

SEQ ID NO: 89291 - DNA, 601 bp, Human
ctcgctttatgaagcggtgttactgctgctgcagcctttgggggcggagggcggagggagggagagatccagcaccgggttgcctctgagcgattctcctttcgctgtagggtctggtcgcctacggatccctgagtccttctgtaatattggttcctggagtaaactgatagggcgctaaatagagcgtaattgagtcaagacagaacgcttcctctgcgagcccgccttgcagtccgggcggtaggaactgaaatcgatcacagctcgttagagtacgtcactgtcgtcacgagtaggraaaaaaaaaccggaaaacaaaaacaaaaaacaaaaaaccctttgagctcctttaggtaaagataaatctttttaattttccaagacgtggcgatatattttcaaagtttgaggatccctagatttctagcgtgtgtgaatttgtaatttctgcttttttttgcgtttgcaatacaacacgcgttgaatgtttgttaaacactaaagcacactaaatagcttcgggcaaaccatccccggcctaatcactcattcccagattctacgttttgtatttttatgacttcacattaaaagtcac

SEQ ID NO: 89292 - DNA, 601 bp, Human
atttcactatgtgcatccattgcatttgtgggtgtttggcattatatgatatatctttgttttatatcacactgcaagcatgcaatcaaatctgaagaaaattactgaaattaaacatcccttaacagaatgccagatgtcatgctctgtaatgttttaatagctgttttaatttctgtgtttcagcagagaaaatagaaaagttttcaatcccaaaacttatctaactagctaagcagaaatatgaaatgttttaaaaagaactgcgtaagtttttaggtaaaaaaaaaaaatgctgctwaaatctaatttccgatagaaagcgtattcaaaatttggcatgaaatttattttgtcaatttagtagattatttttgaagaaaaagtgtaaatgcagacatggatataaagttgaaatattcaaaatttagtggaaataatgtcacatctgaaatctatcatcagtacgttttacgtggaggaggataataactttcagatattagtacagaggtattatttaagattaaaatatattttctgagccacattagtagcttggttttatctgctgtgaataaaacacatgacattaaatttg

SEQ ID NO: 89293 - DNA, 601 bp, Human
cagaacatttaggctgtgaaaggacaaaaaaaatcattctttagtatccctctgtgtaggaagtcaaaatagcttgtatatcatcttattttgtcttcaaaatgactaactacctcattctcatagtagaaataccttgaaattagatacagggaaattaaaacagagaaaagataaaattaaaacctaagtttcttgatttttgacacttcaataatgtacttttttctttaacatttttggacaggaaattctaagttaatattaagggcaaacagaatattagacttggtatttaacrtatttttatatatatatataataatatgatcactgcttgtccatttttccaaaattgaagtaaatgagtattttacctaccccaacaatccgcttcatagcatccagtttagcagaatctttgttgctctctaacatttgctttagatcttcattcctattacaaaagagaagaaaaaaaatccatactttgatttttatattagatagcttaaaatatatcattttcataagaattagaagtaatatcatgggcaatgttaaataactgcagcaagaaggtggccatctgcaggccaga

SEQ ID NO: 89294 - DNA, 601 bp, Human
atatttattagaagttctaggcttctaaactgaataaagtgtttctattggtagtaagagaatttaaaaaacagatgaaagtatgctcagaacatttaggctgtgaaaggacaaaaaaaatcattctttagtatccctctgtgtaggaagtcaaaatagcttgtatatcatcttattttgtcttcaaaatgactaactacctcattctcatagtagaaataccttgaaattagatacagggaaattaaaacagagaaaagataaaattaaaacctaagtttcttgatttttgacacttcartaatgtacttttttctttaacatttttggacaggaaattctaagttaatattaagggcaaacagaatattagacttggtatttaacatatttttatatatatatataataatatgatcactgcttgtccatttttccaaaattgaagtaaatgagtattttacctaccccaacaatccgcttcatagcatccagtttagcagaatctttgttgctctctaacatttgctttagatcttcattcctattacaaaagagaagaaaaaaaatccatactttgatttttatattagatagctta

SEQ ID NO: 89295 - DNA, 601 bp, Human
gtggaattaagcaagttttttctctgtgaatgtggaaaatcaaatgagtacgtacagagagtgcaacataaattgcaaaactattttactaaagatggtatatacaactagaaccctggaaaaataaaaaattaaaattaaaacattaaaaataattaaggaactatattatatctttaattctctggcaatagaatcctcataacttattaatcaattgtttatgttttgctttacagctgaacactggtgaatgctcttatatttaataatatttattagaagttctaggcttctaaastgaataaagtgtttctattggtagtaagagaatttaaaaaacagatgaaagtatgctcagaacatttaggctgtgaaaggacaaaaaaaatcattctttagtatccctctgtgtaggaagtcaaaatagcttgtatatcatcttattttgtcttcaaaatgactaactacctcattctcatagtagaaataccttgaaattagatacagggaaattaaaacagagaaaagataaaattaaaacctaagtttcttgatttttgacacttcaataatgtacttttttctttaacatttttgg

SEQ ID NO: 89296 - DNA, 601 bp, Human
ctagcagtcaagtttgtacattatccaagtacacaattaatacaccatggtaaatgaaatttgaaccatattgttaggggattggtgtcacttaactaaactgtagtaactgaaattcatatgtataaaagccatgcaaagcaagaactgcctgcccataaatactcctatgtatagagcataacattaacaaatcaaaaatttacaatggaatcctcaaaattgcccctatactgccaaatgacataaacatgaaagcaaggatcaagtcacttacagatgtcctacagatacaattagwacttgactttaatatatttgattttcataccacctcactttttaacagagcatgctgatacctgttatttggactttaatatatcaagaaaggaaaagagatctgaagctctcatacgatggcactgcctgctggaaaacagtattgttttagttgtgtcatcgccttattacagtagtttatttaagcaattatgcaaatgtattcaattttgaccttattatataaaattaagtggaaaatagaatcagcaatggtggtgataaaaaggatagtgttaataagaaaaatcagttttat

SEQ ID NO: 89297 - DNA, 601 bp, Human
aagaagtgacatgattgatcatggatcatgatacatgtttgtaatttacaagttatttgtagaatgaagagctagcagtcaagtttgtacattatccaagtacacaattaatacaccatggtaaatgaaatttgaaccatattgttaggggattggtgtcacttaactaaactgtagtaactgaaattcatatgtataaaagccatgcaaagcaagaactgcctgcccataaatactcctatgtatagagcataacattaacaaatcaaaaatttacaatggaatcctcaaaattgccccyatactgccaaatgacataaacatgaaagcaaggatcaagtcacttacagatgtcctacagatacaattagtacttgactttaatatatttgattttcataccacctcactttttaacagagcatgctgatacctgttatttggactttaatatatcaagaaaggaaaagagatctgaagctctcatacgatggcactgcctgctggaaaacagtattgttttagttgtgtcatcgccttattacagtagtttatttaagcaattatgcaaatgtattcaattttgaccttattatataaa

SEQ ID NO: 89298 - DNA, 601 bp, Human
tagttccacagccagctacttctgtataacttcatttatattctacctgattttcattacatgttatcacttttcatttctttgctgtattttcactttgttgggcaaatgcctctttcaattattcatttctgtaaaatgtcacatgtgtttcttactgggagacaaagaggcaacacaactacatgctttgttgtctgtgcataaactgagtaacagatgcacagtgaccaatcactgacagattttgaaagaagtgacatgattgatcatggatcatgatacatgtttgtaatttactagttatttgtagaatgaagagctagcagtcaagtttgtacattatccaagtacacaattaatacaccatggtaaatgaaatttgaaccatattgttaggggattggtgtcacttaactaaactgtagtaactgaaattcatatgtataaaagccatgcaaagcaagaactgcctgcccataaatactcctatgtatagagcataacattaacaaatcaaaaatttacaatggaatcctcaaaattgcccctatactgccaaatgacataaacatgaaagcaaggatcaagtcacttacag

SEQ ID NO: 89299 - DNA, 601 bp, Human
tctataggtgtcacatcaccagtaaaacctcaggcctgataaccaggaattcatcctgatgcacactaatactgcagaaaaatcttggtcttttaaacaatttccaacccaataattttttaaaagatgcaagcaacagccccaagttgaatcctttaaagcatacatagaaccaaagcattgttattgaaggaagaaagggaaagaacaagggataaacagtccgtctggaaagatttatacaaaactatttattacagtcattaactcaaaacagtataccacctgactcagctaattytcctgttttgacaaaaattttaagcatcatagatcaattgtaatttttccagttggcttattaaaatttctttccatggtttctgcttgcattcctgcagggcatagacctgcactaccatgcaaagtagggactgcccttatttatttctttaaactatggctcttacatcccattaaggtaatttatttcactaaatccctggatactatttaaaatttctgtcaaagcattaataactcttttactgtcagttataaatttataggaaagtgaaaaaataataaaaatcaatattta

SEQ ID NO: 89300 - DNA, 601 bp, Human
cagaagtggtaaaagcaagcatccttgtttctgaccttggagtaaaagatttcagtctttcactactgagtgtgatgctagttttgggttttccacacctgctctttaacagataggttgaggtagtttcctcctattcctagtttgttgagtacttttatcatcaaagtgtattaaattttgtcaaatctttctccgaataaattgagatgattgtgagggatttttccctttccttctgttaatgtggtatattacaatgactgaattttgtgttatttttaaattacagtcgtgccaygttttggtcaaggagggaccacatatataatcttattgtaagattataatactgtatctttactgtaactttctatgtttagatacgtttagatacacaaatacttaccattgtgttacaactgcctacagtattcagtacagtaacatgctgtacagatttatagcctaggaagaatagactatgccatatagcctaagtgtgtagtaagcttgtgtaagtatactaggttgtgtaagtactctatgaggttcacaccaacaaactgcctaaggatgcatttctcagaaagcatccctg

SEQ ID NO: 89301 - DNA, 601 bp, Human
agtgcaatggcacgacctcggctcactgcaatctctgcctttcgggttcaagcaattctccttcctcagtctctcaagtagctgggattacaggcgcccgccaccacgcctggctaatttttgtatttttagaagagacgaggtttcactgtgttgaccaggctggtctcgaactcctgacctcacgtgatctgcccacctcggcctcccaaagtgctgggattacaggcatgagccaccggttgttgttgttttttgagacgcggtctcactctgccacccaagctggagtgcagtggcrtgatcttggctcgctgcaacctctgcctcctgggttcaagcaattctcctgcctcagcctcccgagcagctgggattacaggcacccaccaccacacctggctaatttttgtatttttagtagagacgagatttgtctttttagtagagaccaccgtgttggccaggcttgtctcaaactcctgacctcaagtaatccgcccacctcgacctcccaaagtgctgggattacaggcgtgagccaccacacccagccatttggtaggtttttaatggttgagttgtgggagttctttatata

SEQ ID NO: 89302 - DNA, 601 bp, Human
gctcgctgcagcactgttgccaaaagctaagatttggaagcaacctaagtgtccaccaacagacaaatggataaagaaaatgtggggcaaatacacaatggagtactattcagtcataaaaaacaatgggatccagtcatttgcaacaacatgggtggaaatgaagatcttgttaagtgaaataaaccaggcacagaaagacaaacatctggccgggcacggtggctcatgcctgtaatcccagcactttgagaggccaaggcggacggatcatgagatcaggagatcgagaccatcctgrctaacacggtgaaaccccatctctattaaaaatacaaaaaaatacaaaaaaattagccaggcatgatggcaggtgcctgtagtcccagctacttgggaggctgaggcaggagaatggtgtgaacccaggaggtggagcttgcagtgagctgagatcgtgccactgcactccagactggtgacagagcaagactccatctcaaaaaaaaaaaaaagaaagaaagaaagacaaacatttcatgttctcacttacttgtggggtctaaaaatcaaaacaactgaacttatggacatagagagt

SEQ ID NO: 89303 - DNA, 601 bp, Human
gagacaactcatagaatgggagaaaatatttgcaaactatccatctcacaagagatttaaaaccagaatatatcaggaactcaaacaattctataggaaaaagtctaataatctaaaaatgggcaagatttgatcaaatgataaaaagggggcaaaagatttgaaaagacgttactcaaaagaagacatgcaattggcaaacaggcatattaaaagatgctgaacatcactgatcatcaaagaaatgcaaatctaaactataatgagttatcatctcaccccagttaaaatggcttatacycaaaagaaagacaggcaacaacaaatgctggtgaggatgtggagaaaagggaacccctgcacactgttggtgggaatataaattagtacaaccactatggaaaacagtttagaggttcctcaaaaagaaactagtaattgagctaccacatgacccagcaatcccactgctgggtacaacccaaaagaaagaaaatcaggagtgcaaagagacatccgcactccaatgctcgctgcagcactgttgccaaaagctaagatttggaagcaacctaagtgtccaccaacagacaaatggata

SEQ ID NO: 89304 - DNA, 601 bp, Human
ttatatggaaccacaaaagatccagaatagccaaagttatattaagcaaaaagaacaaaactggaggaatcacattacctgacttcaaattatactacaaagctatagtaaccaaacagcatgtactggcataaaaacagacacacagaggaatggaacagaatagagaacccagaaacaaatccacacacctacagagaactgagaaagatgcgaagagcatacactgaggaaaagacagtctctaataaatggtgctaggaaaactggatatccatatgcaggaaaacaaaattagatmcctatctctcagcatatacaaatataaaatcaaaatggattaaagacttaaatctaagacctccaaccatgaaactactacaacaaaacattggggaaaatctccaggacattggtctgggcaaagatttcttgagtaataccccacaagcacaggcaaccaaagcacaaacagacaaatcggatcacatcaagttaaaaagcttctacacagcaaaggacacgatcaacaaagtgaagagacaactcatagaatgggagaaaatatttgcaaactatccatctcacaagagatttaaaa

SEQ ID NO: 89305 - DNA, 601 bp, Human
cactggaagtcctagctagagcaatcagacaagagaaagacataaagggtctccaactggaaaggaagaaattaaagtatccttgtttgcagatgatacaatcttatattggggaaaacctaaagactccaccacaaaactattagaactgataaacaaattaagtaaagttgcaggatacaaaatcaacataccaaaatcaggagcatttctatatgccaacagtgaacaaggtgaaaaagaaattttaaaagtaatcccatttacactagccacacacaaaattaaatacccaggaatwaacttaaccaaagaagtgaactatctctatagtgaaaactataaaacactgaagaaggaaattgaaaaggacaccaaaaaatggaaaaatattctgtgttcatggcctggaaggctcaatattgttaaaatgtccctactacccaaaacaatctacagattcaatgcaatgcctatcaaaataccaaagacattcttcatagaaatagaaaaagaaatcctaaaatttatatggaaccacaaaagatccagaatagccaaagttatattaagcaaaaagaacaaaactggaggaatcaca

SEQ ID NO: 89306 - DNA, 601 bp, Human
ctcaacaaaatgctagaaagctgagttcaacaatacatcagaaagatcactcatcatgaccaagtgggatttatccctgggatgcaaggatgcttcaacatacacaaatcaatcaatgtgatacatcatgtcaacaaaatgggcaataaaaaccatatgatcatttcaattgatgctgaagaaccgtttgataaaatccaacatcctttcatgataaaaaccctcaaaaaactgggaatagaaggaacatacatcaacataataaaaactatatatgacaaacctcacagctagtatcatwctgaatgggaaaaaactgaaagtctttcctataagctctggaacacgacaaggttgcccactgtcatctctgttattcaacataccactggaagtcctagctagagcaatcagacaagagaaagacataaagggtctccaactggaaaggaagaaattaaagtatccttgtttgcagatgatacaatcttatattggggaaaacctaaagactccaccacaaaactattagaactgataaacaaattaagtaaagttgcaggatacaaaatcaacataccaaaatcaggagcatttctat

SEQ ID NO: 89307 - DNA, 601 bp, Human
tacctcgagacatttaataatcagactcccaaaggtcaaggatagagaaaggatcctaaaagcagcaagagaaaaagaacaaataacatacaacggagctccaatatggtggcagtagacttttcagtggaaacaggtaaggtttcctaacatatttaaaagtgctgaagaaaagtaactttcacctcagaatagtatatccagtgaaaatatccttcaaacatgaagaaataaactttcccaaacaaaagctgagggatttcatcaatgccagacctgtcctacaagaaatgctaaaggragtacttcaatcagaaagaaaatgacattaatgagcaataaataatcacctgaaggtacaaaactaactggtaatagtaagtacacagaaaaacatagaatattataaaactgtagctgtgatgtataaactattcttatcctgagtagaaaaactaaatgatgaaccaatcaaaaatggtaactacaagttttcaggacatggtacaataagatataaacagaaacaacaaaaggttaaaaagtgaggagacgaagttaaagcacggagtttttattagttttctttttgcttgtttgt

SEQ ID NO: 89308 - DNA, 601 bp, Human
ggggtgccccctaaagccaatatagcttagatcacaacacccacgttctttcaaatatctggaaagacttcccaagaaggatggccaaaaatatgccaaggcagtgaagactacaataaatacctaactcttcaatgcccagacaccaaagaacatctacttgcaccaacctctatgaggctgcaaaaaccacagcattattgggcttggggcccaagttcctatgaatactagaaagccttcccaagaaagataagcataaacaagcccaggcagtgatgactacaataaatacctaackctccaatgcccaaaaactgatgaacatctacaaacatcaagaccatccaggaaaatacgacctcaccaatcaaactaaataaggcaccaagcaccaattctggaaaaagagaaatatgtgacctttcagatacagaattcaaaatagctgtcttgagaaaactcaaagaaattcaagatcagagaaggaattaagaattctatcagataggccaggcgcggtggctcacgcctgtaatcccagcactttgggaggctgaggtagacggatcatgaagtcaggagatcgagaccatcctag

SEQ ID NO: 89309 - DNA, 601 bp, Human
acagcagggtagagcaccaagtgggctcttagcgtcttcaattctaggacttggctcttggacagcatttctggacatgtcctgggccagaagggagcccactgtcctgaagggtgagtcccaggccaagcagcattcatgaaaagtactgccagagttcccccgatagcttttcatgaatgctgacttaagagaccttgggcgttaagggactatgggggtactctggcagtactctttgtggcctggggtggtggtggctacaggttgaggctcctctgccttcagaaaggggaggaaragtgggaagcattgcaccttgtggtttgagtgccagctcggctgcaatacaacagaacactaggtagacttctaaggtttctgactctagtccctgactcccagggctcctagacagaacttcttgacccatccggggcctgggggagctcgccacccttaagggaaggacacaggcctggttggctttgctacctgctgactgtagagccccagggccttgagcaaacatggcaatagccaagaagcggttacagcaggccttgtgcaagacccagtcctgtgctggcttcaggtctga

SEQ ID NO: 89310 - DNA, 601 bp, Human
gtatgaataaattatatggggaaaaagttggatataaaagagaaaaaccatgggaaatatatctaactcatattcttagtgagatttgaggggatgtggcatttttttaaaaaagaatgactttggaatagcaaagaaaattttcagataaagatataattaccaaattttaaaatataatgagagaagaaaggataatgtcaaaaattctaaactgacttcaatgccagctcaaaaaaaatcctaaaaatgacaggaaaggttagagaggtcaatttgacaggggagaagacagaggcaracagaggatggatccaaaaaatataatacacacataataggaaggctaagagagaactggcagactgacagaaaagggagaaaataaatagcagacaaacattctctaagtaaaacagatttaaaattttagaatcaaagggttcattagtaacataacaaatcagtaaagaaaaaacacagaccgtatcttgaatattttctttttcctcaaaatattaaaaacatctacatatccagacagttgaaacagattctctaaaagagaaagagaaaaagcaatctcagaggcagagcaaga

SEQ ID NO: 89311 - DNA, 601 bp, Human
ccactggagaagtatgaataaattatatggggaaaaagttggatataaaagagaaaaaccatgggaaatatatctaactcatattcttagtgagatttgaggggatgtggcatttttttaaaaaagaatgactttggaatagcaaagaaaattttcagataaagatataattaccaaattttaaaatataatgagagaagaaaggataatgtcaaaaattctaaactgacttcaatgccagctcaaaaaaaatcctaaaaatgacaggaaaggttagagaggtcaatttgacaggggagawgacagaggcaaacagaggatggatccaaaaaatataatacacacataataggaaggctaagagagaactggcagactgacagaaaagggagaaaataaatagcagacaaacattctctaagtaaaacagatttaaaattttagaatcaaagggttcattagtaacataacaaatcagtaaagaaaaaacacagaccgtatcttgaatattttctttttcctcaaaatattaaaaacatctacatatccagacagttgaaacagattctctaaaagagaaagagaaaaagcaatctcagag

SEQ ID NO: 89312 - DNA, 601 bp, Human
agctactcaggagactgaagcaggagaagcttgaaccccaggggcagaggttgcagtaagccgagattgcacaatgcactccagcctgggcgacaagagtgagactccgtctcaaaaaataaaaataaaaataaaaattgtatctttcatcaaatttgggaagttttctaccattatttcttcaaatattttttcctactccaatctctttctcctctccttctgctgttctaatgatgcatacgttagacctttagaatgaaccaacaaaactccaaggctctgttcttttcaatctctrttcttcagaatgatttttttctttttctttttttttttttttttttttgagacagagtcttgctgtgtggcacaggctagacggcaatggtgccatgttggctcactgcagcctcaacctcttgggctcgagtgggctttctgcctcagccttctgtgtagctgggaccacaggcaccctccaccatacctggctgattttttggtatttctgtagagacagggtctcactttgttgcccaggctggtctcggaactccttggctcaagcaatcctcagcctcctgaagtgctgggatta

SEQ ID NO: 89313 - DNA, 601 bp, Human
tatgtaccattttttcccgctactttcaagactttatttttggttttcaaccatttgattactgtgtttatgcgtggttttcttttagtttatcctaactggcatttgctgagcttctttcatctataaatttgtatcttggctgggcacggtggctcatgtctgtaatcccagcactttgggaggctgaggagggcggatcacctgagatcaggagttcgagaccagcctgaccaacatggtgaaaccccatctctattaaaaatacaaaaactagctgggcatggtggggctggggagsgggggcacctgtaatcccagctactcaggagactgaagcaggagaagcttgaaccccaggggcagaggttgcagtaagccgagattgcacaatgcactccagcctgggcgacaagagtgagactccgtctcaaaaaataaaaataaaaataaaaattgtatctttcatcaaatttgggaagttttctaccattatttcttcaaatattttttcctactccaatctctttctcctctccttctgctgttctaatgatgcatacgttagacctttagaatgaaccaacaaaactccaaggct

SEQ ID NO: 89314 - DNA, 601 bp, Human
ggaggctgaggcagaagaatcacttgaacccaggaggcagaggttgcagtgagccgagatcacaccactacactccagcctgggcaacagagcgagactctgtctcaaaaaaaaaaaaaaaaaaaaaaagaaaagaaaaatgcagaaacattgcaaccatatagactcttttatttccacctccccactagcttttatgtttagccacccatattaaaaacctctcagatagtgggataacttaagaataaaattagtcctttatacgtatttaccattttgattggtccgcctaaatatmcatctggtatcatttcccttcagcctacacaacgtctattaacatttcattaaagtaaacatgttagaaatggatactcttagtctttatttcatcttcgttcttgaaggatattttcaatggatatagagttctgggttaacagttctcttctttcagtacttgaaacatattgttccactctcttctggctgccatgatttctgatgagaaatctgcatttattcaaattattgttcccctctatgtaccattttttcccgctactttcaagactttatttttggttttcaaccattt

SEQ ID NO: 89315 - DNA, 601 bp, Human
ccttataacttatgtctttatattaaaagtaggtttcttacaaagagcacagttgtatcttcacattttcatccaatatgaagatctctttttattggtaatgtcagaccacttacatgtaatagaattattaacatggttagattcaggtctaccattttagtatccgtttcctgtttattccctgtattttctgttctcctacttcctcttttctcttttccttagaaaatttttagtatttcatatttttatattaactttctgcctatatctttttatataatttactggttcctcrtaaaaatgcatcataggcataatctatagcaatagcggtttaaatgaatctcctttgtgctcaaacagcatatctttaacttatcggattatcagatacataggtagataaacagacatataaatatataaatacagaaacagcaaaccttacacagtctacttacagttaacactgtaccagatcaagaaaaatgcagaaacaggcagggcacagtggctcacgcctgtaatcccagcactttgggaggctgaggcaggcagatcacaaggtcaggagttcaagaccagcctggccaat

SEQ ID NO: 89316 - DNA, 601 bp, Human
gagcctgcacgcctgttcacattccagtgtttcaaaggagtgtctttctccttgaacacagtgtttacagataagaaagcgggtctccctctgagcatgggaacatgatggcaattaggagactttcctcctcagaggcctcttgtggcttccacaacttattgtcccatatttttatggccagtttatacagacaccccacaagcccttttcccaacatgaagaaaggaagaaaccagcaaagaagctcttagactccttgaacctcagtttgaaagcgggcagtccttctcagtattcytccttatccactcaaataacatacttctcccaccctctctcccttctgctttaggtaaaaaccctgttcctggtccccttgtactcttttacccagaacaaggagcataggaattgaggggagccacatttgggccctgagggaaaagtaaggttcataggtggaaagcataggagaatatgtcctttttcattttatttggttgaagttcctgatatttgaaaaagctgcagtaccagcgattctgccctttgaaggtgactctctagataaaaggtgagaaaggaagacaagttttca

SEQ ID NO: 89317 - DNA, 601 bp, Human
actccagcctgtgtgacagagtttgagactccaactcaaaagaaaaaaaaaagaagaaggactacaaatgactaactggagaaatggaattgccatttactatgatgagaaagactagggaagaagcaggtatttggggagatgagcaatccagagtttggtttcagatatgctgagaagccagctgaatatatgggaataaaggctacagaatacaggagacagcactggttagcaatatgcatttggaaagggatgagatcactacaggagggcatacagacagagaagtagactgagygacaagacatagtacaatcctaaaagtagaaattgtggccaggtgcggtggctcacgcctgtcatcccagcactttgggaggccgaggagcgtggatcacaaggtctggagatcgagaccatcctggccaacatgctgaaatcctgtctctactaaaaatacaaaaattagctgggtgtggtggtacgtgcctgtaatcccagctactcaggaggctgaggcacgagaatcgcttgaacccaggaggcgaaggttatagtgagccaagatcgcacccctgcactccagcgtggtgacaga

SEQ ID NO: 89318 - DNA, 601 bp, Human
atggtgagagataaggtcagaaatgtataaaccactgtaaaatgagttggcttttactatgagtgaagcaggagaccaatggagagttgtgagcagaggaaagacatcattaaatatttagcaatgactcatattttaaaaggatctttctggctgcaatgtgaaaaatagaccagaagatatgataccatggaaaacagaaggctacagcaattatgcagaggaaagatagtgagcacagtgagaatgggctagatttgggatttattctgaaaatagattatatatgatataagaaagragggacatgaattaagaagaactactgcctgtaatcccggcactttgggaggccaaggctggcagattacttgaggccaggagtttgtgaccagcccggccaacatgctgaaaccctgtctctactaaaaacacacacatacacacacaaacacaaaattagccaggcatggtggcagatgcctgtaatcccagttacttgggaggctgaggcaggagaatcacttgaacctgggagccggggattgcagtgagccgagatcacgccactgcactccagcctgtgtgacagagtttgaga

SEQ ID NO: 89319 - DNA, 601 bp, Human
aaactctctgacctaaggttctattaaaatgaccttactcactactagaatattctctggctgccccactatgcctctgctcagatcatggccccagctttctaagttctccccttctatctaaagcatcatcaaattttactccttctcccttgctacagccatctcctaacacctgggccactgtgtcacccaatcctaatttctttcagaatttttttttttaagacagtatctcactctgtcgcccagcctggaacgcagtggcacaatcttggctcactgcaacctccgcctcccrggttcgagcgattctcctgcttcagtctcccgagtagctgggattacaggcacctgatgccaccactggctaatttttgtatttttagtagagacgaggtttcgccatgttgaccaggctggccttgaactcctgacctcaagtgatccacccccctcggcctcccaaactgctgggattacaggcacgtgccaccatgtgcagcctcctctagaatattttaatctacacttatcatttagaatttcctgtgcactattttacatttctatttattttagttttatatctatctgtatt

SEQ ID NO: 89320 - DNA, 601 bp, Human
atttcaaaagcttctgactgtctggagtccaaatgattttatgtaacattcaaatattctcacaatgtgcactaacatctgttcttaaactctctgacctaaggttctattaaaatgaccttactcactactagaatattctctggctgccccactatgcctctgctcagatcatggccccagctttctaagttctccccttctatctaaagcatcatcaaattttactccttctcccttgctacagccatctcctaacacctgggccactgtgtcacccaatcctaatttctttcagaatttttttttttaagacagtatctcactctgtcgcccagcctggaacgcagtggcacaatcttggctcactgcaacctccgcctcccgggttcgagcgattctcctgcttcagtctcccgagtagctgggattacaggcacctgatgccaccactggctaatttttgtatttttagtagagacgaggtttcgccatgttgaccaggctggccttgaactcctgacctcaagtgatccacccccctcggcctcccaaactgctgggattacaggcacgtgccaccatgtgcagcctcctctag

SEQ ID NO: 89321 - DNA, 601 bp, Human
agagtccagtggctcaatcatagctcacggcagcttcgacctcccaggtttaagtgatcccccacctcagcttcagctgaggctacaggcgtatgtcatcatgcctggctaattttcgaatttttttgtagagacagggtaccactatgttgcccaggctgggtaaaaactttttaaaaatatttaaaaatatttttgctattttctattttccaggatctgacattaaagatgtactgcatttgcaatgggggaattgagagagggatgaatgttactttgaaccaactaattatgtgamcctttgctttcttttcataggttaccctacttctgcaaccattgcttttcaaagttgccttcactaaacattcttcctctgcccactaaagttctgcgcaccaccatcttttcagcctacactgttctacaatctctgaaactcctaagatttcattcaccgttaggactaactgtagcccaaatccagcctgagttccacatctctaactagacatcattagattgctctcatcccaaacttgctatgtctaaagccaaactcatctttcatgacaaaatggcattcatgataaaatga

SEQ ID NO: 89322 - DNA, 601 bp, Human
agttcagatgcatttttcccttttgcaatcatctgaagaataaacaaaacagacaatatgggaaattctatatatattaaatatttagaagattaggtcaacaaataagctacgtaattaaccgctgaactctttttgaatcatcttacctcaactatttacagcaaataataaacactatcttgtacagcaatataaatacacaaatacatagacacaataaacaagaaatatttagtaacttaagatatatatttaaatattttactagttttctctggctaactgggttataagtaattttttttttttttagacagatcctactctgtctcccaggctagagtccagtggctcaatcatagctcacggcagcttcgacctcccaggtttaagtgatcccccacctcagcttcagctgaggctacaggcgtatgtcatcatgcctggctaattttcgaatttttttgtagagacagggtaccactatgttgcccaggctgggtaaaaactttttaaaaatatttaaaaatatttttgctattttctattttccaggatctgacattaaagatgtactgcatttgcaatgggggaattg

SEQ ID NO: 89323 - DNA, 601 bp, Human
tagcttacagaaaacagtattttactgggacgtgttcattcaataaatccacatatatgtactgagtgcttagtacatgtcatgagtagtctgagaaacttgggaaatattcttgggctcagtcctagaaatcccaaaaagccccaaatcatcaaggtctggatatacccaaataggtctttttcactggacatatgctatcttaaaattaagtccctggaacaaaatttaaactaaacgggcctctaggaacaggtgaaaactcgacaacttaccatcattcactcaggggaatcaatckgttttgcttttcatattttctaccaaaaatccaaagctaggattgtgcctactttttatttgatcttacctacatttaaaattaaggacattttaatcataacaaaaatctagtgatacttaagtatcttatgttgcattatactacataaaaagtgtacggtcccatgaaaacaaaaggaatcataaaaattatagatcaaaacagtacctcaatatttttactggccacattcttcacaacagcaggaaacagttcagatgcatttttcccttttgcaatcatctgaagaataaacaa

SEQ ID NO: 89324 - DNA, 601 bp, Human
taagacaaaacatattaacaaaaataaaggatttttttataataaaaaggtcaattcatcaggaaaacccaaagagttatgcctaataggagtacttttaaaaataagcaaaaaatactaaattaaggggaaaaataaaacattccagaatcagcccaggcacgatggctcatgcctataatcccagcactttgggaggccaaggttggcagattgcttgagcctgggagttcgaaaccagcctgggcaacatggtgaagccctgtctctgttcaaaatatgaaaattagctggacatggyggcatgcacctgtagtcccagccactcaggaggctgaggaaggaggatcacctaaacccaagaggtcaaggctacagtaagccacgatcatgccactgcactccagcctgggagatagagaggaaccctgtctcagaaaaaaaaaaaaaaaaaaaagccaggcacggttggtcacgcctgtaatcctagcactttgggaggctgaggcaggtagattgcttgagctcaggagttcaagaccagcctgggccacatggcgaaaccctgtctctacaaaaaaaaaaatataaaaaactagcc

SEQ ID NO: 89325 - DNA, 601 bp, Human
ttttttaaaagtaggtttaggctgaacatggtggctcacacccataatcccagcactttgggaggccaaggtgggcagattacttgagctcaggagttccacaccagcctgggcaacatgacaaaaccccggctctactaaaaatacgaaaaataaattagatgggcatggtgacacaagcctgtaatcccagctgctcgggaggctgaggcaggagaatcacctgaacccggcaggcagaggttgtagtgagccaagatcgtgccactgcactccaacctgggcaacacagcgagacccygtctccaaaaaaaaagtaggtttaaagtacctatccttaaaatgctataatccagtgatgcattgcttaacaatgttctgagaaatgcgtcgttggacaatttcattgttgtgcaaacaccacagagtgcaacttacacaaacctacatggtatagactactacacacctaggatatatgatacagaccaggggtctacacacctaggatatatgacatagcccaggggttggaaccaggccacacagcaggcagtgagcagtgggcaagcaagtgaagcttcatctgtatttacagctg

SEQ ID NO: 89326 - DNA, 601 bp, Human
tgataatactaagacaagcttcacctatgcctcataatttttctaagttaaatgtttattttttccagatatttggactttcttataccacaggccataaaactaataaacatatcaaattagaagctcagatatcatggccataaggtgtcaaagggagagtagttgaaaattatcaattcagaattatatataacaagcacatagtgtttaataaatatctactaaattaatcataagtaaaattgattttactcaagaaatctacaaagaaagtatggtttatcaagtcatttaaatmcagtactaatttaatctaattcataaactggccacaagaatacaactgttttgattttggcttatccaacttagtctaattgagtttataagaactatttcattttgatagaaaaattcatctatctgaaatacagaatgcacttcctatctaatgaaaaaaattaagagctgggcacagtggctcacatctataatcccagcactttgggaggccaaggcaggaggatcacctgagcccaagagttcaacaccagcctgggcaacatggagacctcgtctctacaaaatattttttaaa

SEQ ID NO: 89327 - DNA, 601 bp, Human
gacagaaacagccccacagggttatttgtgaggataaaacggagtagatctatgcaaggcactaataaccttggtcagacaggtttttttaatgttagcaattattcctattgctactaagagactctattcctgataatactaagacaagcttcacctatgcctcataatttttctaagttaaatgtttattttttccagatatttggactttcttataccacaggccataaaactaataaacatatcaaattagaagctcagatatcatggccataaggtgtcaaagggagagtagttraaaattatcaattcagaattatatataacaagcacatagtgtttaataaatatctactaaattaatcataagtaaaattgattttactcaagaaatctacaaagaaagtatggtttatcaagtcatttaaatacagtactaatttaatctaattcataaactggccacaagaatacaactgttttgattttggcttatccaacttagtctaattgagtttataagaactatttcattttgatagaaaaattcatctatctgaaatacagaatgcacttcctatctaatgaaaaaaattaa

SEQ ID NO: 89328 - DNA, 601 bp, Human
ctctaactatttgaggatagatgactttttcctcaactagatttaaagttcctaagaatacagcaatggtagaaagcaattaacacgtggttgactgattaacagcagtcaatatatcaaatatatatcaatatatcagcagttgattaacaacagtttcaatatatcaaatcaacacataatatgtatttaactaagtaatttatcccatctgcctggaagtgaacttgaggctatttagtacaacaaccatttcttattcatctgtatattgcaaggacttattacattgcttggcatrtagtaaaagctcaatatttatcagctggatcacattccagaccaactgtagactgaaaaaaattaagacatttcccattagagtgctacatctaggatctaacttctcacaccagtgggtataattcattgaacagcaaagtctagaaagacaccaacatactatgaagaaaacaacaggttttggaaagactgcctccaaagtctttaacttgttagtctggttgtttttttggtgtatgtgggtgtgtggggaggggtgtgtgtgtgtcagtgagtgggggtggaggtgtgggtgtat

SEQ ID NO: 89329 - DNA, 601 bp, Human
cgattagactctttacactttcttggtttaaattagtgcttctcaaccttcagaatttttcaaacccaaaatacacatatttgtgaaacactgttcctttaaatgatcacttggaaccaagtgatgttacacaagaatacaaatataggtataagatggaaaccaaatgattcaaactatacttaatgtttcagattatatttaagtgtaaatataagtttttcaaattcttagatcagttttagaagcgcttctctaactatttgaggatagatgactttttcctcaactagatttaaasttcctaagaatacagcaatggtagaaagcaattaacacgtggttgactgattaacagcagtcaatatatcaaatatatatcaatatatcagcagttgattaacaacagtttcaatatatcaaatcaacacataatatgtatttaactaagtaatttatcccatctgcctggaagtgaacttgaggctatttagtacaacaaccatttcttattcatctgtatattgcaaggacttattacattgcttggcatgtagtaaaagctcaatatttatcagctggatcacattccagaccaact

SEQ ID NO: 89330 - DNA, 601 bp, Human
ccccaattgcacatcttctcatttgaaaatgacatcattgcagtattattattaaaaatccaacaagaaatttacaactgtagtaaaaggtagtaatgacttcattccatagaaccccatctctattatcaatgtactttccatctatattcacgattagactctttacactttcttggtttaaattagtgcttctcaaccttcagaatttttcaaacccaaaatacacatatttgtgaaacactgttcctttaaatgatcacttggaaccaagtgatgttacacaagaatacaaatatakgtataagatggaaaccaaatgattcaaactatacttaatgtttcagattatatttaagtgtaaatataagtttttcaaattcttagatcagttttagaagcgcttctctaactatttgaggatagatgactttttcctcaactagatttaaagttcctaagaatacagcaatggtagaaagcaattaacacgtggttgactgattaacagcagtcaatatatcaaatatatatcaatatatcagcagttgattaacaacagtttcaatatatcaaatcaacacataatatgtatttaact

SEQ ID NO: 89331 - DNA, 601 bp, Human
gcctttcttttctaaaagtacccttgtcattctggctagtattaaaattaattaggaaatacagaatatgaaaggaaaactgcctgcgacagcttttgttcttcacctcaatctgctataactttccagctagaatttaaatgtgtaaggccctacatctacattatattactcgtttaattctcatatctatcctaggtacaattatctccctctcaaagataaggaaagtaaggctcagaggtttatataacttgcccaaagtcacagagctagcaagtgcagaatcaggatgcaaacaggcatgttcctaactactacatgttgtggcctatgatggcagtccgcagatatttctattaaggtacccctaacaaaagaggagacaactcttcccctaagagcatctgaaaacctaggaaaaaaattatattttatttataatatatacatttataaaagaagaatgctttaaatcactgttttttaaccccaattgcacatcttctcatttgaaaatgacatcattgcagtattattattaaaaatccaacaagaaatttacaactgtagtaaaaggtagtaatgacttcattccata

SEQ ID NO: 89332 - DNA, 601 bp, Human
aacagaaatagtccccaaatataacttgcactctttatctcaatctccactcaggttatcccaagttatcccgcttcaccaagttccacttccccaagttccacttattaaaatcttccacaagagcaaaaattaaacaataaagagtcctagtagataaacagtaaacaaatgacagttcctccatataacactatactattcagccactatacaaaattaaataaatctgtatgacattgaaaatatatccttgtggccaggcacggtggctcacacctgtaatcccagcactttgggmggctgagacgagcggatcacctgaggtccggagttggagaccagtatggccaacatggtgaaactccatctctactaaaaatacaaaaaaattagccaggtgtattggcccatgcctgtaatcccagctactgggaaggctgaggcaagagaattgctggaacccgggaggcagaggttgcagcaagccaagatcgcaccactgcaccccagcctgggtgacaaagcaagacaccatctgaaaaaaagaaaagaaagaaaagaaaatatgtaccttgaaaaaggttttttgtttgtttgt

SEQ ID NO: 89333 - DNA, 601 bp, Human
tgctccagatgaggtacttccacagatatgactaattcttgattaaaaccatacaccttttccaaatgtactgctgaccaaatcaaaatccaactgtcctcacggaatttttttaaaattattttaaatgaaaggcaaaatcttccatttatctacagaaattgtcaacaatttagattcaacacatcttggcaccctgttaagataatttgagatgataattttataatccaaactatttctcaattcataagtacaaatgaaaacttaatgagcaaacaaactttgtacatcttcatcrttgataaatatgttaaacacaaccattttaagttgatatcaatccattcatctatactatacgggtagagttataaatgaaatgaaaaaacctttttccaattactcttcaatgttgaatggctccacaaaaccttaaaaacaaaatctaaagctcttaacctagtactcaatacagtttataatctgttcgaaacctcctttcctagtcaaacagaaatagtccccaaatataacttgcactctttatctcaatctccactcaggttatcccaagttatcccgcttcaccaagttccac

SEQ ID NO: 89334 - DNA, 601 bp, Human
agtcatactaaccaatctggactactttagagacaactgtcatgaccttccttccttgtaccctaatttctcgtgaaacataacagctttagttcctctaccatcctgtttgctccttcctaaactcactccaatttttttcagcgtgacactacaaactacaaataaagtctaaacagaacaaactagataagaacttgctccagatgaggtacttccacagatatgactaattcttgattaaaaccatacaccttttccaaatgtactgctgaccaaatcaaaatccaactgtcctcayggaatttttttaaaattattttaaatgaaaggcaaaatcttccatttatctacagaaattgtcaacaatttagattcaacacatcttggcaccctgttaagataatttgagatgataattttataatccaaactatttctcaattcataagtacaaatgaaaacttaatgagcaaacaaactttgtacatcttcatcattgataaatatgttaaacacaaccattttaagttgatatcaatccattcatctatactatacgggtagagttataaatgaaatgaaaaaacctttttccaat

SEQ ID NO: 89335 - DNA, 601 bp, Human
ggatcatatttccagtcatactaaccaatctggactactttagagacaactgtcatgaccttccttccttgtaccctaatttctcgtgaaacataacagctttagttcctctaccatcctgtttgctccttcctaaactcactccaatttttttcagcgtgacactacaaactacaaataaagtctaaacagaacaaactagataagaacttgctccagatgaggtacttccacagatatgactaattcttgattaaaaccatacaccttttccaaatgtactgctgaccaaatcaaaatycaactgtcctcacggaatttttttaaaattattttaaatgaaaggcaaaatcttccatttatctacagaaattgtcaacaatttagattcaacacatcttggcaccctgttaagataatttgagatgataattttataatccaaactatttctcaattcataagtacaaatgaaaacttaatgagcaaacaaactttgtacatcttcatcattgataaatatgttaaacacaaccattttaagttgatatcaatccattcatctatactatacgggtagagttataaatgaaatgaaaaa

SEQ ID NO: 89336 - DNA, 601 bp, Human
cgaagctgcagtgaggcaggattgtgccactgcactccagcctgggcaactggaaagagactctgtctcaaaaatttaaaaaatttaaaattaaaaaaaaagttatatactcaaagaacacaagaaatgaggggaaaaagttggagatagctggaattggtgctggaaatataaaaacagtactatactggatcatatttccagtcatactaaccaatctggactactttagagacaactgtcatgaccttccttccttgtaccctaatttctcgtgaaacataacagctttagttcctcyaccatcctgtttgctccttcctaaactcactccaatttttttcagcgtgacactacaaactacaaataaagtctaaacagaacaaactagataagaacttgctccagatgaggtacttccacagatatgactaattcttgattaaaaccatacaccttttccaaatgtactgctgaccaaatcaaaatccaactgtcctcacggaatttttttaaaattattttaaatgaaaggcaaaatcttccatttatctacagaaattgtcaacaatttagattcaacacatcttggcaccctgtt

SEQ ID NO: 89337 - DNA, 601 bp, Human
ctcagccaggcacagtggctcacgcctgtaatcccagcactttgggaggctgaggcaggcagattgcctgagttcaggagttcaggaccagcctgggcaacatggtgaaatcccatttctagtaaaacaaaaaaaaaaaaaattagccaggcacagtggcatgcacctgtagtcccagctacctgggaggctgagatgggagagtcacctgagcctgggaggtcgaagctgcagtgaggcaggattgtgccactgcactccagcctgggcaactggaaagagactctgtctcaaaaatttwaaaaatttaaaattaaaaaaaaagttatatactcaaagaacacaagaaatgaggggaaaaagttggagatagctggaattggtgctggaaatataaaaacagtactatactggatcatatttccagtcatactaaccaatctggactactttagagacaactgtcatgaccttccttccttgtaccctaatttctcgtgaaacataacagctttagttcctctaccatcctgtttgctccttcctaaactcactccaatttttttcagcgtgacactacaaactacaaataaagtctaaa

SEQ ID NO: 89338 - DNA, 601 bp, Human
caacaaaattatgaacagaaaaagaaataaacaaaaactagaatttgagttgaaatttatccattgcttccttctagcactatttatagcctgtatctaccttctcaaatatcttcacattcctgattacccttctaagataccaacacagtatatacctaaaagttatgtactcagccaggcacagtggctcacgcctgtaatcccagcactttgggaggctgaggcaggcagattgcctgagttcaggagttcaggaccagcctgggcaacatggtgaaatcccatttctagtaaaacaaaaaaaaaaaaaattagccaggcacagtggcatgcacctgtagtcccagctacctgggaggctgagatgggagagtcacctgagcctgggaggtcgaagctgcagtgaggcaggattgtgccactgcactccagcctgggcaactggaaagagactctgtctcaaaaatttaaaaaatttaaaattaaaaaaaaagttatatactcaaagaacacaagaaatgaggggaaaaagttggagatagctggaattggtgctggaaatataaaaacagtactatactggatcatatttccagtc

SEQ ID NO: 89339 - DNA, 601 bp, Human
cacttctttaactgacacactttcaactctgcagaaaccttgtagctatttgcctactcactccattatttaccttcagagctcgctgaaaagtgcttatggacaggagtgcaagatcctgctgttcttcagcatatcgaaccaggtaaacatataccaacttcttgatctgttaaaaaaaaaatcatttattcataaccagagtgaaaatttaaaactcagtatttgctataccaaaatccatgctcaattcttctcaagtaaataactgaatctggtcacatgttagattgtaaaatamaaataatattttgtgggataataagtacaacaggaaaagcttttaaagtaagcattttaatagtccagttcacaatagcaatagcctatcaaagtgtcccttcctcttgaagggaataaaaaatccctgagcagatctcatataagaatattaactaaattgtaaaaatattttcaaaatgagggataaaaataaaagaaagaagccaggcatggcgtacatgcttgtagtcccagctacacaggaggctgaggcaggaggatcacttgagcccaggagttagaggctatcctgggcaac

SEQ ID NO: 89340 - DNA, 601 bp, Human
tcagttggttgtataaattattttctaagtgtactgagtaggcactataggaggcttttaactctttcaagacactactgtgctatttagtggattatcgctccacttctttaactgacacactttcaactctgcagaaaccttgtagctatttgcctactcactccattatttaccttcagagctcgctgaaaagtgcttatggacaggagtgcaagatcctgctgttcttcagcatatcgaaccaggtaaacatataccaacttcttgatctgttaaaaaaaaaatcatttattcatarccagagtgaaaatttaaaactcagtatttgctataccaaaatccatgctcaattcttctcaagtaaataactgaatctggtcacatgttagattgtaaaataaaaataatattttgtgggataataagtacaacaggaaaagcttttaaagtaagcattttaatagtccagttcacaatagcaatagcctatcaaagtgtcccttcctcttgaagggaataaaaaatccctgagcagatctcatataagaatattaactaaattgtaaaaatattttcaaaatgagggataaaaataaaa

SEQ ID NO: 89341 - DNA, 601 bp, Human
tatacagcaaggtttcagttggttgtataaattattttctaagtgtactgagtaggcactataggaggcttttaactctttcaagacactactgtgctatttagtggattatcgctccacttctttaactgacacactttcaactctgcagaaaccttgtagctatttgcctactcactccattatttaccttcagagctcgctgaaaagtgcttatggacaggagtgcaagatcctgctgttcttcagcatatcgaaccaggtaaacatataccaacttcttgatctgttaaaaaaaaaatcatttattcataaccagagtgaaaatttaaaactcagtatttgctataccaaaatccatgctcaattcttctcaagtaaataactgaatctggtcacatgttagattgtaaaataaaaataatattttgtgggataataagtacaacaggaaaagcttttaaagtaagcattttaatagtccagttcacaatagcaatagcctatcaaagtgtcccttcctcttgaagggaataaaaaatccctgagcagatctcatataagaatattaactaaattgtaaaaatattttcaaaatgag

SEQ ID NO: 89342 - DNA, 601 bp, Human
aggaaaacacatataactgagttgagaggatcagacacttaagattctaccctaaacaggaaaaaaaaatctcaattttctaataatacaagcatatgtgtacatgagatagactatataaatgagaattcaaattctgattattcttaagttataaaatctataaattatcacaggctctaacagcctcacaaataaaaacctgcatagggtctctatagccaaaacgaaattaaagatgtgtaaggaacatttgcagcagggggaaataccatcatacagtcactggatttacttagtrtaagagcagcctacctaaaagagcgaataaaacaagcctctgtggtctataacattccatgtaacatcagagatctttggtatattgttaacaatgcacctacctgtataatttttgtattgcatgggctgcattcttcctaacatatggtgataagtcagcagaagcttccttaatagcaagcatcatgataggtacaataattggcactctaatacttgacagaactctcaaagcgcttgcacgaattagttggtttgggtcctaaaaatagtgcaaaaatattcaccaaaatttcaa

SEQ ID NO: 89343 - DNA, 601 bp, Human
tactgtgaatacaacaccagaaacagaagagagtctcaaaaagcttgaggaataaatgatagctgaaaataataccaaattgttatagacaattctatttggacagtaaattttccacagagatcagggcattgtataatattgcataacatttctaaaatatcacacagatatggtatagcacactatatttcaaatcactacactttttaaaattacttaataaaatagctctggaaaagaattagacaacgaagggaggagcaggaacaaagatggaagaaaggaaaacacatataastgagttgagaggatcagacacttaagattctaccctaaacaggaaaaaaaaatctcaattttctaataatacaagcatatgtgtacatgagatagactatataaatgagaattcaaattctgattattcttaagttataaaatctataaattatcacaggctctaacagcctcacaaataaaaacctgcatagggtctctatagccaaaacgaaattaaagatgtgtaaggaacatttgcagcagggggaaataccatcatacagtcactggatttacttagtgtaagagcagcctacct

SEQ ID NO: 89344 - DNA, 601 bp, Human
cctctactgttttcatacatctaaatacacatagcacaatactgtgaatacaacaccagaaacagaagagagtctcaaaaagcttgaggaataaatgatagctgaaaataataccaaattgttatagacaattctatttggacagtaaattttccacagagatcagggcattgtataatattgcataacatttctaaaatatcacacagatatggtatagcacactatatttcaaatcactacactttttaaaattacttaataaaatagctctggaaaagaattagacaacgaagggagsagcaggaacaaagatggaagaaaggaaaacacatataactgagttgagaggatcagacacttaagattctaccctaaacaggaaaaaaaaatctcaattttctaataatacaagcatatgtgtacatgagatagactatataaatgagaattcaaattctgattattcttaagttataaaatctataaattatcacaggctctaacagcctcacaaataaaaacctgcatagggtctctatagccaaaacgaaattaaagatgtgtaaggaacatttgcagcagggggaaataccatcat

SEQ ID NO: 89345 - DNA, 601 bp, Human
caaaatatgatcatctctggtccctgtcctatcaaagacattgctagtgtacctttgtatatacatatatatcaagtgctaatatcttattcattatagattgcctttaattatttggtatgtctttgatcttcttcctcaaatacatgatatgctattcataattaagtgccacatcctctactgttttcatacatctaaatacacatagcacaatactgtgaatacaacaccagaaacagaagagagtctcaaaaagcttgaggaataaatgatagctgaaaataataccaaattgttrtagacaattctatttggacagtaaattttccacagagatcagggcattgtataatattgcataacatttctaaaatatcacacagatatggtatagcacactatatttcaaatcactacactttttaaaattacttaataaaatagctctggaaaagaattagacaacgaagggaggagcaggaacaaagatggaagaaaggaaaacacatataactgagttgagaggatcagacacttaagattctaccctaaacaggaaaaaaaaatctcaattttctaataatacaagcatatgtgt

SEQ ID NO: 89346 - DNA, 601 bp, Human
gcatcctaagatgagctggaatccttttcctcagtagttttgagaaatataaagtgggtacaaaagccccatctaagatactagtacactagtaactcacatcccccataggtcacctctattccttgatcttaccatgttaaccacttagccacaggttaaagatttttttctcaacttgccttttttcagattctgatgaagaaacacataacgatctaaaactccaaatgcagtctttctcattacatgaaaatttttgttctttaaaaatagtcctgtgtgccattaatatttatascattttgaaatcaataaatacaactatataaaatatataatggtaaatgatactatgtaaataaagtacatttttatgtcaaagacgtaaaaagacattacttactgtgcttttatctttcagaagtttttcaattacttcaattaacatttccttctgctctggatcaaggctaaaaaatacaaaaataacatattaatttttccctttaattctagctttacatgatgctcaccaattcaaggatgttgagaaatttttaaagagggaaaggagagcaagaattataagttagaaata

SEQ ID NO: 89347 - DNA, 601 bp, Human
cccaaagaatctacctatgaacactgagcatgaaaccactgcaggggggtgagggagacattaaaaacgatactacacacttaattactatcaccaagaatgtaacaaattaattcaacagtcattcaacaaatattaaatacctgtgatgaacaagtattcaatattttttactttctggtgtattttggaaacagacattccaattttacacagatattgtatctttacatctttttgagtacttatttcttatttggaatttttaatcacatcccatgtggtgttaggcactgtgctragggttttatatacaatagttctttctctcgacacaaacagcaaatgtataaattagatattataaaccctacaaatctggagcctaaaactcataaagaattggtacatatactatgtggcagatgctcagacattaagccagttctatctgattcaaacgctattgtttttacctatgatatgctgtatcctgtctgggaagacatgcacatattatacagagagagttcattcccaggccatccaaagaatttctcttagtctataatgtagcagaaatgatggtaaaactcattaa

SEQ ID NO: 89348 - DNA, 601 bp, Human
ttcaaagataaaatcttcagggccagcatctttcttaatgcaaacacaatgtaagcatttcctttagactgaaacaaggcaagaatgcccaccatctccactactattgaacacaactgtagtgatggcactaaacaatataattaggcaagagaaattagagttctaggaactgaaaaagaggaagtaaaacatctctatttgcagatatgattcattctctaaaaaaaaaaagagagagagatttaggctgcttgcttctgcctcagagttggtgctgtcatggccagtcagtctcagsggatccagtagctgctgcaggttgctgaaaagggtgtctgagacctgcagtgaaagaaccggagggagaagcaggccaaagcagcagttcaaggtgaaattgaacaatattgcctgcagagggagaaagagttcaaggccaaggaggctgctgccctgcgatcccaaggcagctgcagcattaaagtagaggagacccaggagaagagaaccatctggaagcagtttaggcagaagaggggtgaagtcttggcctttttctgcaatatctggtagtccattcctgctagtggttagaaca

SEQ ID NO: 89349 - DNA, 601 bp, Human
tcaagagagcaaaaataatcagatgtgaagactaaattgcaaggtgcccttcgaataaaattactgaatgaaaattttaaaaggggtattaaagaaaggtagaaaaagaaccaaaagaataaaaatgagataaagaaagaagaggtttagagacacaatgattggaatgtaaaacaggcaaagaagatccaatgtgcataaaataggaatccctgaaaaagaaaaaaaataacagaattaatatttaaaattataatcttaaaaaaaaacactttgccagagataataaaaattctgaatstacattttgaaaggactcactgagtaccaaggcaaaacaattgacccatatcaagtaatcctgaagtaccttgcaaaagtactatatttcaaagataaaatcttcagggccagcatctttcttaatgcaaacacaatgtaagcatttcctttagactgaaacaaggcaagaatgcccaccatctccactactattgaacacaactgtagtgatggcactaaacaatataattaggcaagagaaattagagttctaggaactgaaaaagaggaagtaaaacatctctatttgcagatatga

SEQ ID NO: 89350 - DNA, 601 bp, Human
aaaatcaaatcaccaatcctgtccaaagaaataagaagatgcaagtaatctgtaagtactaaaaacagaaaatgaaaatcaaaacaattcaactggcaaaaattaccgacaaagaaatataaatgatgaagcaaaaggaaacaacacgacacttcaaaatgaattaaataccctcaagagaagcatttgaagataggaaatataaatataaattataaattttttaaagttataaattaacaaaagaaatcaggattgattgacaacaggaaagaaatcaagagagcaaaaataatcagaygtgaagactaaattgcaaggtgcccttcgaataaaattactgaatgaaaattttaaaaggggtattaaagaaaggtagaaaaagaaccaaaagaataaaaatgagataaagaaagaagaggtttagagacacaatgattggaatgtaaaacaggcaaagaagatccaatgtgcataaaataggaatccctgaaaaagaaaaaaaataacagaattaatatttaaaattataatcttaaaaaaaaacactttgccagagataataaaaattctgaatctacattttgaaaggactcactga

SEQ ID NO: 89351 - DNA, 601 bp, Human
acactaaaatgttctatttttaggaaaaaactattcatatgacacatactggtctttagtaaaagagaaaagccattctattatattttaatatatttataattccacctttccttaaaatgagaattatggaactaattttctttgagatctcaattgaaagaaaatatcctctagcctaaaagaagcaacagatggtatgcctcaaaatcaacagaggttaaatgaagaaagtttaatagatcaacatctttcaaatgtatatgtatcagcagcaacaccaatgtcatcatcgtaatartgatcccaaaaaactgctgctggcaacaaataaattccttttcaaaatgtggaaataaattagacctggtacatttaactgggagattttttaaatgaaagtgatttttgatcctctattgattttaaatgccaatgctgacattaaaaatttggtggtggggggcaggggagaaatgtacctgtcttccttcaatgaagaattacatgtgaccaaaaaaaggtaataattaagatatgatccacaaatatctgtgtagaatatttttaacctttctacaatggattataatcacacaaa

SEQ ID NO: 89352 - DNA, 601 bp, Human
aaatagaaccaaataaagtttaagaaaacatcaaaataattaaaaagcatataaagagagtacttttacaaaataaaactgatcattttagatacttaatcatatagttttaacaatctgaccctgggctaaacactacaaggaaaattaataattttggtttattaaatgttcaatattctataaaatattcagaattaaaattaaatgatctactcagattttaaaaccaaaaatactggtttccaaaaaacagacagttaacttccatctcactgtgtcaatagtagcttttcatatmagggaaaaaataaatcactccaacaaaaccagcaatgagctcatcaaattcaaatgcagttttccatttatgtattttttatattaaagcaataaacatggttcatttatcttcccttggttgccacgtttttctgtgctgttgctatgaacttcagccattagctgtgctccaaggtaaactacatgaaccatcaacaaaagtgacaccccatctatggagttcatattttctctagattatctatgctagttgacaagctggtaatgaaaaaaatcacactaagcaaatggttcctct

SEQ ID NO: 89353 - DNA, 601 bp, Human
aaatgaatgttcatgtttgaataacaaactttatggtgactattcgtcaaagaataattttaatagttctaatatgtctagaaaatactattctgaagagaagtaaattctgatgtgtttatttcaccaggttaaatttcaacacattgttcatatgtggattaaacattaatcacgcacatttttcatgtttaaagctaacctaaattctaatctaaaaattcagtactttgttcataatattcagaaaaagaatcaagacaataacaaagctcacattgtgtcagtttaaaatgagaasgacaatcattctaaaatgaacttatgttaaaaagtatatgagaaattcataaattttaatagaagaacactttcaaatcatatacatcttaatccaccggtttttacccaatataatttatttacaaagaaaacacactggctgaaattttagaacatcacctgggctcttatcactttcataacaatgtgtataagttggaataatatattactaacaaaagggggctcttccaacaccagttaatgaatcataatgttagtttctgaactgtgatgcttttacaaagtggtaacattg

SEQ ID NO: 89354 - DNA, 601 bp, Human
ggattatgacaacctgcccccactcttcaacatccactagtaagttacatagcttgcggtaatttttatgaatcagatctattctgtccgggcatacttcttcaaaagccatcacaacactgccagctaccaactagaaaagaaagaaatagtaacttattaaaaaatgtttctcccctacatcaaaggtcttactcaggcattatagtaatcagtttcatgccaatcagtattaaagtattcagtcattcaattaaaatgaatgttcatgtttgaataacaaactttatggtgactattygtcaaagaataattttaatagttctaatatgtctagaaaatactattctgaagagaagtaaattctgatgtgtttatttcaccaggttaaatttcaacacattgttcatatgtggattaaacattaatcacgcacatttttcatgtttaaagctaacctaaattctaatctaaaaattcagtactttgttcataatattcagaaaaagaatcaagacaataacaaagctcacattgtgtcagtttaaaatgagaacgacaatcattctaaaatgaacttatgttaaaaagtatatgagaa

SEQ ID NO: 89355 - DNA, 601 bp, Human
ggaagactgttcaacacttacctctttccaagggctgacaaactgtgtccgagcatatcgagttagcatgtggattatgacaacctgcccccactcttcaacatccactagtaagttacatagcttgcggtaatttttatgaatcagatctattctgtccgggcatacttcttcaaaagccatcacaacactgccagctaccaactagaaaagaaagaaatagtaacttattaaaaaatgtttctcccctacatcaaaggtcttactcaggcattatagtaatcagtttcatgccaatcartattaaagtattcagtcattcaattaaaatgaatgttcatgtttgaataacaaactttatggtgactattcgtcaaagaataattttaatagttctaatatgtctagaaaatactattctgaagagaagtaaattctgatgtgtttatttcaccaggttaaatttcaacacattgttcatatgtggattaaacattaatcacgcacatttttcatgtttaaagctaacctaaattctaatctaaaaattcagtactttgttcataatattcagaaaaagaatcaagacaataacaaagct

SEQ ID NO: 89356 - DNA, 601 bp, Human
gcctataactttatacaatagaaaaaaaatctgagcagaagttttgaaaggaattggctgaaatcaaacaaataagctgtttggcaacaaaaatctctcatcaaagttatcataaaagggccaggacattttcatcatagagatgttccttaatctagcaaaagtgccatcaaaactgtactttgctcaatgataaataaaattaactttataaaattaaagttgacaaggatagtaaaatttcatcaatttaagagcattatgtaacataagacttacatattaataattcaaaacatayttcaatttttaagatggataacataatcatcattttgttaatattaaaagtgagatgaaaatcagtattactgtcttgtggataaagaagtattaaaatttctaaacagtttttaatgctaatactaaatcaatatagaaaatagtgatcaacattttataataatttgcaagcttgatgtgtcatttaaagcatgtatcatacatttttccatgttatttacatttttctaattaacaaaagcaagatgtactgagcactcaaggcctgtcataagtatgtatacagaccactttgata

SEQ ID NO: 89357 - DNA, 601 bp, Human
catggtcctagtgttgaccactcatttgaatcttaattttataaaatatatttataacaagagtctaacatattgtacaatccttgattctaatactgcaataagggctgagcctttcaaatctttcacactgcttctgaactgaacatatgtacgtatgtagacaaaagcctgttatactgattattctgggctaaacgagaccctcaaatagcacttacacaatcgatgaataatttttccttgaattgaggtcaactgatatcaacttaaattaataaataaagcaaaatgttttatycaaagtaaaatttataaccaccagagtaactgaaattaaacagttaccaataattgcctctaaggcgtcaaccaagaggttacgagaagggaacatgtacttgaattgcttctataattaaaaaacaacaacaacaataataggaatcaaattagctaaacttataaatcttctatttaaagtggttttctttctatctgtcttttaagccaatggatctttctcaaaggaaatcaaattcaacgctgcataagaaaggaaggcaaaaaaggcttctgtgtttgaaacagtggcaaaagc

SEQ ID NO: 89358 - DNA, 601 bp, Human
caggctggagtgcagtggtgcgatctcggctcactgcaagctctgcctcctgggttcatgccattctcctgcctcagcctcccaagtagctgggactacaggtgcccgccaccgtgcccggctaattttttttgtatttttagtagagatggggtttcaccgtgttagccaggatggtcttgatctcctgacctcgtgataagcccgcctcagcctcccaaagtgctgggattacaggcgtgagccaccgcgcccggcctcgtctgccaacttctaaagctaaaactaccatgtgtagtcrctaaaaagttggaagcaacatcaagcctagatcagaaagcactgaagactataaatggctacactgctcactccaaagtttctcagtaaaacaaaatcataattagcacagaggaagcctgagatgggttaactggaagagtgagagcacagacatggtcctagtgttgaccactcatttgaatcttaattttataaaatatatttataacaagagtctaacatattgtacaatccttgattctaatactgcaataagggctgagcctttcaaatctttcacactgcttctgaactgaac

SEQ ID NO: 89359 - DNA, 601 bp, Human
gtaaactctcaggaatgcctctgctagagtactgtttcaccttgtctttttattctataatcatcttaacctttctttactacatggtgttccttttacaacatcacataagaaagagcaagcaaatataaatgccaaatacttctcagtttcttctagctatggtcaaactctgctttgagatttagtctgccaacttcttttatttttatttatttatttatttatttttttgagacacccaggctggagtgcagtggtgcgatctcggctcactgcaagctctgcctcctgggttcaygccattctcctgcctcagcctcccaagtagctgggactacaggtgcccgccaccgtgcccggctaattttttttgtatttttagtagagatggggtttcaccgtgttagccaggatggtcttgatctcctgacctcgtgataagcccgcctcagcctcccaaagtgctgggattacaggcgtgagccaccgcgcccggcctcgtctgccaacttctaaagctaaaactaccatgtgtagtcactaaaaagttggaagcaacatcaagcctagatcagaaagcactgaagactataaatgg

SEQ ID NO: 89360 - DNA, 601 bp, Human
aaagaaagtacagcaaaaatgataagccattaaatataaagcatcacagtattatttttcacattttctcttagtatctgagagaaaactgctggatttaaatgaattcggtattacaggcaggtttttttaattataaatttaacttttatgtcgatacattgttttagtgacactttttcctactggcaaattctttacttcaaggtaaaatggcccttaattcatcataaaatggtgcttatatagcatttatgtaagtgacttctgcctgtaggtaaaagggaatggagggctagartgaagacatttctacttggatgattccatgaaacaacacattcaagtgttgatggtaaaaggataaaaaagagaggtaaactctcaggaatgcctctgctagagtactgtttcaccttgtctttttattctataatcatcttaacctttctttactacatggtgttccttttacaacatcacataagaaagagcaagcaaatataaatgccaaatacttctcagtttcttctagctatggtcaaactctgctttgagatttagtctgccaacttcttttatttttatttatttatttatt

SEQ ID NO: 89361 - DNA, 560 bp, Human
caacaccagcctggccaacatgccgaaacccccatctctactaaaaatacaaaagttagctgggtgtgctggcacatgtctgtaattccacctacttgggaggttgaggcagacgaatcgcttcaacccaggaggcaagaggttgcagtgagccaagaacgcaccactgcaccccagcctgggtgacagagacagactctatcccaaaaaaggaaaacaaagaagaaaagaaagtacagcaaaaatgataagccattaartataaagcatcacagtattatttttcacattttctcttagtatctgagagaaaactgctggatttaaatgaattcggtattacaggcaggtttttttaattataaatttaacttttatgtcgatacattgttttagtgacactttttcctactggcaaattctttacttcaaggtaaaatggcccttaattcatcataaaatggtgcttatatagcatttatgtaagtgacttctgcctgtaggtaaaagggaatggagggctagagtgaagacatttctacttggatgattccatgaaa

SEQ ID NO: 89362 - DNA, 601 bp, Human
tatttatttttttaaatcgattaattttacaaaagcaactttagtcttagagatctaggtttatgcttcaagaaatctcccataataggcttgaatgacaaataaaatacttaaacaattttatatccttgaaaattatacaaacttgacctagaataaaaaacaacccacatggactgcaaagagtaaggtaaatttaagaaaataaaaatgcaaatgtgcattttagcagtctcttgaatttattaacctaaaaggtttaatttccattttcctgcatcagctttatttataaaatgtygtgccctataaatacgccgttattttctatagtcaagcaccctcttaacaaatcttctcattaatatgtaaatttaaagtcaatcggtcttctccctgacagccccatgaattcctagtgcactgtataatcagctttgacttgacatccactatttatcatcaaagatgtcagttagaaaaattatggaaaatgcactgcaattgatatgactgcaatctactttgtcaacacttaattgttcctcaaatcatacatttacatataaacagcctaaatactgatctataatgatgcaaa

SEQ ID NO: 89363 - DNA, 601 bp, Human
tgataagttattttatggctaccactgaaaaacttaagaacttaccttaaaaatactttaaacaaaattctaaatttggactttgttaaacttatgtaaggttttataattgatgtacagatatacagagagagacaaaattaattactccaaattttaaactggcataaatactgccaccagaattacataacccggattcatattctaaaaaataatggtaaatatttagagttttaacttccaaatcactgaagtaaaatattttgataattcttgaaaacctctcatctcccagagmaagttcagttgtaaaaagctagattcatgcaattaaaaacattcctagcaggccccagtgtcagagtttcctttcagtttacaattgatgccactaacagatgttggtttttattttaaatcactcttaaaatttactctgtgttttataatatttatttttttaaatcgattaattttacaaaagcaactttagtcttagagatctaggtttatgcttcaagaaatctcccataataggcttgaatgacaaataaaatacttaaacaattttatatccttgaaaattatacaaacttga

SEQ ID NO: 89364 - DNA, 601 bp, Human
acagtgcacaaaaaactgctcttattgcattgtaaagaatgtattctaccacaacttctcagtattttgtttttttaataaattccacagaatcgtggatctatagtccattggtaagacacatgacaaaatttgttttaacaaagaaaattaatcagtaaagaaaattaaaactcaataatctctaacattttggtccgttaagacaggatctggatgtggagttcatgaagtacttccctgaagtacctctgtacctacagaaaattgctcatcaaaaaactacatttataaattttgsattttgataagttattttatggctaccactgaaaaacttaagaacttaccttaaaaatactttaaacaaaattctaaatttggactttgttaaacttatgtaaggttttataattgatgtacagatatacagagagagacaaaattaattactccaaattttaaactggcataaatactgccaccagaattacataacccggattcatattctaaaaaataatggtaaatatttagagttttaacttccaaatcactgaagtaaaatattttgataattcttgaaaacctctcatctccc

SEQ ID NO: 89365 - DNA, 601 bp, Human
gaagctaattcagacattgagaagggtcactcagaaaaatgtttctcataagccttgtagtactattcattttctttcttttaaaccatgcatatgttccttggtaaaatttaaagttttcttttttaaaaaagaaaacttcatgagttaaaaaaaattccaatcaataggaataaattataaacaacaaaaagaatacggaatctttacgataaatgcttcataaccaatgggaagagaggagacattatttcaatattagatcatggtccttagtttcaccttaaattatatgttgaaycctttgtcaacagttacttaaaacagtgcacaaaaaactgctcttattgcattgtaaagaatgtattctaccacaacttctcagtattttgtttttttaataaattccacagaatcgtggatctatagtccattggtaagacacatgacaaaatttgttttaacaaagaaaattaatcagtaaagaaaattaaaactcaataatctctaacattttggtccgttaagacaggatctggatgtggagttcatgaagtacttccctgaagtacctctgtacctacagaaaattgctcatcaa

SEQ ID NO: 89366 - DNA, 601 bp, Human
acacatgcattctgggaaggaatcatgagaaagggcaaagggtaaaatatacatatgtcaaataagtctgtcagaaaaacaatagcttccccagaatcccaatttccagatgtggacccatttctgactctaaaggaatttagtacgttgattatttttcattaggcatataactactctgaacaaaatcaggatcctgttatttaaataagtgggaggggtagaactgacattgggtagacaagaagtatcacaacaactgcacataaaataatatttggagaatatttaatattccaayggagaacttggaatgcttcatatagtgacatgataaagtaagcaaatttaaaatgaagcaatttttgattccaaaaagaaccaaaagttccacaagagatgaaatgctattatacagctgaataatattcataaatcataggaaaatgaacacctatggattgaaaaaattctaatataattatattccaaagatgaaagaggtaagcagaagcataaggtaatagaagaatgacaaattctccatttctataataggaagtcaatacataatgcctaaaattgataaatcaagaaatag

SEQ ID NO: 89367 - DNA, 601 bp, Human
atataacagaaatatctagttaggtagctccataaaatgaaaagttgccccaaacactttgtttttcagctctgcccacccccagaatatagttttatccttatgcttgtaacatgactactgcacctctaatcatcacacatgcattctgggaaggaatcatgagaaagggcaaagggtaaaatatacatatgtcaaataagtctgtcagaaaaacaatagcttccccagaatcccaatttccagatgtggacccatttctgactctaaaggaatttagtacgttgattatttttcattrggcatataactactctgaacaaaatcaggatcctgttatttaaataagtgggaggggtagaactgacattgggtagacaagaagtatcacaacaactgcacataaaataatatttggagaatatttaatattccaacggagaacttggaatgcttcatatagtgacatgataaagtaagcaaatttaaaatgaagcaatttttgattccaaaaagaaccaaaagttccacaagagatgaaatgctattatacagctgaataatattcataaatcataggaaaatgaacacctatggattg

SEQ ID NO: 89368 - DNA, 601 bp, Human
agaactgtgttcagctatatataacagaaatatctagttaggtagctccataaaatgaaaagttgccccaaacactttgtttttcagctctgcccacccccagaatatagttttatccttatgcttgtaacatgactactgcacctctaatcatcacacatgcattctgggaaggaatcatgagaaagggcaaagggtaaaatatacatatgtcaaataagtctgtcagaaaaacaatagcttccccagaatcccaatttccagatgtggacccatttctgactctaaaggaatttagtaygttgattatttttcattaggcatataactactctgaacaaaatcaggatcctgttatttaaataagtgggaggggtagaactgacattgggtagacaagaagtatcacaacaactgcacataaaataatatttggagaatatttaatattccaacggagaacttggaatgcttcatatagtgacatgataaagtaagcaaatttaaaatgaagcaatttttgattccaaaaagaaccaaaagttccacaagagatgaaatgctattatacagctgaataatattcataaatcataggaaa

SEQ ID NO: 89369 - DNA, 601 bp, Human
tgtcccaacagtaccataaccagcaagatgtcaaatatacaagaaacaataaaccattttcaaatgcacaaggcctaagagaatactaatccaagagcccaggtaaaatatcaatcaagtgtgagagtgacactgaaagtctcaaaattttatctcccatctacccactcttaagaaaacattggaggatatgctccaaagccaggaaaaccaaaagaaaggagagagacagacagagacagagacagagagacagagagagaaagagagagagaagaagaaagcctaagaaataggattyaacacagaagagacatgaaattaagttctagaaaaacagattggaactgtgcaggcctagtaagcaatcagattagaacagagggtgaagactccaggaacatatctcctgggaagaaaatgaagctgttgaaatacttgatatacttgacaactgtactagtcagaactgtgttcagctatatataacagaaatatctagttaggtagctccataaaatgaaaagttgccccaaacactttgtttttcagctctgcccacccccagaatatagttttatccttatgcttgtaacatgac

SEQ ID NO: 89370 - DNA, 601 bp, Human
ctgtaatcacaccagtgtactcaagcctgggtgacagagtgagatcctgtctcaaaaaaaagaaaaaaggacaaacattaaagaaattttctaaaaatatgatggacatggtagacaaagattataaaacagaataacgggtattcctcaagtatataacttacaaatgaagcagaaaaaaaatgtaaacatcgaatttttaaaattacaaaaagaaaagaaaattccctaaaataaaaggaagaagtgaacctggagatcatatggaataactcacgttgagatgtaacctgattaattytcaaagactttttaaacaggtttttttagcatgcagaaaaaaaaaatcaagtcacctgcaaaggagaaaaatctttggctatcttcagatttcttcacagcaaaattcattgcagaagaaaattaagtaatgtctacagagttctcaaaagaagaaaagggtgtgtcccaacagtaccataaccagcaagatgtcaaatatacaagaaacaataaaccattttcaaatgcacaaggcctaagagaatactaatccaagagcccaggtaaaatatcaatcaagtgtgagagtgacactgaa

SEQ ID NO: 89371 - DNA, 601 bp, Human
gagcctggaagggcgaagctgcaatgaactgtaatcacaccagtgtactcaagcctgggtgacagagtgagatcctgtctcaaaaaaaagaaaaaaggacaaacattaaagaaattttctaaaaatatgatggacatggtagacaaagattataaaacagaataacgggtattcctcaagtatataacttacaaatgaagcagaaaaaaaatgtaaacatcgaatttttaaaattacaaaaagaaaagaaaattccctaaaataaaaggaagaagtgaacctggagatcatatggaataaytcacgttgagatgtaacctgattaattctcaaagactttttaaacaggtttttttagcatgcagaaaaaaaaaatcaagtcacctgcaaaggagaaaaatctttggctatcttcagatttcttcacagcaaaattcattgcagaagaaaattaagtaatgtctacagagttctcaaaagaagaaaagggtgtgtcccaacagtaccataaccagcaagatgtcaaatatacaagaaacaataaaccattttcaaatgcacaaggcctaagagaatactaatccaagagcccaggtaaaat

SEQ ID NO: 89372 - DNA, 601 bp, Human
ccatcacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactatactaggaatggtttttctatgtactttatatgaaaatgtatgaagttacttatctaagaaaaattggtgtttctgaaggacatcaacccaagaaaacttatttttaactaacattttttaacagagttctttaaagcrtttcacaaaggtcagtatgagctgattttttttaatgtgaacatttccacaacaaattttaaaaattggaatgaatcagcaacttagatgacacagcctgaagtatttcctaataaatgagaatgagaaaaggtccattatttcacttataaattaattaagagcttccaacctacaatgtatcaggccttcctcacctaccagacatctattttaatgaattaaaatatactacattgtgatcaaactaaaatagaccatttcaaaatctagagggaacaggaggtgtactcctgagat

SEQ ID NO: 89373 - DNA, 601 bp, Human
aaaatggtcagcatgtcaaatggataactaaccagcaccatcacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactatactaggaatggtttttctatgtactttatatgaaaatgtatgaagttacttatctaagaaaaattggtgtttctgaaggacatcaacccaagaaaacttatttttaactaacattttttaacagagttctttaaagcgtttcacaaaggtcagtatgagctgattttttttaatgtgaacatttccacaacaaattttaaaaattggaatgaatcagcaacttagatgacacagcctgaagtatttcctaataaatgagaatgagaaaaggtccattatttcacttataaattaattaagagcttccaacctacaatgtatcaggccttcctcacctaccagacatctattttaatgaattaaaatatactacattgtgatcaaactaaaatagaccattt

SEQ ID NO: 89374 - DNA, 601 bp, Human
aggcagtagctaaccactaaaggaaatgttaaaaaagcaaaggtcaatgtctggccctaaatttttaattccaacaacatggctagaactgttcaaattagaaaatggtcagcatgtcaaatggataactaaccagcaccatcacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactayactaggaatggtttttctatgtactttatatgaaaatgtatgaagttacttatctaagaaaaattggtgtttctgaaggacatcaacccaagaaaacttatttttaactaacattttttaacagagttctttaaagcgtttcacaaaggtcagtatgagctgattttttttaatgtgaacatttccacaacaaattttaaaaattggaatgaatcagcaacttagatgacacagcctgaagtatttcctaataaatgagaatgagaaaaggtccattatttcacttataaattaattaag

SEQ ID NO: 89375 - DNA, 601 bp, Human
atctgtcaaggtctccactgggttgaggaaggcagtagctaaccactaaaggaaatgttaaaaaagcaaaggtcaatgtctggccctaaatttttaattccaacaacatggctagaactgttcaaattagaaaatggtcagcatgtcaaatggataactaaccagcaccatcacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactatactaggaatggtttttctatgtactttatatgaaaatgtatgaagttacttatctaagaaaaattggtgtttctgaaggacatcaacccaagaaaacttatttttaactaacattttttaacagagttctttaaagcgtttcacaaaggtcagtatgagctgattttttttaatgtgaacatttccacaacaaattttaaaaattggaatgaatcagcaacttagatgacacagcctgaagtatttcctaataaatgagaatgagaaaagg

SEQ ID NO: 89376 - DNA, 601 bp, Human
atatatatatacacacacacacgcacacaaatatatatttttatatatataggcactaaactttactggcccctaaataaattaacaggaataacaactagctctggaagcaattacttgtaatagggaatctgtcaaggtctccactgggttgaggaaggcagtagctaaccactaaaggaaatgttaaaaaagcaaaggtcaatgtctggccctaaatttttaattccaacaacatggctagaactgttcaaattagaaaatggtcagcatgtcaaatggataactaaccagcaccatyacctagtgcttacatacagcatactataagccccatgctagacaagtacatgaattttcagcaggacatacacagaatcatggggatggagggtgaagaggaaaggggatttattttgtctaaaaaaatttttttttttcagaatatagctctactatactaggaatggtttttctatgtactttatatgaaaatgtatgaagttacttatctaagaaaaattggtgtttctgaaggacatcaacccaagaaaacttatttttaactaacattttttaacagagttctttaaagcgtttc

SEQ ID NO: 89377 - DNA, 601 bp, Human
gaaaactgccccccatgattcaattatctccacctggtcccactcttgacatgtggggattattacagttcaaggtgagatatgggggggacacagacccaaaccatatcatgtgtcttggtgtgcattcagaatttctcctacttagattctgatgagcttcctgaatgtgttgattagtgtgtcatcaaattgggaagttttcagccatttttttcttcagccattctatttgcccctttctctctctcctttcctcctggaatatgtattatgtgtgttggtgcacttgatgtcatcrcacaggcctcttaagtctcttgagctctgttcatcttcatgctttttgactttctactccctagactagataatctcaattgacttaagttcacccattcattttctgcctgttcaaatctgctgttgattgctacttgtgaatacttcatttaagttattatacgttttccctctagtatttctagttggtttctttgcatcatttctctatacatactgatactctctacttggagagtcattgttttcctggtttcatttagctgtttcagcatatttaacatggtgatttaaaacc

SEQ ID NO: 89378 - DNA, 519 bp, Human
ggtgggccctaatacaatgtgactagtgtcctaataaaagaaggaaatctggatactcaggaaaaccctaggaatatgcggacacagtgagaagatggccacctgtaagcaaaggacagaggcctcaagagaaaccaaacctgccaacaccttgagatcttgcacttctagacatcagaactgtgagaaaataaatttctgttgtttaagccacccaatctgtggtattttgtcatggcaactgtagcaaactaaaacaataatacaactactttgggaaaaagactgacaggttcttgcrgaaccaaaatatatccaccttatgatccaataattctatatctaggtattgacccaacatatacaaaaacataaaaagatttgtgcaagaatgttcctaacagatttattacaataggcaaaacactggaaatagcccagtatttattaatatgagaatggataaactatgggaatattcatacaatagactattattcagcaaaataacactgaaaa

SEQ ID NO: 89379 - DNA, 601 bp, Human
ttggttgttatgggccaaactgtgccccccaaccctaaattcttatgttgaagccttaacctccaaatatgactatatttggagacagggcctttaaagaggtgtttacattaaaatgaggccattagggtgggccctaatacaatgtgactagtgtcctaataaaagaaggaaatctggatactcaggaaaaccctaggaatatgcggacacagtgagaagatggccacctgtaagcaaaggacagaggcctcaagagaaaccaaacctgccaacaccttgagatcttgcacttctagayatcagaactgtgagaaaataaatttctgttgtttaagccacccaatctgtggtattttgtcatggcaactgtagcaaactaaaacaataatacaactactttgggaaaaagactgacaggttcttgcagaaccaaaatatatccaccttatgatccaataattctatatctaggtattgacccaacatatacaaaaacataaaaagatttgtgcaagaatgttcctaacagatttattacaataggcaaaacactggaaatagcccagtatttattaatatgagaatggataaactatgg

SEQ ID NO: 89380 - DNA, 601 bp, Human
tcacctttattaccttggcatttagagtagtcacataaaagacactgaatatacccacttgccttctgaattccaaggcagcctgaagggtgctagtgccatctcaagatttacaccaggatgaaacaatctctgcaacctgctgtggcctgagactcttgcaaaatgtttaaaagtgactttaacacatcatgacattcccacataatctaagacactgcactagtcaactcaggctgttataacaaaataccacagggtaggtgcctgaaacaagagacatttatttctcacagttctmggggctgaaaagtccaagatcaaggggcaggtgattcaattcatggtgaaggccctcctcctggtgtgtggacagctacctcatatggtggaagagaggaagcaagcttcttagaagggcactaatcccattatgaggtccccactctcatgacttcctctaaacttcattacctcccaaaagctaaagtaacctgaggcattgcctttaagaataccaacttttatccatctctaaatatcatcaccctggggctaagtcttcaaatatgcactcagaggggatgcaaacattcagtcc

SEQ ID NO: 89381 - DNA, 601 bp, Human
ttaagaaacttctagtattaataaaacacttgcacaaatacctctttgaaacctgagaaccaccccatgtggtaaacaaagcaggtatttactatctttttcacagatgaaagaactgaggtgcacacaatttacataaattatcaatagtcacagagattaaaaatggtagagccaggatttgaactcgggaattattattctttatcctgtcacctctcacctttattaccttggcatttagagtagtcacataaaagacactgaatatacccacttgccttctgaattccaaggcagcctgaagggtgctagtgccatctcaagatttacaccaggatgaaacaatctctgcaacctgctgtggcctgagactcttgcaaaatgtttaaaagtgactttaacacatcatgacattcccacataatctaagacactgcactagtcaactcaggctgttataacaaaataccacagggtaggtgcctgaaacaagagacatttatttctcacagttctcggggctgaaaagtccaagatcaaggggcaggtgattcaattcatggtgaaggccctcctcctggtgtgtggacagctacct

SEQ ID NO: 89382 - DNA, 601 bp, Human
aggttaaaagtaaaaagatggaaaaatacatagcatgctaatattaatcaagggaaagcacaataactatattaatatgagataaagtacacttcagagcaaagaaaattacaacagagaaggacattatagaatgacaaaatggataatctacaatgaaggttatataccatataattccatttatataacattcttgaaataacaaaattatggaaacagaaagattagcagttgccaggggttaagggttgggagtaaggttaaacatgtggaataaagtcggtttggctatgaaacrgcaacatgaagattccctgtgatggaaatgttctcagttttgactgtatcaatgtcaatatcctggttgtaatactgtattagagttttgcaagacattaccattggggaaaattgagtaaaggttatgccagatctctctcaattatttcttaaaatttcatgtgaatctaaattatcttttaaaaaccatttaattgaataaaactaaggagataaaaatcagtaagtcacttaaaagcaatttgttgtatttatgcattgttatacataacaataaagaaaattatctaaaatgttt

SEQ ID NO: 89383 - DNA, 601 bp, Human
aaaagacaaaggctggcaaagtagattaaaacccatgactcaactatgtgctgcctataagaaattcaccataaacataaagataaaggcaggttaaaagtaaaaagatggaaaaatacatagcatgctaatattaatcaagggaaagcacaataactatattaatatgagataaagtacacttcagagcaaagaaaattacaacagagaaggacattatagaatgacaaaatggataatctacaatgaaggttatataccatataattccatttatataacattcttgaaataacaaaaytatggaaacagaaagattagcagttgccaggggttaagggttgggagtaaggttaaacatgtggaataaagtcggtttggctatgaaacggcaacatgaagattccctgtgatggaaatgttctcagttttgactgtatcaatgtcaatatcctggttgtaatactgtattagagttttgcaagacattaccattggggaaaattgagtaaaggttatgccagatctctctcaattatttcttaaaatttcatgtgaatctaaattatcttttaaaaaccatttaattgaataaaactaa

SEQ ID NO: 89384 - DNA, 601 bp, Human
gagtgagaccctatctctaaaaaatttcaaaaaaataggttttaattaataaaaaaagagatatattcaaattaactgcagataagcaaagatggaattctaaaaaatgttgaaataacccacagttaagagaaatgaagactagagagaacaaacaaaaaacaaaaaactaaatgggacgcttaagccttaaaaataaataattagattaaatgtaaatcagtatgctgattaaaagacaaaggctggcaaagtagattaaaacccatgactcaactatgtgctgcctataagaaattcmccataaacataaagataaaggcaggttaaaagtaaaaagatggaaaaatacatagcatgctaatattaatcaagggaaagcacaataactatattaatatgagataaagtacacttcagagcaaagaaaattacaacagagaaggacattatagaatgacaaaatggataatctacaatgaaggttatataccatataattccatttatataacattcttgaaataacaaaattatggaaacagaaagattagcagttgccaggggttaagggttgggagtaaggttaaacatgtggaat

SEQ ID NO: 89385 - DNA, 601 bp, Human
ctctgggaggccgaggtgggcagatcacctgaggtcaggagttcaagaccagcctggccaacatggcgaaaccctgtctcactaaaaatacaaaattagcctggctggtggggcacacctgtaatcccagctactcgagaggctgaggcaggagaattgcttgagctcatgaggcggaggttgcagtgagccaagatcgcgccattgccctccagcctgggcaacaagagcaaaattccatcttaaaaaaaaaaaaaaaaaaaaggccaggcacagtggctcacgcctgtaatcccagcaytttgggaagccgaggtgggtggatcacgagatcaggagttagagaccagcctggccaacatggtgaaactccatctctactaaaaatacaaaaattagccaggcatggtggtggacgcctgtaatcccagctactcaggaagctgaggcaggagactcacttgaaccctgggaggcggaggttgcagtgagtggagattgcgccactgcactccagcctgggtgacagagtgagactccatctcaaaaaaaaaaaaattataaagtttaaagaaagaaatagaagatataaagaccaaat

SEQ ID NO: 89386 - DNA, 601 bp, Human
agaaggttttagcaaagaattataaagtctagactgggtgcagtgacccatgcctgtcatcccagcactctgggaggccgaggtgggcagatcacctgaggtcaggagttcaagaccagcctggccaacatggcgaaaccctgtctcactaaaaatacaaaattagcctggctggtggggcacacctgtaatcccagctactcgagaggctgaggcaggagaattgcttgagctcatgaggcggaggttgcagtgagccaagatcgcgccattgccctccagcctgggcaacaagagcaamattccatcttaaaaaaaaaaaaaaaaaaaaggccaggcacagtggctcacgcctgtaatcccagcattttgggaagccgaggtgggtggatcacgagatcaggagttagagaccagcctggccaacatggtgaaactccatctctactaaaaatacaaaaattagccaggcatggtggtggacgcctgtaatcccagctactcaggaagctgaggcaggagactcacttgaaccctgggaggcggaggttgcagtgagtggagattgcgccactgcactccagcctgggtgacagagtga

SEQ ID NO: 89387 - DNA, 601 bp, Human
gctgtaaacatggacgtgggaggaagcagaatctaacggagactgggctgaaggccgaggcgagagaacgaagactgaggcggcgctgacggcggccggtgtgcctcagcttgccatcaggagtcgttacctttgctaagctcggagggtttcacctctaggagttcctcagcagtctggaaccccgcagacaccagcttcacccgcaccgctggagacagcgggaaactcaccaaatcccgctgcatttcaaagcggaacgtcttcccgcgcatcgcaggctcacctgctaaccccggarcagccaaactccgcacgccctcgctggggcgtgcggcgtgacgtcagacgtaaagcggaaggggccggctctgcggcctggccgcacggggctccgggccttgcagctttgcgcagtcttgtaaattttcacacttatgcaccattccgttttgattccccaaaatcccatttagagattcctcatcaaatgtacaccctgactgtaaaacgatggacggagaccataggacggagagccaggcccagtgggttctccacgccacatttccttgcctccaccgtggcctgttaggtgaag

SEQ ID NO: 89388 - DNA, 601 bp, Human
ttcttgctaaaagtaaaaactattatcctagttaagatgtttcaagttacatttaagctaatacagccaaacatttctattagctctatcaactggttataatgaattagaaagcaactaacataagtcctaaaaatggtcatgtctgttgacttagtaatcacatttcaggtaacacttaggggaaatcatttttaaaaattaaaaactacaaataaaatcactcaatgtggtggtataacgatgaatcagaaaactcaatttctagcaaggaaaatagtttaaaaattgtgaactataygatcaattacatagttactaaagatgataaaaaaatacaacatggcaatgctgatagtgtaatattatataaaaagctaagtatattttatctacattatgattatagccatttaaaaaatacaaatacttttggacaagaactagagggaagaccaaaatgtgccaaaagtaagatgtgctggaacaataaagttgtgggtaaattcttgctttaattttgaactttaataatgctatattggtagttgtcaaaaaatagtttcaatactgaaaagcccaaaataacacacaacgtgat

SEQ ID NO: 89389 - DNA, 601 bp, Human
gacctcaggtgatccacccaccttggcctcccaaattgctgggattacaggtgtgagctacctcacccagcctgttctgtgcattattgtaagatgttttgaagcagccctggcctttacctactatataccagcagcatccccttcagttgtgacaaatgtcccctaagggaaaaaaaaaatcatcccccttccccactcagttttgagaatcaccgctccatggtattccaatcaccacagtatagtgaaatcctatgtacagcctctaacaaattaatggcacctgccaatgggaacrtctgaaggttgtacaaactagcataaaaacctgaaggttgtacaaaccagcataaaaaatgaacagagcatggaatttgctttaactgcctacaggaagctaaacatgagtttatcaaaaaacacactatcaaaaaaacacactaaaatgctatctttctccccttgtcagtcaatctacaaaatgactgtcaactttctgttttgtctttattaacattttgcctctagtactatcaattaccttatttacagcctctgaaagccattattgatactttgtttatctggcagtgtagct

SEQ ID NO: 89390 - DNA, 601 bp, Human
tctttcctacaaccttcactaaaatataaggtttaaagtagcacatgttctaaaagacagagttctactctggagtaatcatcatgtgggtgtcattcttttgattttctataatgtaaaagttatctttaccttgcaatccacttttatccaaaaaattgcttaagttaaacaacgtgtttcttgaagccaaatactgaataaaacgctggaaaaaaaaaattacatcatattaaggtactgccatctcaccaactctaattcgaaaattaggaggaaaagttatggttaacacattctrttaagcttatctagtttaaatttctcatcctcactctttccattaactagttaccaaacctaaaaacataatacatatttttcactagcatgcgagaatttattaaagcctaatgcccacagatatagtattaagtcaaaacaataaaagcaaataggcagtggaagcagtagttttggttttattacagcatactaaaactatagctaatcatttttaggtggcatctgtattttaaacagccgtctggtaaaccaaagttttggctttaaaaaaaaaatacttctaaacatacaagaa

SEQ ID NO: 89391 - DNA, 601 bp, Human
ttaaatcagataagtcctatgtagttttaaaaaaaaaacctcttcccttagaacttcactattctctcaatattcctattctttattcatcaggaattagaaaaacatgttcttttacacaacttgataatctcaactcaaatttaacatcctatggaaccacaatcccattcctcaaatcaagcaactttatataatttttatactcctaaaatctttagctgtatttagaaccataacttgtatgtgccaaccttataaaaagtataaaaaattactgtgtaatataagaaatggcaayatgcaagttcagggtgtaacaaaaacaattatatgaatgttttcaatgaaactttctaaatgaatacataaatcattctaagattttgtttcatcatgaccttgacttgaaaactttagcaacataaaatctaatcaatattattttctaaaaacaccaaaaactttgtgttttagttattacctggctcaaggaagtctataaatttttgctcctcattgaaaagtgaacccattttatctcatattcatctaacaaatttaattacttggtctttgctacctttaaaagacaatacca

SEQ ID NO: 89392 - DNA, 601 bp, Human
aagagagagacaagtttttataaatgactaaaaatcccaatatgcctagaaaaacaactcattgcatccaatggctataaaatgtcttgatatcccaattcaatttagtatgtaaattaagtaactaattaataacattaccattaaattctcttaaggcttcatatttaaatcagataagtcctatgtagttttaaaaaaaaaacctcttcccttagaacttcactattctctcaatattcctattctttattcatcaggaattagaaaaacatgttcttttacacaacttgataatctaaactcaaatttaacatcctatggaaccacaatcccattcctcaaatcaagcaactttatataatttttatactcctaaaatctttagctgtatttagaaccataacttgtatgtgccaaccttataaaaagtataaaaaattactgtgtaatataagaaatggcaatatgcaagttcagggtgtaacaaaaacaattatatgaatgttttcaatgaaactttctaaatgaatacataaatcattctaagattttgtttcatcatgaccttgacttgaaaactttagcaacataaaatcta

SEQ ID NO: 89393 - DNA, 601 bp, Human
agaaactattcaagtggccatcaccttatgaacagataaacaaaatgcagtatatgtccataaagtaaaatatgatttggctagaaaaaggaataaaatactgatatatgaaataacatggatgctataacttggacatatcatgctacacaaaggtcacatattgtataatttcatttatatgaaatgttcagaatagacaagcccagagacacagaaagtagattcatggttgccaggatctaggggaagagggactaggaaatgaatgctaataggtatagagtttctttgtggaggkgataaaaatgttctgaaattagtggtgatgttggacaactttgtaaatacactaaaaaccaatgaattacacactttaaaatgataaattttgttatgtgaatgatatctcaataaaggtgctataaaaagaacttaaaaacaaatcctaccacaaaaagtacttgatatacctcatcaaagaaaaatgaggctcatcttttaaaactggctaaaatttcataattcataatctagtaactcctatgttttacatttttaaaaattcaaatcaattagatgtcaaaaaaagcttaactca

SEQ ID NO: 89394 - DNA, 601 bp, Human
aaatctaatgttcacagcaccattattcctaataggcaaaagtagaaactattcaagtggccatcaccttatgaacagataaacaaaatgcagtatatgtccataaagtaaaatatgatttggctagaaaaaggaataaaatactgatatatgaaataacatggatgctataacttggacatatcatgctacacaaaggtcacatattgtataatttcatttatatgaaatgttcagaatagacaagcccagagacacagaaagtagattcatggttgccaggatctaggggaagagggamtaggaaatgaatgctaataggtatagagtttctttgtggaggtgataaaaatgttctgaaattagtggtgatgttggacaactttgtaaatacactaaaaaccaatgaattacacactttaaaatgataaattttgttatgtgaatgatatctcaataaaggtgctataaaaagaacttaaaaacaaatcctaccacaaaaagtacttgatatacctcatcaaagaaaaatgaggctcatcttttaaaactggctaaaatttcataattcataatctagtaactcctatgttttacattt

SEQ ID NO: 89395 - DNA, 601 bp, Human
agtaatttcacaaaatgttgctgggataactcaatatccacatacaaaagaataaatttggactcacctctcacaccatatacaaaagttaattccaaatagataagaacctaactatatgggcaaaaaatacaagattcttagaataaaaagtaggagtaaatctttgtgaccctggattaaacaatgatttcttagacatgattacaaaagtacaagcaaccaaaggaaaaaaaagatacacttaattaattaaaaatgtttgttcttcaaaaaacaccaacaagaaactgaaaagacmagccatgggagaaaaatatttgcaaattatttatgcgataagaaactggtgcccagaacatattttttaaaattcttgcaacttaacaataaaaagggcaagtaacccaatttaaaaatgagcaaaaggccaggtcagtagctcaagcctataatctcaacactgtgggaggccaaaatgggaagactgcttgagcccaggagttcaagaccagccttggcaacatagtgagaactcatttgtatgaaaatttttttaaaaattaactgagcatagtgttgcatgcctgtgttcccagct

SEQ ID NO: 89396 - DNA, 601 bp, Human
agaatcgcttgaatctggaaggcggaggttgcagggagcagagatcacgccactgcactccagcctgggtgacagagtgagactctgtctcaaaaaaaaaaaaaaagttagcttctacctcatgtttttcctaccatggtagattccaaatgaatccaagattaaaatataaaacacctaatccataaatataactgatgaaaacataatcattttagctcactgagcttgcttgaaagataaaaaacataaaaatgaagataatgattttgatcacctaagattgtaaagcttttaacartgttaaaaaacaaggaaaaatactcataacctataacaatttattttcctaatatacaaaaagttcatttgttgagtgtttgttatgtgttaagcactacatacaatatcccatttaattctcacaacaatcctgacaggaaagtactaattaacatcgtaattttacagatgaaataactcagagcttaagtaaggccttcccagttttgccacagcatactagtatggtagaaagggttataagtgtgccaagatgttgatcctttttaaccctttagcctcaagtagtctcttgtat

SEQ ID NO: 89397 - DNA, 601 bp, Human
actggggctaacgtacacaactaatattaagagcttattatatatcacactaagtattattcagagattgccctatcattttcaaatcctcattctactgatttactgtttggctgagtaacaaggcatttccaaaaaatatgtcaggttcccctaatttacaaatgacctatacttataaatggctgttctaccctacgataaaccatgaactatgacctcagacgccaaaaaacaattaagctataaaaagcaacaactgtgctttgtaggacacaacaaagtttaataaccaaatacyagactgccttaagtagtcacctattgatcagcttcggcctaattctccctaatgtgttaacttatggatgcctgtttccgctcaagtgctaaacagcattggctggaagcagctgctggagcttgggctgaggacaccattccttcttttgcaactcttcttactgatgtcatttttttacctctggttacttctccatcacagaagatttgaacattggctcagtctttcttgtcattagcttcaacatctacatggacaaccaatccaacaccttgatgtcaaaatccctgattctaa

SEQ ID NO: 89398 - DNA, 601 bp, Human
aactactttattacaaaataaagaacaattttaccaaatcattctaatctggctattacacaagagatactttcaatggacagcctttaataaaatagtctgttaaatatttccaaacagatatttctaaagatagagaaattattggcagcaccaaaacagatttaaaaaccagtacatgaaaggtactggggctaacgtacacaactaatattaagagcttattatatatcacactaagtattattcagagattgccctatcattttcaaatcctcattctactgatttactgtttggytgagtaacaaggcatttccaaaaaatatgtcaggttcccctaatttacaaatgacctatacttataaatggctgttctaccctacgataaaccatgaactatgacctcagacgccaaaaaacaattaagctataaaaagcaacaactgtgctttgtaggacacaacaaagtttaataaccaaatactagactgccttaagtagtcacctattgatcagcttcggcctaattctccctaatgtgttaacttatggatgcctgtttccgctcaagtgctaaacagcattggctggaagcagc

SEQ ID NO: 89399 - DNA, 601 bp, Human
aataaataataaacaaaacattgttaagatagatgacaaaaaaacagaacagagttgaaaacgttaacttctaacacattataaatgaatgacaaagctggcagcttggttcaagtcatggtcattaaaacaaaaattccagcgaacacaatgcccttgggcaatagctacataataagctattataactgctatttaaacttcttcttctgaataattgccatgctttgagtcccattaaatagacaaaagtaaaatattaagttggctatttatttaaaaaatatccctgtacattttyaagatctaaaagccattatcaaaagaaaatatattttcagatcaatcctttcaccactttagcttgtatatcttaaaattctagagctagagaagcactaaagaaataaatccaaaacagtcataaaaatcagaaagtaatttgacttgagactattttataaaaaatccttagccatataggatatcaggatgtgaaaaactagagtctgtgaaaacttgaggttaaaaattctcatgaattataatgacctaattttttaaaatcttaaattacaaaagcataactcacattaaaatc

SEQ ID NO: 89400 - DNA, 601 bp, Human
tgcttgagcccaggagttggaggctgcaatgagctatgatcatgccacagaactccagccagggtgacagagaaaaatgctgtctcaaaaaaacaaaaaaaagatgaaaaagcaaaaacagacacctgttgagaagttagtggctcacccttttggaatataagcaatatttattaaaaatttaaatgtttatattatttgaaccaccacattctttttctgggtgttaaacctattaaaataggtttacaaatagaaacacacacacacacagagggagagacagacaagagacagagaraggagagagaattgagtgtagcactgtttaggataaaaaaacagaataaacatctatcaacaggaggattagataaattgttattatacaacaaagtacaatacagacattgaaaagaataagaaattttaaacaaatacaatatattaagaaaaatatgcatggttggaccctgagattctatacaaaccaaaataatgttgaataactgcatcagtaccccatgccttctagagcaggggtcagcaaacttttttttgtaaagggtcagatggtaaatattttagactgtgggccaca

SEQ ID NO: 89401 - DNA, 601 bp, Human
gcagctgagcatggtggtgtacccctgtagtcccagctactcaggaggctgaggtgggaggattgcttgagcccaggagttggaggctgcaatgagctatgatcatgccacagaactccagccagggtgacagagaaaaatgctgtctcaaaaaaacaaaaaaaagatgaaaaagcaaaaacagacacctgttgagaagttagtggctcacccttttggaatataagcaatatttattaaaaatttaaatgtttatattatttgaaccaccacattctttttctgggtgttaaacctattraaataggtttacaaatagaaacacacacacacacagagggagagacagacaagagacagagaaaggagagagaattgagtgtagcactgtttaggataaaaaaacagaataaacatctatcaacaggaggattagataaattgttattatacaacaaagtacaatacagacattgaaaagaataagaaattttaaacaaatacaatatattaagaaaaatatgcatggttggaccctgagattctatacaaaccaaaataatgttgaataactgcatcagtaccccatgccttctagagc

SEQ ID NO: 89402 - DNA, 601 bp, Human
aaaaaggtatttgcagactatctagtagagctgatgtccattatatagggagaatcctaataataaataaagtaaatgaaaacaatttacaaaataaaaaatacatatggataataacgtgaaaagaaatacaacttcacttatcaggtaaattaaaatacaataatcaaatcaaattactaaaatatcctttcctgaacatcagactatattactcagtgcccataagaatgaaaaaagaaaagaacacggtagctcatgcctgtggtcccagcactttgtgaggccgaggcaggaggaytgcttgagcctggcagtttcaaatgagaccagcctgggcaacacagcaagaccttgtctctacaaaaaactaaaaccaagaaaaggcagctgagcatggtggtgtacccctgtagtcccagctactcaggaggctgaggtgggaggattgcttgagcccaggagttggaggctgcaatgagctatgatcatgccacagaactccagccagggtgacagagaaaaatgctgtctcaaaaaaacaaaaaaaagatgaaaaagcaaaaacagacacctgttgagaagttagtggctcaccctt

SEQ ID NO: 89403 - DNA, 601 bp, Human
tttgtttttttcccatctttttttattgtggtaaaatacctgtaacataaaacttactatcctttttgttttttttttttttttgaaactgagtttcgctcttgttgcccaggctggagtacaatggcacgatctaggctcactgcaacctccgcctcctgggttcaagcaattctcctgcctcagcctaaaacttactatcttaacccagctaaattttaaaggcacttttatatttctaaaaattaataaaatgggtggaaaaaacatagatacatctaaaaaataaagttcatcttgytgaacatcctgggtataaaaatatgtaatcacttgcagaagtaattaggtataaaactcttttctccaaattaactgttacaatgaatgaatatatcataataaatttttagccagctttaagtaacaactcagtcaatattgtttatccatatgacacaagataagaaatgttattaggctacagcagtatttacccaacaaattaataattccttcattgtatgctgcaaacagtctaatggcatctttgaacaggagcatgaaggcagcatttattaccccatttgtaagttcattg

SEQ ID NO: 89404 - DNA, 601 bp, Human
aggttaatttatactaattatagtattgaagactatgccttccaaagctttatagaaaaacctttatttttcacttgtgaaaaaataagccaaatttccctatccctatagattaaagcatccctgagtaagtccacgttacttcagactataaaaaacagatttaaattttttaaaagttcattatggagttgattatgagaaaacaatattcttctgggacaaaatatttgtttttttcccatctttttttattgtggtaaaatacctgtaacataaaacttactatcctttttgtttwttttttttttttgaaactgagtttcgctcttgttgcccaggctggagtacaatggcacgatctaggctcactgcaacctccgcctcctgggttcaagcaattctcctgcctcagcctaaaacttactatcttaacccagctaaattttaaaggcacttttatatttctaaaaattaataaaatgggtggaaaaaacatagatacatctaaaaaataaagttcatcttgctgaacatcctgggtataaaaatatgtaatcacttgcagaagtaattaggtataaaactcttttctccaaat

SEQ ID NO: 89405 - DNA, 601 bp, Human
gaggttgcagtgagctgagatcatgccactgcactctagcctaggcgacaatagcaaaactctatgtcaaaaagaaacaacaacaaaaaaatgtcctggaataattcaaaacaaggtaaaacagatgtcaacaaatgagagagttgatggaaatgttacaaggatagcttatgccaggtactttcattcttaatactccgtaaagaaaacagagaatcagccagaacaaccagcaggtatgaagttttttcctagaaaattttttgatgatgatgatgataaagacaatattaaaatagcmaacattagttgagtgtgtttaatgctctaatttttttttttggcattaacttatttaatcctgtgaactacttactgtctgaggtaggtactgttgtatcttcattttacagatgatgaaactgaagaatagaaagtaacttccccaaagtcacagggccagctaatggcacagccgggactgaaatttcgacgtatcccaaaccctactctcttaatcttatgttttgtggtttatccctaaattaatactcccacctgagtcaaacagtcaaagtggaagtttaaaacaggaaaaata

SEQ ID NO: 89406 - DNA, 601 bp, Human
gagatacagtttctggatacaggatctaaaaatagttaaaggggcaatacctgctaatttctctatcattgatggctttaacaacttctttcatccactattccctctatataccaggaccttagcccaagggagacacagtagaaaaccatttaaaaccaaatactacattggaagatgaacttctttgttgaactgagagtatacatacactttcaaacagccccagcaaaaatgtttgctaatcagcaagcaaagcactgtcttaagagctttcagagatgataaggaggatgttgaygatagtggttaacatttaaaaagctcttctcacacaacaggtactgtgctagctaccttgtagtagtcactgaatctatgaagtagacactactggtatatccatattacagataaacaacctgagacagtgaagattaagtaatctgtccaagatcacatatctgatacacaacagaagccaagatagggaaggtatctctgactttaaagactacataattaactactatggtaccaaatcctggactgaaactgtggtcatagaaactgtagtttatcttttttctgaagggtttaa

SEQ ID NO: 89407 - DNA, 601 bp, Human
tacgtttttttttttaatggaagactaattttaaactcaggctataggtcaaatctcaacttaatatgaagaaagctctcaaaaggaaaccttttcagtgtgcagactaagaactgtccgctctaagtgaagcaaatgcaccagtagcatttacttaccctaaatattctataggatttgagatacagtttctggatacaggatctaaaaatagttaaaggggcaatacctgctaatttctctatcattgatggctttaacaacttctttcatccactattccctctatataccaggaccytagcccaagggagacacagtagaaaaccatttaaaaccaaatactacattggaagatgaacttctttgttgaactgagagtatacatacactttcaaacagccccagcaaaaatgtttgctaatcagcaagcaaagcactgtcttaagagctttcagagatgataaggaggatgttgacgatagtggttaacatttaaaaagctcttctcacacaacaggtactgtgctagctaccttgtagtagtcactgaatctatgaagtagacactactggtatatccatattacagataaacaac

SEQ ID NO: 89408 - DNA, 601 bp, Human
tggcatgcatctgtagtcccacccttgggaggctgaggtgggagaatcgcttgaacccaggaggtggaagttgcaagtgagttgagattgtgccactgcactccagcctgggcaatagagtgagactctgcctcgggggaagaaaaaaaaaatgtatcttataactacaaagcaccacataaaacaatgcattagcatctttaggagaaattttgacatcataaacacaattctaaactatgcagtcactgtcattatcttaacagatgctgacatttattgaaggtcagaaacaatttcragaatttgcatgtattaatccatttaatcctaatactaattctatgaggctgatattatgattaaacccattttatagaaaatgaaatcaagatatagagaaattaaacagcttggaacttgagctggtttcatctactgcctcagaaaaatcactctggctttttggcctacaaagaatgatatacctgcttgcagctgtagaatctttgattttctttccttccaaggaagctaaatgttgttccaaagcatcaagaagactgctaggggcctgcaattgtacaaatattaagaattt

SEQ ID NO: 89409 - DNA, 601 bp, Human
gattgagcaaattaatacgaaagtatcttgcaattataggcctggcacggtggttcatgcctgtaatcccagcactttgggaggctgaggtgtgcagatcacttgagttcaggggttcgagaccagcctgctcaacatggtgaaaccctgtctctactaaaaatacaaaaattagccggccgtggtggcatgcatctgtagtcccacccttgggaggctgaggtgggagaatcgcttgaacccaggaggtggaagttgcaagtgagttgagattgtgccactgcactccagcctgggcaayagagtgagactctgcctcgggggaagaaaaaaaaaatgtatcttataactacaaagcaccacataaaacaatgcattagcatctttaggagaaattttgacatcataaacacaattctaaactatgcagtcactgtcattatcttaacagatgctgacatttattgaaggtcagaaacaatttcaagaatttgcatgtattaatccatttaatcctaatactaattctatgaggctgatattatgattaaacccattttatagaaaatgaaatcaagatatagagaaattaaacagcttg

SEQ ID NO: 89410 - DNA, 601 bp, Human
aaaattcaaagtacaaatctaggattaaaaatgagtactaaaatccaataacggcatttccctttggaaattatttaaattttattactaaaagaaagatcaaaagttctgaaacaaccagaaagtctaaaaagaaccaaaggaaggttctcactatacaaattctttcttcatgctgttttaaaaaaaggttcataagaaaacatgagaataactcaagtaatttcttaacccaatacaaaaatcatgttaccagactgatatgaaatgatttctgttactttcaatttgctaggttaamtggtcttagtctgaggaattagcttaaaacataataaagtgattaaaatataaaatatcaataatcaaccccatgaactggcattaggcagagatgatgcaatttgatgtcagatattctaggtttgagtcccagcattgctactacatacttcacagggctattgtgaggattgagcaaattaatacgaaagtatcttgcaattataggcctggcacggtggttcatgcctgtaatcccagcactttgggaggctgaggtgtgcagatcacttgagttcaggggttcgagaccagcctg

SEQ ID NO: 89411 - DNA, 601 bp, Human
cctcaacattaactttccaaatgttaactctaggctaagtaaaacaagtggtaaagaattctaacctgaagaactaccttgagctttattaattttccttttaccacacaccaaacatcattagtttctactcttaagcacgtaaagtggtaaaaactaccttttaaattttatgtaatattagtattataaataagccaataaaaaggtacaattcagaagacaaaggaagaataacatagttgtgacagaaatgcaagaaaaccaataaattttatgataaacatttcaggtaaattgstgcacctgaactacgtggctctttttttcgttattctctcaaataaatgagacttattgttttgactgctacttcgaaaatcttactagaaaattcaaagtacaaatctaggattaaaaatgagtactaaaatccaataacggcatttccctttggaaattatttaaattttattactaaaagaaagatcaaaagttctgaaacaaccagaaagtctaaaaagaaccaaaggaaggttctcactatacaaattctttcttcatgctgttttaaaaaaaggttcataagaaaacatgagaa

SEQ ID NO: 89412 - DNA, 601 bp, Human
tgctttggggaacatatagaatatacaataataattctgtaaatgggctgtaagatttgcccttaattactattaaaaaggtgaaaatttttagtatgtgacataaaacatagtgaaattagttctttatccaataatttgtttcagcctcgaacaatgaacattcttttcacttctttctcctaggacagacttcttttcaagatctccatgttgagaacttgccccttaatggggtcaatgttacttaactggggattaaagaaggtagcatacatgagcaaacaaatcataaagctgraagaaaaaaaagaactaaattcaacaaacacctactaagatttcagggagcaggtagcaactgagcatgcatacagcaagcagttcacgtagtaaaacttacactgagctattaggctcagctattaggagtcagtaggcaggcagatgagcttttaagggtgagttaataaacagcaacaacaaagtgaaaggaaaaaactcaccactctctatggaacatttaacatgtgctaataatgcactgtgctaaaacctagtcacctgggagcatcttaaaaacaaaaattcttgggcccca

SEQ ID NO: 89413 - DNA, 601 bp, Human
tttatgggatacatatgatattgtgatacatgcataccatgtaattatcaggacatctatcacacctcaaacattcatcatttctctgtgttgagaacattctaaatcttctagctactttgatatagataatacaattatttttaattagtaattctactgtgctatcaaacactagaacttattccttctaactgtatttttataaaaaagttttgaagacatgtcttttagatgtacaatagttgtgtagatagtagatataaacgcatttagtgctttggggaacatatagaatatmcaataataattctgtaaatgggctgtaagatttgcccttaattactattaaaaaggtgaaaatttttagtatgtgacataaaacatagtgaaattagttctttatccaataatttgtttcagcctcgaacaatgaacattcttttcacttctttctcctaggacagacttcttttcaagatctccatgttgagaacttgccccttaatggggtcaatgttacttaactggggattaaagaaggtagcatacatgagcaaacaaatcataaagctgaaagaaaaaaaagaactaaattcaa

SEQ ID NO: 89414 - DNA, 601 bp, Human
ctagcttgtacggctgggctcaggccttcctcctgcctcaacctcctgagtagctgggacaacaggcacacgccaccacacccagctcctaatttttaacttatatattctccaaaatagaatgtttttctttttaaatggatatacaataattgtacatatttatgggatacatatgatattgtgatacatgcataccatgtaattatcaggacatctatcacacctcaaacattcatcatttctctgtgttgagaacattctaaatcttctagctactttgatatagataatacaattrtttttaattagtaattctactgtgctatcaaacactagaacttattccttctaactgtatttttataaaaaagttttgaagacatgtcttttagatgtacaatagttgtgtagatagtagatataaacgcatttagtgctttggggaacatatagaatatacaataataattctgtaaatgggctgtaagatttgcccttaattactattaaaaaggtgaaaatttttagtatgtgacataaaacatagtgaaattagttctttatccaataatttgtttcagcctcgaacaatgaacat

SEQ ID NO: 89415 - DNA, 601 bp, Human
tgttgcccaggctagcttgtacggctgggctcaggccttcctcctgcctcaacctcctgagtagctgggacaacaggcacacgccaccacacccagctcctaatttttaacttatatattctccaaaatagaatgtttttctttttaaatggatatacaataattgtacatatttatgggatacatatgatattgtgatacatgcataccatgtaattatcaggacatctatcacacctcaaacattcatcatttctctgtgttgagaacattctaaatcttctagctactttgatatagrtaatacaattatttttaattagtaattctactgtgctatcaaacactagaacttattccttctaactgtatttttataaaaaagttttgaagacatgtcttttagatgtacaatagttgtgtagatagtagatataaacgcatttagtgctttggggaacatatagaatatacaataataattctgtaaatgggctgtaagatttgcccttaattactattaaaaaggtgaaaatttttagtatgtgacataaaacatagtgaaattagttctttatccaataatttgtttcagcctcga

SEQ ID NO: 89416 - DNA, 601 bp, Human
ttgagagagaaacagacaaacagaccaagagatgttgcccaggctagcttgtacggctgggctcaggccttcctcctgcctcaacctcctgagtagctgggacaacaggcacacgccaccacacccagctcctaatttttaacttatatattctccaaaatagaatgtttttctttttaaatggatatacaataattgtacatatttatgggatacatatgatattgtgatacatgcataccatgtaattatcaggacatctatcacacctcaaacattcatcatttctctgtgttgagawcattctaaatcttctagctactttgatatagataatacaattatttttaattagtaattctactgtgctatcaaacactagaacttattccttctaactgtatttttataaaaaagttttgaagacatgtcttttagatgtacaatagttgtgtagatagtagatataaacgcatttagtgctttggggaacatatagaatatacaataataattctgtaaatgggctgtaagatttgcccttaattactattaaaaaggtgaaaatttttagtatgtgacataaaacatagtgaaatta

SEQ ID NO: 89417 - DNA, 601 bp, Human
tactcgggaagctaaggcagagggaatgcttgagcccaggaggttgaggctgcagtgagccatggctgtgccactgcactccagcctgggtgacagagtaagtcactgtctcaaaagagagagagagattgagagagaaacagacaaacagaccaagagatgttgcccaggctagcttgtacggctgggctcaggccttcctcctgcctcaacctcctgagtagctgggacaacaggcacacgccaccacacccagctcctaatttttaacttatatattctccaaaatagaatgtttttstttttaaatggatatacaataattgtacatatttatgggatacatatgatattgtgatacatgcataccatgtaattatcaggacatctatcacacctcaaacattcatcatttctctgtgttgagaacattctaaatcttctagctactttgatatagataatacaattatttttaattagtaattctactgtgctatcaaacactagaacttattccttctaactgtatttttataaaaaagttttgaagacatgtcttttagatgtacaatagttgtgtagatagtagatataaacg

SEQ ID NO: 89418 - DNA, 601 bp, Human
ggatggtctcgatctcctgacctcatgatgcgcccacctcagcctcccaaaatgctgggattacaggcatgagccaccatgcccggccgacttctatgtgattttaatgaacaactcaaaacatgaccccagagtgtctaagaattcaaacacagtacagataatttttttaagagaaggggtctggaggctgagtgtagtggctcatgcctgtaatcccagcactttgggaggctgaggcgtgcggactgcttgagttcaaaagttcaagatcagcttgggcaaaatggcgaaaaaataygaaaaatagttgggcattgcggagtgcgcctgtagtcccagctactcgggaagctaaggcagagggaatgcttgagcccaggaggttgaggctgcagtgagccatggctgtgccactgcactccagcctgggtgacagagtaagtcactgtctcaaaagagagagagagattgagagagaaacagacaaacagaccaagagatgttgcccaggctagcttgtacggctgggctcaggccttcctcctgcctcaacctcctgagtagctgggacaacaggcacacgccaccacacccagct

SEQ ID NO: 89419 - DNA, 601 bp, Human
gccaccacgcccggctaattttttatatttttagtagagatggggtttcaccgtgttagccaggatggtctcgatctcctgacctcatgatgcgcccacctcagcctcccaaaatgctgggattacaggcatgagccaccatgcccggccgacttctatgtgattttaatgaacaactcaaaacatgaccccagagtgtctaagaattcaaacacagtacagataatttttttaagagaaggggtctggaggctgagtgtagtggctcatgcctgtaatcccagcactttgggaggctgasgcgtgcggactgcttgagttcaaaagttcaagatcagcttgggcaaaatggcgaaaaaatacgaaaaatagttgggcattgcggagtgcgcctgtagtcccagctactcgggaagctaaggcagagggaatgcttgagcccaggaggttgaggctgcagtgagccatggctgtgccactgcactccagcctgggtgacagagtaagtcactgtctcaaaagagagagagagattgagagagaaacagacaaacagaccaagagatgttgcccaggctagcttgtacggctgggctcaggc

SEQ ID NO: 89420 - DNA, 601 bp, Human
gctaatttttgtcctttagtagagacagggtttcaccacactgcccaggctggcctcgaactcctgacctcagatgatccacccacctgagcctcccaaagtgctgggattacaggcgggaggcaccatgcctggcttacatgatatatttctacctcaagacttctatgtaattttttttatttgagacagagtctcgctccgtcgcccaggctggagtgcagtggagcgatcctggctcactgcaagctccgcctcccgggttcatgccattcttctacctcagcctgccaagtagctsggactacaggcgcctgccaccacgcccggctaattttttatatttttagtagagatggggtttcaccgtgttagccaggatggtctcgatctcctgacctcatgatgcgcccacctcagcctcccaaaatgctgggattacaggcatgagccaccatgcccggccgacttctatgtgattttaatgaacaactcaaaacatgaccccagagtgtctaagaattcaaacacagtacagataatttttttaagagaaggggtctggaggctgagtgtagtggctcatgcctgtaatcccagc

SEQ ID NO: 89421 - DNA, 601 bp, Human
aataaaagaacagtacaagatttggggattatgaaaaaaatcatacctttgctttgtcatatactataacagcagcattatatgtaaaatgttacatatttaagtgttcaagtaaatagttaacttcaaaataccttaagcatttaatgttatgatctaagcttctcatacatgagatttcttttcttttcttttctgtctcccaggttagagtgtggtggcacaaatctcggctcattgcaatttccgcctccggggttcaagtgattctcatgcctcggcctcccaagaagctgagatkacagatgtgtaccaccacacctggctaatttttgtatttttagtagagacagggttttgccatgttggcgaggctgttctggaactcctgtcctcatgtgatctgcccaccttggcttcccaaagtactgggattacaggtgtgagccatcgcacctggccttatatgagatttctttatttcagtctaagtttaagttagtttagtctaactttaattttaaaaattaaaaaaaatatatcgatctgattgtcctggatatgagtactgacttgaattagaactttcttggcttaaagt

SEQ ID NO: 89422 - DNA, 601 bp, Human
gcttcaaatattcaacagtgtaccaaactgataatattgtatatttttagatataaaaattcaaagtttgctatcatccaaaattttcagggtgatgaaaacctaggtcttctcagatattagtattcaataccgactgcttgtttagactccacaacatttgttgaaaaagtcaaggctcattaataatacaatgaggccaacaagagagcttgtgttctcccattttcattctaccaaaaggtagaatcttaaatgtctttcatatatacatataaacttttcttccctttatctctawcttatcactaatctatgactaggaatgcgcatcatttctgtggtgtttaaaagaactaaattaaatactacgtctgttattggcattcatttttagctaataaaagccaataaaagaacagtacaagatttggggattatgaaaaaaatcatacctttgctttgtcatatactataacagcagcattatatgtaaaatgttacatatttaagtgttcaagtaaatagttaacttcaaaataccttaagcatttaatgttatgatctaagcttctcatacatgagatttcttttcttttct

SEQ ID NO: 89423 - DNA, 601 bp, Human
gagatggggtatcaccatgttggccaggctggtctcaaattcctgacgtcaaatgatccacccacctcaacctcccaaagtgctgggattacaggcgtgagccaccacacacctggcgcaaaagtttaattttatgctacactagagtcatctaaaaaaatccaaaaaaagttaaaacaaggattaaaatggcaccacagtcatattatcgcctttaagtcctaaacaactgatacctacattcacacacactaaactgatttttttttttaaacatggtagagacaaggtattgctatattgcccaggctggtctcaaattcttgggctaacgcaatcctcctgccttggtctcctaaagtattgcaattacaggtatgagccactgcacctgcccagataatcaaattttttcatcaagtgttttgtgtttcatgccagctaaaagtaaagcaaattaaacttcagaatggataattctattacacctaaactaaaatctgaaatcttgcttcaaatattcaacagtgtaccaaactgataatattgtatatttttagatataaaaattcaaagtttgctatcatccaaaattttcagg

SEQ ID NO: 89424 - DNA, 601 bp, Human
ttcataattagatcaatcagataaggaaaaccagttcctaatctacttgacaaaacactacaggtaatctacaagatgttaatctattaatggacattacactataataataaaaaccaattcattaaggtataataataacgctccagctatttcaagttaacctattaaactggcaattcgaaatcccttaaagtttttttttttttttttaaataagagtcttgctctgttgcctaggttggaatgcaatggcataatcatagcttactgcagcctcgacctttctgtgctcaagcartccccccactttagccttctgagtagctgggaccacaggtgtatggcaccatgcctggctattttccgatttttttgtagaggcaaggtcttgccatgttgtccaggctggtctcgaactcctgggctcaaataatctgcctgtctcagctcccaaactgctgggattacaagtgtgagccactgcacccagtctaaaatttttaaatatagttttgtccctttttttttcattattcattcaagtttaattttttcatttttttgagacagaggttcgctctgtcgcccaggctagaat

SEQ ID NO: 89425 - DNA, 601 bp, Human
tatttctgtaacagatccattggtttatgagaaaacacatgttcaggaaaggttaccagtcatccgctgttctactgacagataggttttatctagcacctaatttcaatcacttcctattacgtgaaacaccttagagaagaatattcagaaatatttgcaaatgcattcataattagatcaatcagataaggaaaaccagttcctaatctacttgacaaaacactacaggtaatctacaagatgttaatctattaatggacattacactataataataaaaaccaattcattaaggtayaataataacgctccagctatttcaagttaacctattaaactggcaattcgaaatcccttaaagtttttttttttttttttaaataagagtcttgctctgttgcctaggttggaatgcaatggcataatcatagcttactgcagcctcgacctttctgtgctcaagcaatccccccactttagccttctgagtagctgggaccacaggtgtatggcaccatgcctggctattttccgatttttttgtagaggcaaggtcttgccatgttgtccaggctggtctcgaactcctgggctcaaa

SEQ ID NO: 89426 - DNA, 601 bp, Human
gtcagacaagtaaaatatctgtttttcacgcaaaaaaagccatgaaatacgtaattttttaaagacacattatttctgtaacagatccattggtttatgagaaaacacatgttcaggaaaggttaccagtcatccgctgttctactgacagataggttttatctagcacctaatttcaatcacttcctattacgtgaaacaccttagagaagaatattcagaaatatttgcaaatgcattcataattagatcaatcagataaggaaaaccagttcctaatctacttgacaaaacactacargtaatctacaagatgttaatctattaatggacattacactataataataaaaaccaattcattaaggtataataataacgctccagctatttcaagttaacctattaaactggcaattcgaaatcccttaaagtttttttttttttttttaaataagagtcttgctctgttgcctaggttggaatgcaatggcataatcatagcttactgcagcctcgacctttctgtgctcaagcaatccccccactttagccttctgagtagctgggaccacaggtgtatggcaccatgcctggctat

SEQ ID NO: 89427 - DNA, 601 bp, Human
ccaaagtgctggcattacaggcatgagccaccacacacggccgaatgttctgtttttaaatacatgatattaacagctgcatagagttttaaaagtacattatattttgtcagacaagtaaaatatctgtttttcacgcaaaaaaagccatgaaatacgtaattttttaaagacacattatttctgtaacagatccattggtttatgagaaaacacatgttcaggaaaggttaccagtcatccgctgttctactgacagataggttttatctagcacctaatttcaatcacttcctattaygtgaaacaccttagagaagaatattcagaaatatttgcaaatgcattcataattagatcaatcagataaggaaaaccagttcctaatctacttgacaaaacactacaggtaatctacaagatgttaatctattaatggacattacactataataataaaaaccaattcattaaggtataataataacgctccagctatttcaagttaacctattaaactggcaattcgaaatcccttaaagtttttttttttttttttaaataagagtcttgctctgttgcctaggttggaatgcaatgg

SEQ ID NO: 89428 - DNA, 601 bp, Human
tcctgagtagctgggattacaggcgcgtgccaccacgctcagctcatttttctatttttagtagagacgggggtttcaccatgttggctaggctggcctcgaactcctaacctcaggtgatccacccgccttggcctccccaaagtgctggcattacaggcatgagccaccacacacggccgaatgttctgtttttaaatacatgatattaacagctgcatagagttttaaaagtacattatattttgtcagacaagtaaaatatctgtttttcacgcaaaaaaagccatgaaatacgtarttttttaaagacacattatttctgtaacagatccattggtttatgagaaaacacatgttcaggaaaggttaccagtcatccgctgttctactgacagataggttttatctagcacctaatttcaatcacttcctattacgtgaaacaccttagagaagaatattcagaaatatttgcaaatgcattcataattagatcaatcagataaggaaaaccagttcctaatctacttgacaaaacactacaggtaatctacaagatgttaatctattaatggacattacactataataataaaaa

SEQ ID NO: 89429 - DNA, 601 bp, Human
aacctcctgagtagctgggattacaggcgcgtgccaccacgctcagctcatttttctatttttagtagagacgggggtttcaccatgttggctaggctggcctcgaactcctaacctcaggtgatccacccgccttggcctccccaaagtgctggcattacaggcatgagccaccacacacggccgaatgttctgtttttaaatacatgatattaacagctgcatagagttttaaaagtacattatattttgtcagacaagtaaaatatctgtttttcacgcaaaaaaagccatgaaatamgtaattttttaaagacacattatttctgtaacagatccattggtttatgagaaaacacatgttcaggaaaggttaccagtcatccgctgttctactgacagataggttttatctagcacctaatttcaatcacttcctattacgtgaaacaccttagagaagaatattcagaaatatttgcaaatgcattcataattagatcaatcagataaggaaaaccagttcctaatctacttgacaaaacactacaggtaatctacaagatgttaatctattaatggacattacactataataata

SEQ ID NO: 89430 - DNA, 601 bp, Human
aataaatggaacactgggaaaaaagaatcagaaaacagtaattcagaaatagaaactagaaaatagttaaatagttacaagaagttgcaggggggcacggtgggtttttttgttttcttctttttgagagtgggtcttgctctgttgcccaggcagactgcagtggtacaatcatagctcactgcagcctcaaactcctgggctcaagtgatgctcccacctcagccttccgagtagctgagactacaggcatgtgccaccatgcctggctaatttaatttttgtagagatgctatgataycaacgctagtcttgaacacctgcctggactcaagcaatcctcctgccttggcctcccaaagtgctgggattacaggcatgagccaacaaggacattggtttttagtactaaaaatatatatatattttagctaatatatatactgatggccactctagcttcttcttgcataagaaaggagttgcattaagcttacagttggccagttaggctgaaagttctgggtgtgttttgtttttttttttttgagacagagtcgaactcgctgtgttgtctaggctgaagggcaatggtgtgatc

SEQ ID NO: 89431 - DNA, 601 bp, Human
atatagtattcttatggaacatcaattcacactaaaaaaaaaaaagtcctacaaatctatcaaaatatgctgattatgctattcaaactcgaaatctttcccatcattccacccccaataaatggaacactgggaaaaaagaatcagaaaacagtaattcagaaatagaaactagaaaatagttaaatagttacaagaagttgcaggggggcacggtgggtttttttgttttcttctttttgagagtgggtcttgctctgttgcccaggcagactgcagtggtacaatcatagctcactgyagcctcaaactcctgggctcaagtgatgctcccacctcagccttccgagtagctgagactacaggcatgtgccaccatgcctggctaatttaatttttgtagagatgctatgataccaacgctagtcttgaacacctgcctggactcaagcaatcctcctgccttggcctcccaaagtgctgggattacaggcatgagccaacaaggacattggtttttagtactaaaaatatatatatattttagctaatatatatactgatggccactctagcttcttcttgcataagaaaggagttg

SEQ ID NO: 89432 - DNA, 601 bp, Human
gaacttttctatatagtattcttatggaacatcaattcacactaaaaaaaaaaaagtcctacaaatctatcaaaatatgctgattatgctattcaaactcgaaatctttcccatcattccacccccaataaatggaacactgggaaaaaagaatcagaaaacagtaattcagaaatagaaactagaaaatagttaaatagttacaagaagttgcaggggggcacggtgggtttttttgttttcttctttttgagagtgggtcttgctctgttgcccaggcagactgcagtggtacaatcakagctcactgcagcctcaaactcctgggctcaagtgatgctcccacctcagccttccgagtagctgagactacaggcatgtgccaccatgcctggctaatttaatttttgtagagatgctatgataccaacgctagtcttgaacacctgcctggactcaagcaatcctcctgccttggcctcccaaagtgctgggattacaggcatgagccaacaaggacattggtttttagtactaaaaatatatatatattttagctaatatatatactgatggccactctagcttcttcttgcataag

SEQ ID NO: 89433 - DNA, 601 bp, Human
tggtatcttcatagtactaggtactgtattttactcttaagattgtatgattgaacattaagaaggcaacagtggcctaaggaccagctcatttactatgatataggcacacttcctttaaagtcaaaaaattcaaggcaagcattctacaagctcaaatacaactgtctgaaaaaggaaaaaaaaaaatcaagaaaatactcaggttatgattttaaaaacaacacatcttttaaatacaactttttctgtagtaagaacttttctatatagtattcttatggaacatcaattcacactaaaaaaaaaaaagtcctacaaatctatcaaaatatgctgattatgctattcaaactcgaaatctttcccatcattccacccccaataaatggaacactgggaaaaaagaatcagaaaacagtaattcagaaatagaaactagaaaatagttaaatagttacaagaagttgcaggggggcacggtgggtttttttgttttcttctttttgagagtgggtcttgctctgttgcccaggcagactgcagtggtacaatcatagctcactgcagcctcaaactcctgggctcaagtgatgctccc

SEQ ID NO: 89434 - DNA, 601 bp, Human
gtgtgttgtgagtaaactttcaaagaaaaaaagagggtaatgacaaattagggctaagaagctgtttttggcatgtgcagataattcctgcatagattcaaaataaaaaataaagatgaagaaaaaaatctaaggatgggggaaagaattttagataattaagaacagagatgaaagaatgtccacttaatagactgcgaacacctttgaatgtctatctaagagctttagtctttaaatgaattgctaaaggaacaacaaaagtgttgtttgcctactagaatgatataaatatgtattmtatcaaatcctttatctaaagttattctagagtcagataattattatactgataccttattcaagataattatcattctaatgactgaaatctatttttccttacttctcaagatttaaagagctaactaaatggggaaagaaaaaataaaaagcagcaaaaatagtataattttttctttgtaacataattaaaataagaggatactcctgtaattctcaacagtggaatcttcttgtctgttctagtttagttcttgaccttcactgaaatatactgtggtatcttcatagtactagg

SEQ ID NO: 89435 - DNA, 601 bp, Human
gtagtaaaagtagatacatctgaagaaatggaaaggtgaacatcaccactactttttgtgaggaaaggatttaagcttggaatggcatcatcaacagcatctacagtagcagagaaaggatctgtgcagtccaaatgtattatagcaaaatgaagaaaggaagtaaataaattagtattgtaattagtcaaaagatgcaaagtgaaaagtagtaactatattattgtttattaatcttaaatatctaaattatcaaaaacaaaaaatacctaatcatcaagatagaagaattgcatttaayatatttttaagtgaatccttagaaaaaatccttttatttgttaacaccacaaagccaacagtcaggtagttaaaaaatggaataataaccaagatgtttctataaagagccacccatcctgcaccaatcttccctgtcctaggtgagtgtgctggtcgtggtggtatagctgtgtttacttgaataattgatattgacaattggtatgtgtgttgtgagtaaactttcaaagaaaaaaagagggtaatgacaaattagggctaagaagctgtttttggcatgtgcagataattcctgcat

SEQ ID NO: 89436 - DNA, 601 bp, Human
ctaaaagcaataaagaaaaaatcaatgtttaagattttagttgatgactacataataatttaggtgagaagtacattctaattatgatgtggtccacatatacaagaattttaaattctttaaattttctgagagatagggtcttgcatgttgccgaggctggcctcaaactcctggcctcaagctatcctcctgcctcagcttcctaattagctggaattatgggtaccagctactgtacccagctcccgagatggtttttagtagtagtcattttgatacttttatatacctagcaaartgctagatgttacatagtcatgtatgtaaacttcaggacaatcctgcaagacactattatcccaacttgcatagccttaaaaaggttaaatacttgcttaaagtcaagttcatgaagcagaactaaaattcaaacctaagttcactaggctccaagcatataccatcaaatgccctaataaattccattttaaaatacatttagtcctgtccaattcttgtaatcaagagcctcaattctttagttgtgtcaaacattctttttaatgccaacttaactacagtaataactactatgcac

SEQ ID NO: 89437 - DNA, 601 bp, Human
attagcaaagaaccatacaagctgatccacactaatgatactactttaaagtagcattttacacatcctataatgactattctgtagcgcacacatttttagagaatgtaccagtttgatcttgttccataatcacgtaacccttaaactactattaagtcaaagacattggtcatacaatgagaacacaaaacactatcaaaatacgaaataatttagtatataaatcttctgactattcatcaaaaggatctgagaatcctagacttaccaatttaataatatttttaagtgtgcaagrtgtttaagaattatgccatcagcttattggttgttctcttaactctttacataaaaagcgaatgtatctactcaagaaaaaaatccatcatgcttaattatgtgtccatgctatcatcagagtgtaagtagtacaaacaatgttctttaaatcattctggtaataatcttggctattgatgtcactaacttttagattatatatggaacaacaatttaaaattaggccaatatatcaaattcccattttctcctgctactttgcctcagccttctagaatatgattgatataagagataa

SEQ ID NO: 89438 - DNA, 601 bp, Human
tcagcctatacagagttaacaaatataagatttccaattatgtgaggttatatttaagtaaggttctgaatgtctaggggctgaaaagaattaaaatcccctaaaaatattaggtctgtcatgtgatttggagaactttcaatcattgagtatatccaaataaatatcaacttcacaaggatcacaaagaagaaattatttcacctcgtggaatgtcataaggctcctaaggtctcttccttttctaaattctactaagtcagaatataaaaaacccaagaagcaaacaaaaaccacctayattagaaggttaaaaactacaccattagggagaagttaaacttttggtgtcctaaatttaggatccctttcttcccctcctctattcaggtcagaatctcactttgaattcttaatgtgtaacaccaggacataaagtataatgatgtcatgctgtactagagagactgatctcaaagaaaactgtaaaaagtaggacaagatttggtgagatgtccaagaaggtcctcaaagacagaaacaacaatttattattagcaaagaaccatacaagctgatccacactaatgatactacttta

SEQ ID NO: 89439 - DNA, 601 bp, Human
aactcaagcatactaattaaggtgactctagttttgcaacacaaaaccattaacagaccttattctttcttgcctgcgttacactaatgctagtggtattacacagacaataagctcacatctttaagatcagcctatacagagttaacaaatataagatttccaattatgtgaggttatatttaagtaaggttctgaatgtctaggggctgaaaagaattaaaatcccctaaaaatattaggtctgtcatgtgatttggagaactttcaatcattgagtatatccaaataaatatcaacytcacaaggatcacaaagaagaaattatttcacctcgtggaatgtcataaggctcctaaggtctcttccttttctaaattctactaagtcagaatataaaaaacccaagaagcaaacaaaaaccacctatattagaaggttaaaaactacaccattagggagaagttaaacttttggtgtcctaaatttaggatccctttcttcccctcctctattcaggtcagaatctcactttgaattcttaatgtgtaacaccaggacataaagtataatgatgtcatgctgtactagagagactgat

SEQ ID NO: 89440 - DNA, 601 bp, Human
tacaattacttatacttctaaactcagtaacaatccttctatttatgtctatcactttaaaaacattttcatgttacatatttaactaaattattcaactgttagtctatcaggagctttttcaactcaccattgttgccgcattccaagcggttgttggtgcaacctttggttgccagttagatcccccagttaacttcttttcacctggttgactccaatttacatcactttaaataaacataagtgagaatattaaatgtctctaattataaagtttccttagctatatacttatatmgaacagagtaagatagagacttgaggctgggcgtggtggctcatgcctgtaatcccagcactttgggaggccaaggtggacaaatcacttgaggtcaggagattgagaccaacctggctaacacggcgaaaccccgtctctactaaaaatacaaaaaaattagccaggcatggtggtgggtgcctgtagtccagctacttgagaggctgaggcagaagaacggcgtgaatccgggaggcggagcttgcagtgggccgagattgcgccactgtactccagcctgagcaacagagcgagact

SEQ ID NO: 89441 - DNA, 601 bp, Human
aatagggataataatagtgactaacacattaataggaggattataaaaaataaaacattattatttactggaatatgtctggcacaaagtaacccttaaatacttgttagccactaaaatgtatctggtaaatataggcaaccagcttcctttgaaagaaatacaattacttatacttctaaactcagtaacaatccttctatttatgtctatcactttaaaaacattttcatgttacatatttaactaaattattcaactgttagtctatcaggagctttttcaactcaccattgttgcmgcattccaagcggttgttggtgcaacctttggttgccagttagatcccccagttaacttcttttcacctggttgactccaatttacatcactttaaataaacataagtgagaatattaaatgtctctaattataaagtttccttagctatatacttatatcgaacagagtaagatagagacttgaggctgggcgtggtggctcatgcctgtaatcccagcactttgggaggccaaggtggacaaatcacttgaggtcaggagattgagaccaacctggctaacacggcgaaaccccgtct

SEQ ID NO: 89442 - DNA, 601 bp, Human
cccccagcaagggttcagtgttcactaattcagtgtttggggtgacttaagtacttaactgccacaaataatgagtatcaactgtgtaagttatatgacatatatataattgccaaacacattgtcatatatataaattatatgacaaaacccaagcaagtatagtttctttaccaataatgaaatcacaagattttgtattttagaaaaataaataaaaaatttgaggtcagtaatatagagtagtgattaaggacatatgttctatagttaggctgcctaggttataaaaattcaactmatcatttaagatctctgtaatcctgagcacattgcttaataactctgagcctccacttcctcatctgtaaaatagggataataatagtgactaacacattaataggaggattataaaaaataaaacattattatttactggaatatgtctggcacaaagtaacccttaaatacttgttagccactaaaatgtatctggtaaatataggcaaccagcttcctttgaaagaaatacaattacttatacttctaaactcagtaacaatccttctatttatgtctatcactttaaaaacatttt

SEQ ID NO: 89443 - DNA, 601 bp, Human
actctggcaccagttagtgcgacagccttaagcaagtcacttaacacttctgaactttatttcctctttcataaaataaatagaatatactagaatgaggttttctaaaaggaccgtctatgtgacatatacatatatgcatatatttcccccagcaagggttcagtgttcactaattcagtgtttggggtgacttaagtacttaactgccacaaataatgagtatcaactgtgtaagttatatgacatatatataattgccaaacacattgtcatatatataaattatatgacaaaaccsaagcaagtatagtttctttaccaataatgaaatcacaagattttgtattttagaaaaataaataaaaaatttgaggtcagtaatatagagtagtgattaaggacatatgttctatagttaggctgcctaggttataaaaattcaactaatcatttaagatctctgtaatcctgagcacattgcttaataactctgagcctccacttcctcatctgtaaaatagggataataatagtgactaacacattaataggaggattataaaaaataaaacattattatttactggaatatgtctgg

SEQ ID NO: 89444 - DNA, 601 bp, Human
taccatatataacacagcaagataaagactgttaccttatcaacttaaatacaaattctacatgactaaatacctactacattttagtagtcagtcttaagtgctatctatgaactcctaatacttcatatagattaatactaacttaatataagaaaatattcattatattttaatagcagcactggtatttatatcattcctcatacatcatcaatgtcataattcacacgagtccataaaatccactactctaaactcctaccataccctagtcagtgaggtgtgttatagtgggaaraagactggattcagagtcaaagagatggatttcaacttaaatctgcttttcaactgctttgcacttagggaaaaaaaaaatctttagaagtggggtgatacatgctccaattccctcaagacagcaacatttacatgtttaagattgtgtatttgtgtgtataaaaatctaaactacttaaatgcaaagttttaaaatcagtgatgataggctgggcgtggtagctcaggcctgtaatcccagcactctgggaggctgaggcgggtggatcacttgaggtcagcagttcaagaccagcct

SEQ ID NO: 89445 - DNA, 601 bp, Human
taattaaaagaatttgtagtataatatatattttaataaaattccaatgaatttgtgttaaatttaaaaaacactgaaaaaccttgacagtgtttaaggattaataaaaaggttagaaatgtaaagaaatgtcaaaagcagcagtttatcttaagtagtgaatcacattatcagccccaaacattagccattaaaaagaaaactccataaaatacatataaatattttagcaaaatccttaggagatgatacacattaccatatataacacagcaagataaagactgttaccttatcaacytaaatacaaattctacatgactaaatacctactacattttagtagtcagtcttaagtgctatctatgaactcctaatacttcatatagattaatactaacttaatataagaaaatattcattatattttaatagcagcactggtatttatatcattcctcatacatcatcaatgtcataattcacacgagtccataaaatccactactctaaactcctaccataccctagtcagtgaggtgtgttatagtgggaaaaagactggattcagagtcaaagagatggatttcaacttaaatct

SEQ ID NO: 89446 - DNA, 601 bp, Human
caacagtgcaaaattttgggcatcgcataaacagggttgcatcagatgtctaccacagaaaaaaagcaagcactaattaaaagaatttgtagtataatatatattttaataaaattccaatgaatttgtgttaaatttaaaaaacactgaaaaaccttgacagtgtttaaggattaataaaaaggttagaaatgtaaagaaatgtcaaaagcagcagtttatcttaagtagtgaatcacattatcagccccaaacattagccattaaaaagaaaactccataaaatacatataaatatttwagcaaaatccttaggagatgatacacattaccatatataacacagcaagataaagactgttaccttatcaacttaaatacaaattctacatgactaaatacctactacattttagtagtcagtcttaagtgctatctatgaactcctaatacttcatatagattaatactaacttaatataagaaaatattcattatattttaatagcagcactggtatttatatcattcctcatacatcatcaatgtcataattcacacgagtccataaaatccactactctaaactcctaccataccc

SEQ ID NO: 89447 - DNA, 601 bp, Human
acacagagagcattttagttcacatgtacattcactaactacctaaaatcccttgtatttccagtatctaatgaaagaacatctatactaaaacactatcaaggttgacaagggaattgtagtctttggcctcatctctttatataaaaaatagtttattgattacaagtaccattaaaacatcaattctatcaacagtgtcaacagtgcaaaattttgggcatcgcataaacagggttgcatcagatgtctaccacagaaaaaaagcaagcactaattaaaagaatttgtagtataatawatattttaataaaattccaatgaatttgtgttaaatttaaaaaacactgaaaaaccttgacagtgtttaaggattaataaaaaggttagaaatgtaaagaaatgtcaaaagcagcagtttatcttaagtagtgaatcacattatcagccccaaacattagccattaaaaagaaaactccataaaatacatataaatattttagcaaaatccttaggagatgatacacattaccatatataacacagcaagataaagactgttaccttatcaacttaaatacaaattctacatgactaaat

SEQ ID NO: 89448 - DNA, 601 bp, Human
aggctggctgtatattaaggttggttgcgtcattacaggaacacttcccatttgtggaggctaaaaaagagaaaaatatcaaaagatactgactcctatcttccttattgtgactaagtaaataacaatgacaacagggatgacaggtcctagtacctttgcttgactcaaagggtaacttcctctgaatataagtaagactaacagctacaaactttcgagagtatttttttttcttttggtaagtaaagtctttaacatgctcatttttaaaatgtagtaacaaagcctaactttttckattcaatgagttgcaaaatgtaaactttattgtattacaacagataaaatgatttagactaagagtttccaaatttatcaggtttagacatcaagaaaacttaagactctgtcttcgctgctaagatatttcaaagtaaatttgtataacaaatcaagtacttttgccattatgcaagtgatcacaagtgaagacagttgattctctgaataagcctgctctagttcttccattttatttcatataagaatcaagaaagagcttaaactacaaaccagaggttaactctttcttgagtaa

SEQ ID NO: 89449 - DNA, 601 bp, Human
aaaccatcctatcacttcacaagagcctcatcccagagtatgccaccagagaagtgaataacaaaggaatttcctatatcttctaaccgtaacgggtaaaacattaaaaaaaaaaaattcttctaatgcaacaataatgggacaaaaaacaatgtatatttatggtgtattttcaggaactgggagagaaaagccttagaaacacgtcaagaggaaagtctctggattaaaccatctaagtttagcatgacatttcaagctttttgactcctttttttggtttttgaaaacaatcctcagyggcagaaagttatctaacgaaaaaataacattcaaaactttttggagagttgccaagagtttcacaagcatctcaaggccaacacgccctgctgtagcatcattctagccattagccaaggaactaaagctctgagttaatggttttgaggttcacaaaggatactacaccagaatcacgaagagcaagtaggctccttaatctcagaaaaatcatcctttggatctaccaactataagttaccaagaattttctgtctttagtatttgctatctacttatcctttccctccaaataatc

SEQ ID NO: 89450 - DNA, 601 bp, Human
gagtagagaaataattttttaaaggaacttttctagtaaatgtgagacaatacattcccattctttctgtatacacagtattatacatggtcactgatgttcgtcatgaagattctgcagaacttcacaggcaccccggactttaagaatactttctggttttatttattaagacaagaaattagatttccttttcgagaatgtcctcagcaaaaacctagtaataagcaaggtcttattctataagttgtcttgttagcaatagtgatcagcagatgagacttctaacatttctatttcraatgattcaggtgtgtgtactaggagctagttttcacctatggtactacatcccaatccccaaggaaacgtccctcatggtattctgcagtaggcaaggatgaatgagcacaacacattgcttacaaggcaaaaagccttcttcacagaaatccagctggagagatcggctgacagaggaggtactgccaatactcacaattaacacaccaagagaataaaacaacaacaacaaaaccaaaaaacaaaaccaaaacgaaacctaaaagcagccactagttcttaaatacaagaaagtact

SEQ ID NO: 89451 - DNA, 601 bp, Human
ataaagtacacaaagtaataccacaattttacaggtaaggaaactaaggctcaaagttacatagagaatttgctctcaacacatggttagctgaggagtcaagtcaagactgctgaattgtgaccccccaaaagatgtgttgaagtcctaacccctggtgcccataaatttgaccctacttggaaacagggtctttgtagatgtaatcaagttaagatgaggtctttggagtgaccctaatttgatgaccagtgtccttataaggagaggcacgtggaggtagagacccatagagagaatkccatgttgacaggtagagactaaatggctacagatgcaaactatggaacgaatggggctaccaaaagctggaaaagccaaggaaggaccctcctctagaaaattcagagggagcatggctctgccgataccctgatttctccagaagtgatagaaaacaaatttctgttttaatttctgtttttaagagcttaaaaacttttaacatgcttaatcaagtttgtggtacactttgttacagcagtcctaggaaactataatataaactctaatgcagatctgctggttccaaggctggtgt

SEQ ID NO: 89452 - DNA, 601 bp, Human
cattttgttttaggggatgccacacagtgacctgggagcattccactttgaatgtatgttgtatctgaacctctctaaaactgtttttccccccccaaagacagggtctagctctgttgcccaggctggagtacagtggtgtgatcattgctaactgtagcctccaattcctgggctcaagtgatccttccactttagcctccaaaagtgttgatatcacaggtgtgagccactgtgcccaattctcctcttagaattagagaataaggacaattcagggaataggaacaatttccaaaarcagggcaacctttaaatattttcttagtcagtttcaaatattttcatttgatccttacagcaaaatgataaagtacacaaagtaataccacaattttacaggtaaggaaactaaggctcaaagttacatagagaatttgctctcaacacatggttagctgaggagtcaagtcaagactgctgaattgtgaccccccaaaagatgtgttgaagtcctaacccctggtgcccataaatttgaccctacttggaaacagggtctttgtagatgtaatcaagttaagatgaggtctttggagtg

SEQ ID NO: 89453 - DNA, 601 bp, Human
cagcaattctcctgcctcagcctcctgagttgctgggactacaggtgcctgccaccacgcctggctaatttttgtattttttgtagagacagggtttcaccatgttggtcagcctggtttcgaactcttgacctcgtgatctgcacccctcccccagcctcccaaagtgctgggattacaggtgtgagccaccgcacccggcccgcattacgcattttgttttaggggatgccacacagtgacctgggagcattccactttgaatgtatgttgtatctgaacctctctaaaactgtttttccccccccaaagacagggtctagctctgttgcccaggctggagtacagtggtgtgatcattgctaactgtagcctccaattcctgggctcaagtgatccttccactttagcctccaaaagtgttgatatcacaggtgtgagccactgtgcccaattctcctcttagaattagagaataaggacaattcagggaataggaacaatttccaaaaacagggcaacctttaaatattttcttagtcagtttcaaatattttcatttgatccttacagcaaaatgataaagtacacaaagtaatac

SEQ ID NO: 89454 - DNA, 601 bp, Human
gttgatgatagtatctcttaaattccttctcccctcctccactactctaatcaatcaataagaaaaaatacggtaaaatgttaccaaaatctttgcattatatccagagcaatgatttttttggttatagagcgtgtttcatatagtctatctatcaacagtgtcttgttctgtcacccaggctgtagtgtagtggcgcagtcacgggtcactgcagcctcaatctcctgggctcaagtgatcctcccatctcagcctcccaagtagctgggattacaggcatgcaccaccacacctggctttttttttttttttttttttttttattaaagttaaggtcttgcaatgttgtacaggctgggtcaaactgactttaataaaggacaaacacacctagcttaaagaaggttaaaaaaagtctattgatagactatcataaaataaaaatggttactccttcattatactcctgttaacatcaaacaaagaaaatttcaggttagaacaagaaaacatcaacaatctcagaaagtgaggctagtggaattaaaagcttatgaaagactaaatggttggatatttaggaaaaaacttgtgacat

SEQ ID NO: 89455 - DNA, 601 bp, Human
tcggcaaatattacatcactagtatatgcaacttgttctggatgccaagatcaatttataggcatcagttatactcatggttgagtaatttcctaatgcatatcttgttcccaaaaacaaatgttcaaagacaatgggaagagacaaatggaacgatgatggaatcacgcaggcagctacagatgggaggacagagcagcatgcctgggcttgaggtttcaaatatcatccatgcagagacaaattaaggtataactactggaaagactccccctcctccctcttcagcgcaaccacggayggccaatcaaaagcacaacgatttcaagtaaagtgatcctcagttactgagctggagggagtccaacatccacacttatctccaagatgaacttggtttctctctgaagcagattttctttttcacctacagttaaaacaacagcaacaacaaatcctacttattgcagatagactgcatctaaaatcagaagtttcctatgatagccccacaccgaaataccttcttaaatcacgttttcaccagggtagcagtctgaagacctgacagacccacagtaaaatgcccctgaagaatacg

SEQ ID NO: 89456 - DNA, 601 bp, Human
tcaattcatacttcaacattcaaatcctatagaggatttctttgctggtgccaagtgatttcatttctttctacctatttatttatttatttatttatttatttattttcggaaaagcactacagagaatgaacagccaatgagcttcggcaaatattacatcactagtatatgcaacttgttctggatgccaagatcaatttataggcatcagttatactcatggttgagtaatttcctaatgcatatcttgttcccaaaaacaaatgttcaaagacaatgggaagagacaaatggaacratgatggaatcacgcaggcagctacagatgggaggacagagcagcatgcctgggcttgaggtttcaaatatcatccatgcagagacaaattaaggtataactactggaaagactccccctcctccctcttcagcgcaaccacggacggccaatcaaaagcacaacgatttcaagtaaagtgatcctcagttactgagctggagggagtccaacatccacacttatctccaagatgaacttggtttctctctgaagcagattttctttttcacctacagttaaaacaacagcaacaacaaa

SEQ ID NO: 89457 - DNA, 601 bp, Human
attcctgaagaaccaagatattaattttcatacatgtatccttcattaagctgacatgagcgtttcaaacccgacatgaacctttttactttggaacaagcttttaattctttttctccctctgtataagattgcaaagcatataagcacaggactattacaaaatgagcttttcttttagggatgtcctagtgagtaataaaagttgactaactggaaatagtttcaattcatacttcaacattcaaatcctatagaggatttctttgctggtgccaagtgatttcatttctttctacctatttatttatttatttatttatttatttattttcggaaaagcactacagagaatgaacagccaatgagcttcggcaaatattacatcactagtatatgcaacttgttctggatgccaagatcaatttataggcatcagttatactcatggttgagtaatttcctaatgcatatcttgttcccaaaaacaaatgttcaaagacaatgggaagagacaaatggaacgatgatggaatcacgcaggcagctacagatgggaggacagagcagcatgcctgggcttgaggtttcaaatatcatc

SEQ ID NO: 89458 - DNA, 601 bp, Human
agctgtgcaactctgacctcagtccggacccaacacatctagctgcaatattctttcctttctttcttcataagggtcgaaaagtcctgtcctaggttcacacactttttacacgaagttgtctcctgctcatttatcttgacgaactgcagctgacacacatactgtgggaggtgaaagggaccttagaggtcacctactgtaactgtccacatactgccctgaatatggggaatacttaagatctttgattctgcttcctgtttggacaaatttacttgattcttagaatctgtcctaytgtttaattcgaatatactgtaaggcaagtaaacaactgaattcagtatgtatctttattctcccaaacacagactattcctgaagaaccaagatattaattttcatacatgtatccttcattaagctgacatgagcgtttcaaacccgacatgaacctttttactttggaacaagcttttaattctttttctccctctgtataagattgcaaagcatataagcacaggactattacaaaatgagcttttcttttagggatgtcctagtgagtaataaaagttgactaactggaaatagt

SEQ ID NO: 89459 - DNA, 601 bp, Human
cagaatccttctaatcgaaagggcttaagtattcacttgcccttaattaaaaagcaaactttatccgatctcatccatttactgtgagcagtggatgagtttactttaaataattatgttacagatattttccaaaagttgtttttccttatgtcctatcttttcattctgcacctaaagaatagaggaagaggaggaggaggagagggagcctagagtcctttaaagaaatgaaagagaagcgtgaattgtgtttaatgtttggtaattgtttttaagtatttaagtccccatctcccamaacaagtagcaatacctaaagtgatttataagaaatcctccaaagagagctctgcaaaggggtcctttcctgaagctctgtgaggactgtgactggaggggctggatgctgccgacagctgggggaaaagaagacagagagagggaaagaaaaaaagatctcagaatgacagaacatgaaagcagaaaatgtatgaaagaagaagtggttttggttttgtcatctttaataaatataagggcagtctttgtagaaaatggattgttaagacaaaagtttcagtcatatgtcaagttaaaa

SEQ ID NO: 89460 - DNA, 601 bp, Human
ttcaaagatatttcactcacaatttcccttaaactgcccatccaaagatctattactgaagtagatgtgctaataaacttgccaaatcagaagactataaactcccaaagatctagaaggtatatctaaactgggggctagagcatcaagaagaacaaattacactgtcttccagcaaacagaggcagtgtggatcatatgcagaatccttctaatcgaaagggcttaagtattcacttgcccttaattaaaaagcaaactttatccgatctcatccatttactgtgagcagtggatgagwttactttaaataattatgttacagatattttccaaaagttgtttttccttatgtcctatcttttcattctgcacctaaagaatagaggaagaggaggaggaggagagggagcctagagtcctttaaagaaatgaaagagaagcgtgaattgtgtttaatgtttggtaattgtttttaagtatttaagtccccatctcccacaacaagtagcaatacctaaagtgatttataagaaatcctccaaagagagctctgcaaaggggtcctttcctgaagctctgtgaggactgtgactggagg

SEQ ID NO: 89461 - DNA, 601 bp, Human
agcctgggcaacaagagcgaaactccgtctcaaaaaaaaaaaaaaaaaaaaaaaagctcattggaactcctgggctcaagcaaccctcctgcctcagcctcctgaatagctaggactgcagacagtcgccaccacacctgggtaatttttgggtgggggtagagactagggtctcaccgtattgcccaggctgatcttgaactactagccccaagtgatcctcccgcatcagcctcccagggtgctgggattacaggcataagcaaccacatccaggccaaatacttaactgctaaaaatmgaggaatagcatgtggaggaggaaaagaaagaagatcaatgacctattttttcatgacaagttcagaaaaatctctccataagcacaaataccacaagcaaaatctcatttgggaagcaaaatttgaaatattatttccaaatgatatacaattagagacaataaagggaacagtaatattatactaagtctttttattaacataaataagaacctgaaagagccataaaaatatttttcaatagggtactactgttcattcaaagatatttcactcacaatttcccttaaactgcccat

SEQ ID NO: 89462 - DNA, 601 bp, Human
cacctgtaatcccaggtatttgggaggctgaggcaggagaatcccttgaacccaggaggcaaaggttgcagttagctgagatcgcaccactgcactccagcctgggcaacaagagcgaaactccgtctcaaaaaaaaaaaaaaaaaaaaaaaagctcattggaactcctgggctcaagcaaccctcctgcctcagcctcctgaatagctaggactgcagacagtcgccaccacacctgggtaatttttgggtgggggtagagactagggtctcaccgtattgcccaggctgatcttgaacwactagccccaagtgatcctcccgcatcagcctcccagggtgctgggattacaggcataagcaaccacatccaggccaaatacttaactgctaaaaatagaggaatagcatgtggaggaggaaaagaaagaagatcaatgacctattttttcatgacaagttcagaaaaatctctccataagcacaaataccacaagcaaaatctcatttgggaagcaaaatttgaaatattatttccaaatgatatacaattagagacaataaagggaacagtaatattatactaagtctttttattaac

SEQ ID NO: 89463 - DNA, 601 bp, Human; identical to SEQ ID NO: 89388

SEQ ID NO: 89464 - DNA, 601 bp, Human; identical to SEQ ID NO: 89389

SEQ ID NO: 89465 - DNA, 601 bp, Human; identical to SEQ ID NO: 89390

SEQ ID NO: 89466 - DNA, 601 bp, Human; identical to SEQ ID NO: 89391

SEQ ID NO: 89467 - DNA, 601 bp, Human; identical to SEQ ID NO: 89392

SEQ ID NO: 89468 - DNA, 601 bp, Human; identical to SEQ ID NO: 89393

SEQ ID NO: 89469 - DNA, 601 bp, Human; identical to SEQ ID NO: 89394

SEQ ID NO: 89470 - DNA, 601 bp, Human; identical to SEQ ID NO: 89395

SEQ ID NO: 89471 - DNA, 601 bp, Human; identical to SEQ ID NO: 89396

SEQ ID NO: 89472 - DNA, 601 bp, Human; identical to SEQ ID NO: 89397

SEQ ID NO: 89473 - DNA, 601 bp, Human; identical to SEQ ID NO: 89398

SEQ ID NO: 89474 - DNA, 601 bp, Human; identical to SEQ ID NO: 89399

SEQ ID NO: 89475 - DNA, 601 bp, Human; identical to SEQ ID NO: 89400

SEQ ID NO: 89476 - DNA, 601 bp, Human; identical to SEQ ID NO: 89401

SEQ ID NO: 89477 - DNA, 601 bp, Human; identical to SEQ ID NO: 89402

SEQ ID NO: 89478 - DNA, 601 bp, Human; identical to SEQ ID NO: 89403

SEQ ID NO: 89479 - DNA, 601 bp, Human; identical to SEQ ID NO: 89404

SEQ ID NO: 89480 - DNA, 601 bp, Human; identical to SEQ ID NO: 89405

SEQ ID NO: 89481 - DNA, 601 bp, Human; identical to SEQ ID NO: 89406

SEQ ID NO: 89482 - DNA, 601 bp, Human; identical to SEQ ID NO: 89407

SEQ ID NO: 89483 - DNA, 601 bp, Human; identical to SEQ ID NO: 89408

SEQ ID NO: 89484 - DNA, 601 bp, Human; identical to SEQ ID NO: 89409

SEQ ID NO: 89485 - DNA, 601 bp, Human; identical to SEQ ID NO: 89410

SEQ ID NO: 89486 - DNA, 601 bp, Human; identical to SEQ ID NO: 89411

SEQ ID NO: 89487 - DNA, 601 bp, Human; identical to SEQ ID NO: 89412

SEQ ID NO: 89488 - DNA, 601 bp, Human; identical to SEQ ID NO: 89413

SEQ ID NO: 89489 - DNA, 601 bp, Human; identical to SEQ ID NO: 89414

SEQ ID NO: 89490 - DNA, 601 bp, Human; identical to SEQ ID NO: 89415

SEQ ID NO: 89491 - DNA, 601 bp, Human; identical to SEQ ID NO: 89416

SEQ ID NO: 89492 - DNA, 601 bp, Human; identical to SEQ ID NO: 89417

SEQ ID NO: 89493 - DNA, 601 bp, Human; identical to SEQ ID NO: 89418

SEQ ID NO: 89494 - DNA, 601 bp, Human; identical to SEQ ID NO: 89419

SEQ ID NO: 89495 - DNA, 601 bp, Human; identical to SEQ ID NO: 89420

SEQ ID NO: 89496 - DNA, 601 bp, Human; identical to SEQ ID NO: 89421

SEQ ID NO: 89497 - DNA, 601 bp, Human; identical to SEQ ID NO: 89422

SEQ ID NO: 89498 - DNA, 601 bp, Human; identical to SEQ ID NO: 89423

SEQ ID NO: 89499 - DNA, 601 bp, Human; identical to SEQ ID NO: 89424

SEQ ID NO: 89500 - DNA, 601 bp, Human; identical to SEQ ID NO: 89425

SEQ ID NO: 89501 - DNA, 601 bp, Human; identical to SEQ ID NO: 89426

SEQ ID NO: 89502 - DNA, 601 bp, Human; identical to SEQ ID NO: 89427

SEQ ID NO: 89503 - DNA, 601 bp, Human; identical to SEQ ID NO: 89428

SEQ ID NO: 89504 - DNA, 601 bp, Human; identical to SEQ ID NO: 89429

SEQ ID NO: 89505 - DNA, 601 bp, Human; identical to SEQ ID NO: 89430

SEQ ID NO: 89506 - DNA, 601 bp, Human; identical to SEQ ID NO: 89431

SEQ ID NO: 89507 - DNA, 601 bp, Human; identical to SEQ ID NO: 89432

SEQ ID NO: 89508 - DNA, 601 bp, Human; identical to SEQ ID NO: 89433

SEQ ID NO: 89509 - DNA, 601 bp, Human; identical to SEQ ID NO: 89434

SEQ ID NO: 89510 - DNA, 601 bp, Human; identical to SEQ ID NO: 89435

SEQ ID NO: 89511 - DNA, 601 bp, Human; identical to SEQ ID NO: 89436

SEQ ID NO: 89512 - DNA, 601 bp, Human; identical to SEQ ID NO: 89437

SEQ ID NO: 89513 - DNA, 601 bp, Human; identical to SEQ ID NO: 89438

SEQ ID NO: 89514 - DNA, 601 bp, Human; identical to SEQ ID NO: 89439

SEQ ID NO: 89515 - DNA, 601 bp, Human; identical to SEQ ID NO: 89440

SEQ ID NO: 89516 - DNA, 601 bp, Human; identical to SEQ ID NO: 89441

SEQ ID NO: 89517 - DNA, 601 bp, Human; identical to SEQ ID NO: 89442

SEQ ID NO: 89518 - DNA, 601 bp, Human; identical to SEQ ID NO: 89443

SEQ ID NO: 89519 - DNA, 601 bp, Human; identical to SEQ ID NO: 89444

SEQ ID NO: 89520 - DNA, 601 bp, Human; identical to SEQ ID NO: 89445

SEQ ID NO: 89521 - DNA, 601 bp, Human; identical to SEQ ID NO: 89446

SEQ ID NO: 89522 - DNA, 601 bp, Human; identical to SEQ ID NO: 89447

SEQ ID NO: 89523 - DNA, 601 bp, Human; identical to SEQ ID NO: 89448

SEQ ID NO: 89524 - DNA, 601 bp, Human; identical to SEQ ID NO: 89449

SEQ ID NO: 89525 - DNA, 601 bp, Human; identical to SEQ ID NO: 89450

SEQ ID NO: 89526 - DNA, 601 bp, Human; identical to SEQ ID NO: 89451

SEQ ID NO: 89527 - DNA, 601 bp, Human; identical to SEQ ID NO: 89452

SEQ ID NO: 89528 - DNA, 601 bp, Human; identical to SEQ ID NO: 89453

SEQ ID NO: 89529 - DNA, 601 bp, Human; identical to SEQ ID NO: 89454

SEQ ID NO: 89530 - DNA, 601 bp, Human; identical to SEQ ID NO: 89455

SEQ ID NO: 89531 - DNA, 601 bp, Human; identical to SEQ ID NO: 89456

SEQ ID NO: 89532 - DNA, 601 bp, Human; identical to SEQ ID NO: 89457

SEQ ID NO: 89533 - DNA, 601 bp, Human; identical to SEQ ID NO: 89458

SEQ ID NO: 89534 - DNA, 601 bp, Human; identical to SEQ ID NO: 89459

SEQ ID NO: 89535 - DNA, 601 bp, Human; identical to SEQ ID NO: 89460

SEQ ID NO: 89536 - DNA, 601 bp, Human; identical to SEQ ID NO: 89461

SEQ ID NO: 89537 - DNA, 601 bp, Human; identical to SEQ ID NO: 89462

SEQ ID NO: 89538 - DNA, 601 bp, Human; identical to SEQ ID NO: 89388

SEQ ID NO: 89539 - DNA, 601 bp, Human; identical to SEQ ID NO: 89389

SEQ ID NO: 89540 - DNA, 601 bp, Human; identical to SEQ ID NO: 89390

SEQ ID NO: 89541 - DNA, 601 bp, Human; identical to SEQ ID NO: 89391

SEQ ID NO: 89542 - DNA, 601 bp, Human; identical to SEQ ID NO: 89392

SEQ ID NO: 89543 - DNA, 601 bp, Human; identical to SEQ ID NO: 89393

SEQ ID NO: 89544 - DNA, 601 bp, Human; identical to SEQ ID NO: 89394

SEQ ID NO: 89545 - DNA, 601 bp, Human; identical to SEQ ID NO: 89395

SEQ ID NO: 89546 - DNA, 601 bp, Human; identical to SEQ ID NO: 89396

SEQ ID NO: 89547 - DNA, 601 bp, Human; identical to SEQ ID NO: 89397

SEQ ID NO: 89548 - DNA, 601 bp, Human; identical to SEQ ID NO: 89398

SEQ ID NO: 89549 - DNA, 601 bp, Human; identical to SEQ ID NO: 89399

SEQ ID NO: 89550 - DNA, 601 bp, Human; identical to SEQ ID NO: 89400

SEQ ID NO: 89551 - DNA, 601 bp, Human; identical to SEQ ID NO: 89401

SEQ ID NO: 89552 - DNA, 601 bp, Human; identical to SEQ ID NO: 89402

SEQ ID NO: 89553 - DNA, 601 bp, Human; identical to SEQ ID NO: 89403

SEQ ID NO: 89554 - DNA, 601 bp, Human; identical to SEQ ID NO: 89404

SEQ ID NO: 89555 - DNA, 601 bp, Human; identical to SEQ ID NO: 89405

SEQ ID NO: 89556 - DNA, 601 bp, Human; identical to SEQ ID NO: 89406

SEQ ID NO: 89557 - DNA, 601 bp, Human; identical to SEQ ID NO: 89407

SEQ ID NO: 89558 - DNA, 601 bp, Human; identical to SEQ ID NO: 89408

SEQ ID NO: 89559 - DNA, 601 bp, Human; identical to SEQ ID NO: 89409

SEQ ID NO: 89560 - DNA, 601 bp, Human; identical to SEQ ID NO: 89410

SEQ ID NO: 89561 - DNA, 601 bp, Human; identical to SEQ ID NO: 89411

SEQ ID NO: 89562 - DNA, 601 bp, Human; identical to SEQ ID NO: 89412

SEQ ID NO: 89563 - DNA, 601 bp, Human; identical to SEQ ID NO: 89413

SEQ ID NO: 89564 - DNA, 601 bp, Human; identical to SEQ ID NO: 89414

SEQ ID NO: 89565 - DNA, 601 bp, Human; identical to SEQ ID NO: 89415

SEQ ID NO: 89566 - DNA, 601 bp, Human; identical to SEQ ID NO: 89416

SEQ ID NO: 89567 - DNA, 601 bp, Human; identical to SEQ ID NO: 89417

SEQ ID NO: 89568 - DNA, 601 bp, Human; identical to SEQ ID NO: 89418

SEQ ID NO: 89569 - DNA, 601 bp, Human; identical to SEQ ID NO: 89419

SEQ ID NO: 89570 - DNA, 601 bp, Human; identical to SEQ ID NO: 89420

SEQ ID NO: 89571 - DNA, 601 bp, Human; identical to SEQ ID NO: 89421

SEQ ID NO: 89572 - DNA, 601 bp, Human; identical to SEQ ID NO: 89422

SEQ ID NO: 89573 - DNA, 601 bp, Human; identical to SEQ ID NO: 89423

SEQ ID NO: 89574 - DNA, 601 bp, Human; identical to SEQ ID NO: 89424

SEQ ID NO: 89575 - DNA, 601 bp, Human; identical to SEQ ID NO: 89425

SEQ ID NO: 89576 - DNA, 601 bp, Human; identical to SEQ ID NO: 89426

SEQ ID NO: 89577 - DNA, 601 bp, Human; identical to SEQ ID NO: 89427

SEQ ID NO: 89578 - DNA, 601 bp, Human; identical to SEQ ID NO: 89428

SEQ ID NO: 89579 - DNA, 601 bp, Human; identical to SEQ ID NO: 89429

SEQ ID NO: 89580 - DNA, 601 bp, Human; identical to SEQ ID NO: 89430

SEQ ID NO: 89581 - DNA, 601 bp, Human; identical to SEQ ID NO: 89431

SEQ ID NO: 89582 - DNA, 601 bp, Human; identical to SEQ ID NO: 89432

SEQ ID NO: 89583 - DNA, 601 bp, Human; identical to SEQ ID NO: 89433

SEQ ID NO: 89584 - DNA, 601 bp, Human; identical to SEQ ID NO: 89434

SEQ ID NO: 89585 - DNA, 601 bp, Human; identical to SEQ ID NO: 89435

SEQ ID NO: 89586 - DNA, 601 bp, Human; identical to SEQ ID NO: 89436

SEQ ID NO: 89587 - DNA, 601 bp, Human; identical to SEQ ID NO: 89437

SEQ ID NO: 89588 - DNA, 601 bp, Human; identical to SEQ ID NO: 89438

SEQ ID NO: 89589 - DNA, 601 bp, Human; identical to SEQ ID NO: 89439

SEQ ID NO: 89590 - DNA, 601 bp, Human; identical to SEQ ID NO: 89440

SEQ ID NO: 89591 - DNA, 601 bp, Human; identical to SEQ ID NO: 89441

SEQ ID NO: 89592 - DNA, 601 bp, Human; identical to SEQ ID NO: 89442

SEQ ID NO: 89593 - DNA, 601 bp, Human; identical to SEQ ID NO: 89443

SEQ ID NO: 89594 - DNA, 601 bp, Human; identical to SEQ ID NO: 89444

SEQ ID NO: 89595 - DNA, 601 bp, Human; identical to SEQ ID NO: 89445

SEQ ID NO: 89596 - DNA, 601 bp, Human; identical to SEQ ID NO: 89446

SEQ ID NO: 89597 - DNA, 601 bp, Human; identical to SEQ ID NO: 89447

SEQ ID NO: 89598 - DNA, 601 bp, Human; identical to SEQ ID NO: 89448

SEQ ID NO: 89599 - DNA, 601 bp, Human; identical to SEQ ID NO: 89449

SEQ ID NO: 89600 - DNA, 601 bp, Human; identical to SEQ ID NO: 89450

SEQ ID NO: 89601 - DNA, 601 bp, Human; identical to SEQ ID NO: 89451

SEQ ID NO: 89602 - DNA, 601 bp, Human; identical to SEQ ID NO: 89452

SEQ ID NO: 89603 - DNA, 601 bp, Human; identical to SEQ ID NO: 89453

SEQ ID NO: 89604 - DNA, 601 bp, Human; identical to SEQ ID NO: 89454

SEQ ID NO: 89605 - DNA, 601 bp, Human; identical to SEQ ID NO: 89455

SEQ ID NO: 89606 - DNA, 601 bp, Human; identical to SEQ ID NO: 89456

SEQ ID NO: 89607 - DNA, 601 bp, Human; identical to SEQ ID NO: 89457

SEQ ID NO: 89608 - DNA, 601 bp, Human; identical to SEQ ID NO: 89458

SEQ ID NO: 89609 - DNA, 601 bp, Human; identical to SEQ ID NO: 89459

SEQ ID NO: 89610 - DNA, 601 bp, Human; identical to SEQ ID NO: 89460

SEQ ID NO: 89611 - DNA, 601 bp, Human; identical to SEQ ID NO: 89461

SEQ ID NO: 89612 - DNA, 601 bp, Human; identical to SEQ ID NO: 89462

SEQ ID NO: 89613 - DNA, 601 bp, Human
aggaatgggaaaattagtgattcccagtgtatacatttctttctcaccttggcttttggaattgcacttttggagtttcttcagacattcagaaatgtagagagttatatatatcattatatattatcaaggtcctatcagcttcattcttaatttcatagtttttgaagaagatattggccttgaagtaatagatgcttcatccacaatatctgtatcttttgtctctctgggggcaggtcgtttgaattgacttctgataggcaacagtgccttgtttccgatgagtttgatgtcaggwtccatgagagaagagtggtaagccagcatcttggcggcgcccgggtttcaacccagaggagcaggatcggaagcattgttaagtacagaggtctttggagttccttatcatctttgtaagtaacccatgagataagggaagcttcatttaaaagaaattacccaaaactatggctgtggcaaagagagcagaaagaaaaaaaaaagagtaaacattaaaaaaagaataaggggccgggcccagtggctcatgcctgtaatcccagcactttgggaggctgaggcaggtgggtcatgaggt

SEQ ID NO: 89614 - DNA, 601 bp, Human
tgataacccactttcttttctcccacccaaattcttgatcaagagtttttcaagtaaagacatgctcttctctcttctgtataaaactttacgaaataaaggcaaaagattgtgtacatcttgatggaaaatgctgcccagggctctggagacggtggctgcccgggctcccttcactgcccaggtcctgaaagactcttattcatgaactgtctcttcacaaagcaagtccaccacttgctgggtttatcattctgagggtcgaaaactttctcacaaagtctcagtccagtctcttgcyttagctgttgtaaataggctctcatcacttcatcttcctgtttgtttgcaggtttggcataaattgcgttaagtagaaaaccaggctttccaggaatgggaaaattagtgattcccagtgtatacatttctttctcaccttggcttttggaattgcacttttggagtttcttcagacattcagaaatgtagagagttatatatatcattatatattatcaaggtcctatcagcttcattcttaatttcatagtttttgaagaagatattggccttgaagtaatagatgcttcatccacaa

SEQ ID NO: 89615 - DNA, 601 bp, Human; identical to SEQ ID NO: 34093

SEQ ID NO: 89616 - DNA, 601 bp, Human; identical to SEQ ID NO: 34094

SEQ ID NO: 89617 - DNA, 601 bp, Human; identical to SEQ ID NO: 34095

SEQ ID NO: 89618 - DNA, 601 bp, Human; identical to SEQ ID NO: 34096

SEQ ID NO: 89619 - DNA, 601 bp, Human; identical to SEQ ID NO: 34097

SEQ ID NO: 89620 - DNA, 601 bp, Human; identical to SEQ ID NO: 34098

SEQ ID NO: 89621 - DNA, 601 bp, Human; identical to SEQ ID NO: 34099

SEQ ID NO: 89622 - DNA, 601 bp, Human; identical to SEQ ID NO: 34100

SEQ ID NO: 89623 - DNA, 601 bp, Human; identical to SEQ ID NO: 34101

SEQ ID NO: 89624 - DNA, 601 bp, Human; identical to SEQ ID NO: 34102

SEQ ID NO: 89625 - DNA, 601 bp, Human; identical to SEQ ID NO: 34103

SEQ ID NO: 89626 - DNA, 601 bp, Human; identical to SEQ ID NO: 34104

SEQ ID NO: 89627 - DNA, 601 bp, Human; identical to SEQ ID NO: 34105

SEQ ID NO: 89628 - DNA, 601 bp, Human; identical to SEQ ID NO: 34106

SEQ ID NO: 89629 - DNA, 601 bp, Human; identical to SEQ ID NO: 34107

SEQ ID NO: 89630 - DNA, 601 bp, Human; identical to SEQ ID NO: 34108

SEQ ID NO: 89631 - DNA, 601 bp, Human; identical to SEQ ID NO: 34109

SEQ ID NO: 89632 - DNA, 601 bp, Human
attgaccattaggattcaggtgcagccagtttggcctcaggactttgtgactcctgtgacggttgcaggtcagatcataggtcctggggatgctttgattcagatctgcctactggaagcaaatctcctcagatctttgggaaacaaaactgatcaggcttggcctgggcgccgtggctcacctgtaataccagcactttgagaggccgaagcaggcagatcacctgaggtcaggagttcgagaccagcctggccaacgtggcgaaaccccgtctctactaaaaatacaaaaaaaaaaaaattagccgggtgcagtggcgtgctcctgtaatcccagctactctggaggctgaggcaggagaatcgcttgaactcggaaagcggaggttgcagtgagctgagatcacgccactgcactccagcctgcgcgacagagtgagactgtctcaaaacaacaacaacaaaaacctgattaggcttggtgtggtggctcacgtttctaatcccagcactttgggaggccagggtgggaagattgcttgagcccaggagttggagaccagcctgagcagcttaggaagatctcctctctacaaaaaaa

SEQ ID NO: 89633 - DNA, 601 bp, Human
tgaacccagcaggcggagcttgcagtgagcggagatcgtgccactgcaccccagcctgggcgacagagcaagactccgtctcaaaaaaaaaaagtcaggttttgtgattttcagttaaatagtctataatgggctgcttcttgcaggctactcaaactgcattactaaactgtaattggtgatcccgaaatcctttcaataaagaggtatctgtcaaaggaaaccttttcaaattagttggactaaacgggacctaggccggacatggctcacacctgtaatcccagcactttgggaggaygaggcgggtggatcacctgaggtcagcagttcaagaccagcctggccaccatggtgaaaccccatctctactaaaaatacaaaaattagccagtcgtggtggcgtgtgcctgtaatcccagctaccggggaggctgagacaggagaatcacttgaacccaggatacagaggctgccgtgagccgagattgtgccacttcactccagcctgggcaacagagcgagactctgtctcaaaaaaaaaaataaaataaagagggcttgggtaattggcaaaatgctgcatattagtggtagtggg

SEQ ID NO: 89634 - DNA, 601 bp, Human
ttactaaactgtaattggtgatcccgaaatcctttcaataaagaggtatctgtcaaaggaaaccttttcaaattagttggactaaacgggacctaggccggacatggctcacacctgtaatcccagcactttgggaggacgaggcgggtggatcacctgaggtcagcagttcaagaccagcctggccaccatggtgaaaccccatctctactaaaaatacaaaaattagccagtcgtggtggcgtgtgcctgtaatcccagctaccggggaggctgagacaggagaatcacttgaacccasgatacagaggctgccgtgagccgagattgtgccacttcactccagcctgggcaacagagcgagactctgtctcaaaaaaaaaaataaaataaagagggcttgggtaattggcaaaatgctgcatattagtggtagtgggaggcagttgagtgttttgttttaatgggcctcttactccttgcaaactagccagaccattgtactttcagagtgtaaatctttggctcaccaaatttcagctatctctcaaattcagcttttgcttttcttcccacttgctcaaatatgtctatattcttt

SEQ ID NO: 89635 - DNA, 601 bp, Human
ctgatcccagcccagccactaactgtgtggtcttggaaaaggccctcacatgagtttcagtgttctctgtcaaatggagctcgggttacttaccctcctttcctcccagcgctgctctaaggaccagaaaagatagtgaagggtttgtgctgtgtatggaaacaagtacaaagttcaaaatccaccaagttaaagcaatgggaagacctacagctgaaagaactgggagggtgatgataactcgtgccatttctcaaacactatgtgccacacgttgtgatagactctctttctttctttctttttctttctttctttctttctttctttctttctttctttctttctttctttctttctctctctctctctctctctctttctttctttctttctttctttctttctctttctctctctctctctctttctttcttctttttttttggagttttgctgttgttgcccgggctggagggcaatggcgcgatctcgggtcattgcaacttctgcctgccaggttcaagtgattctcctgcctcagcctcctgagtagctgggattacaggaatgcatcatcacacccggctaattttttgta

SEQ ID NO: 89636 - DNA, 601 bp, Human
cagtgttctctgtcaaatggagctcgggttacttaccctcctttcctcccagcgctgctctaaggaccagaaaagatagtgaagggtttgtgctgtgtatggaaacaagtacaaagttcaaaatccaccaagttaaagcaatgggaagacctacagctgaaagaactgggagggtgatgataactcgtgccatttctcaaacactatgtgccacacgttgtgatagactctctttctttctttctttttctttctttctttctttctttctttctttctttctttctttctttctttctttctctctctctctctctctctctttctttctttctttctttctttctttctctttctctctctctctctctttctttcttctttttttttggagttttgctgttgttgcccgggctggagggcaatggcgcgatctcgggtcattgcaacttctgcctgccaggttcaagtgattctcctgcctcagcctcctgagtagctgggattacaggaatgcatcatcacacccggctaattttttgtatttttagtagtgatggggtttcaccatgttggccaggctggtctggaactcctgacc

SEQ ID NO: 89637 - DNA, 601 bp, Human
aggtaaaaaaaaaaaaaaaaaggaataataaaaaaaattgactagggctaataagtacgggatagacgagaataatatttcttttttttttttttttggggacagagtctcgctctgtcactcaggcaggagtgcagtggcgcaatctcggctcactgcaagctctgcctcccgggttcacgccattcttctgtctcagcctcccgagtagctggaactacaggcgcctgccaccatgcccggctaattttttgtatttttaggagagacggggtttcaccgtgttagccaggatggtctygatctcctgacctcgtgatccgcctgcctcggcctcccaaagtgctgggattacaggcgtgagccaccgcgcccggccgagaatatattatatttttcttgttattcattcaacaaataggaacacagtacctactctgttgccacatctatgccagccctgtttcaggggtgttgggggagatgaaatcaataaaatatgatgtctactttcagggatggatttcatgccccaggcagcagagtaggaagaatgactatagtctcagtagctgctggttggagcctgccatcacttcag

SEQ ID NO: 89638 - DNA, 601 bp, Human; identical to SEQ ID NO: 75683

SEQ ID NO: 89639 - DNA, 601 bp, Human; identical to SEQ ID NO: 75684

SEQ ID NO: 89640 - DNA, 601 bp, Human; identical to SEQ ID NO: 75685

SEQ ID NO: 89641 - DNA, 601 bp, Human; identical to SEQ ID NO: 75686

SEQ ID NO: 89642 - DNA, 601 bp, Human; identical to SEQ ID NO: 75687

SEQ ID NO: 89643 - DNA, 601 bp, Human; identical to SEQ ID NO: 75688

SEQ ID NO: 89644 - DNA, 601 bp, Human
ccagctcagcggctggggccggggcttctccaggggctccagtggcctcagcaggggcaggggcaggggccagcatgggctctgccttctctggaggggatcagatgggagtcgtggtgcagccactaaccagagacccctccaccctctctctcctgagcattggacccatgagcccgctgtggatgaggaaagtctgccatggctgtcctcccgctgcctgggcccctcagaggcagctcatgctgagctggagagccagcctgcctctcacattctcctccccgtcccaggccatcasttcccatgtcctctgcatctgccctgaacagctccaggtccatccctgctctgccccagccttagagcagcccctcagactgggctgcactcccctcatccacagctcctggggcttcccggccgtctgtgcagggtcatctccccagggaggtctgcagggggagagtggggttgtgtcttgttcatctctcccacctaccccatggctggaacaagccaggatggcacatgggggtactcagagaggtcatgtgcagaaaagggggaaagggcgttcctggcggggggcacagccaca

SEQ ID NO: 89645 - DNA, 601 bp, Human
gaacatgttggcctctcttgctagaggcccccttgcctagcccaggactggggaaggttgggaaaagcagaggcttggagtgaacaaacaaggggacttaagccttaaggttctggtgggcagggcggaaaaaaacaaaacacaaaaaacgaaggcttaaggttctaggcctatgtctaagtgaccttggagcagccacttaacctctcaagctttggtttccgtgtctgtataatgaggaattgttctggttaatccctgagagtcccttgagcccttagccctgatactcacccatccmggggctttacaaccccactagctggtgcccccatgcttcacagtgtcctccaggcttcctgaccaccctgggcgcccccccacccccggccaaaccttattaggtgcccccttgaggtgatcatgtccaccaagtctcccaggtccccgacagtgctcccatgagcctcatcgcactccctggcccccaggcctccgggatctccctgtgggcccctggcccctccacctgcctcccagattccccacaccccttgcttgcagctcgtgtgtgcctctgggtctcatggtgccctctgtg

SEQ ID NO: 89646 - DNA, 601 bp, Human
ccgacatcaacggcctgcgccgggtgctggatgagctcactctgtctaagactgacctggagatgcagatcgagagcctgaatgaagagctagcctacatgaagaagaaccatgaagaggtgagcggggattgcaggctgccctgggctcaacaacctccagtgagaaggaggagccctcccctgcaactggacacagtcctccactgtgggacctggaaacactctccagaacactctgccagcactcagagccaaggagagggaggatgagtagcctcacacatcttcctttcccatcsccacaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaaggtacccggccctcccaccccacatagcccatcccatatagccaggggggccgggcggacacagcctcttggtcaggctgctcgagctgagcttccccaccaccttcttcctgcttgcatttcagagtgcaga

SEQ ID NO: 89647 - DNA, 601 bp, Human
ttgaaagttcccctggtgattctaatgtggcccagattcagaaccactggcttaaatggggcatcagcatcccatcatcccatctaaggcgatcaaatcaaaggccacatctctggccataatagtaacaacagcaatatgtctatcctaacttagtcttctagacattgatttgtaacccctgatcccgactgttatggcttgggactggaatgtagccagcctccaaagctgatagcactacctggactattacagtatgcactgaatgaatgagcagaaaacaaaaaaacaagctacmtacctggcgctcttcatgttttccatgcacctcaatcacatctcccaacaccttaactttgagttcctctggggagaagtgcttcacatccaggttgacagagaacctgtccttctccaggcgcatctagaaatagcaaggtaagggaatgggatgggagaaagagggcaaaaatactgattacacaggtgctgtcttattctgcagagctgctttctgtccgggtaattcatccttctcttctctgcttaaaaaatctcctttttaaataaacatagctgtctgcttcagggagccacc

SEQ ID NO: 89648 - DNA, 601 bp, Human
agttaatgtaattatgcaaagcaactaggtgtctgacagccctatacctaatcagtggttctcaaccttgactgtagattagaattaccttaaaaattgctgatgcctgggtcccacccttaaaaatgctgatttaattggtctggagtagtgctcgcttcggcagcacatatgctaattggtctggagtatgcccgagcattaggttttttgaaagttcccctggtgattctaatgtggcccagattcagaaccactggcttaaatggggcatcagcatcccatcatcccatctaaggcratcaaatcaaaggccacatctctggccataatagtaacaacagcaatatgtctatcctaacttagtcttctagacattgatttgtaacccctgatcccgactgttatggcttgggactggaatgtagccagcctccaaagctgatagcactacctggactattacagtatgcactgaatgaatgagcagaaaacaaaaaaacaagctacctacctggcgctcttcatgttttccatgcacctcaatcacatctcccaacaccttaactttgagttcctctggggagaagtgcttcacatc

SEQ ID NO: 89649 - DNA, 601 bp, Human
agggtggaagtgcagagaagaaattcccccacagttatacagcaagtcaggggtagagctggtgtttgaacccaggaagcagggggctgagaatggaggtgcataagccctttgatctgccacctctcaatggcgggagggaaggagcccgttagaggcaaggtcctgcccctgcctctggtggcctcccccggatttggagccgctcagcaggcaggtctcacagtggtgccctgcaactgagtacacttgccccggacagccagacggtggcctggccaggacgcttctgccacagctragggccgctactctttcctgccctgccggagccccttctcgcacgagggaagtggagcccgaggaggaaggaacgcgcaagttagcactttccgggctgtgccaaactgtgcccctgagcagcagtgagacttagggtctgtcaagcccagctgtccccagcggccagtccctgggccaggaaaggacaggccaggaagagtcagtgcccatcctgacgggcctgaggtgctgggtgctcagggaggccatgaaggacccaggtcccacacagaaggccgtcagggctgtcttcccagat

SEQ ID NO: 89650 - DNA, 601 bp, Human
ccatttggctatcaggtgcttagcagctatttgggaaatgcatgaataaataaaacagaaccttaaagtttatcagacagaaggaggaagccgagcccaatgtgtagacttgttcaaagtcctaatgaaagctgagacagacctcctttcctgcgttaccatcctcaggggaagcagatctagttaagaaacattaatatatagtgctggtcaggcaccgggcaaaaactaacaaaccctaactcatctaaccattatggcaaccttatgaggcgtcaatgtcattctggtgtaatccacragagggtggaagtgcagagaagaaattcccccacagttatacagcaagtcaggggtagagctggtgtttgaacccaggaagcagggggctgagaatggaggtgcataagccctttgatctgccacctctcaatggcgggagggaaggagcccgttagaggcaaggtcctgcccctgcctctggtggcctcccccggatttggagccgctcagcaggcaggtctcacagtggtgccctgcaactgagtacacttgccccggacagccagacggtggcctggccaggacgcttctgccacag

SEQ ID NO: 89651 - DNA, 601 bp, Human
gcgagcctggcaccccaccgggcacccattcccacatcctgcagtggggggcgtggtggggaggctcacccctcccttggcaactcccgaaagccagcctgctcagcggccttgagaagagaggtgccctggtcagcaccccttccctggaggccaccccacttactgaggaggatgaggagccccacgatgaaggccagtccagcgaagatcaggcccccattgcgaacggtctcatagtctccggaaagagagggcaagaggagcgggatgggtggtctctcccagcagctgtctctcyccgcagcctgcccgcagcagcccgtggtaaccaggggagataaggggcacagagcatggacctggggctgggagaggccgctgcttggtggaaggggtcctgagggctcaggaagggtgcgcaggggcccaggcttaccatagtagaacgggtccacgtcccccttggggctgccgcctaggagagagccagaggtgggatgagaggagtcaccgatggtgagccagccacaggaacagctggaattccctgtccttcccttcccagaggaccctcgagggtccaagcaggcgaggggag

SEQ ID NO: 89652 - DNA, 601 bp, Human
tggcctcctaatatgccggcattacaggcatgagccaccacgcccagccttctctctctttatataaggctggaccataggcatttaagaacctaagtcagtcagtcagtcagcaaatatttactggagcagatccacggtggtctgttggcatatcgagagtagcagcagagactgggccatcatggtgcccccagcacagctgcccgatgaacacctggagaaggatggcagcaactccaaagtggagccccttgcttaggccacctgcctcctgtgcctatgtgatcagctgccaccyggcactgccctccgggagctgccacgggcaacatgtgaaaatggggagacctgcaggactgtggcccgagccttggggtgggctggcagtggcacacgtagagagagctgccatgggcaacacgggaaaatggggagacccgcaggactgtggcccgagccttggggtggggtggcagtggcacacgtgcattagaagtccagagcccacaggtgtgcttgctgtatcttctttccatgggttgtgttttctgtgtatttttctttgggttggaccaaaacaagtcaatgtgcagttatt

SEQ ID NO: 89653 - DNA, 601 bp, Human
caagtaatcctcctgcctcagcctcccaagtagctgggactataggtacatgtcaccatgcccagctaattaaaaaaatttttttttgtatagatcgggtctcactgtattgaccaggctggtcttaaactcctggtctcaagagatcctcctgccttggcctcctaatatgccggcattacaggcatgagccaccacgcccagccttctctctctttatataaggctggaccataggcatttaagaacctaagtcagtcagtcagtcagcaaatatttactggagcagatccacggtggkctgttggcatatcgagagtagcagcagagactgggccatcatggtgcccccagcacagctgcccgatgaacacctggagaaggatggcagcaactccaaagtggagccccttgcttaggccacctgcctcctgtgcctatgtgatcagctgccacccggcactgccctccgggagctgccacgggcaacatgtgaaaatggggagacctgcaggactgtggcccgagccttggggtgggctggcagtggcacacgtagagagagctgccatgggcaacacgggaaaatggggagacccgc

SEQ ID NO: 89654 - DNA, 601 bp, Human
gagtgcagtggtgggatcgtagctcactgcagcctcaaactcctgggctcaagtaatcctcctgcctcagcctcccaagtagctgggactataggtacatgtcaccatgcccagctaattaaaaaaatttttttttgtatagatcgggtctcactgtattgaccaggctggtcttaaactcctggtctcaagagatcctcctgccttggcctcctaatatgccggcattacaggcatgagccaccacgcccagccttctctctctttatataaggctggaccataggcatttaagaacctragtcagtcagtcagtcagcaaatatttactggagcagatccacggtggtctgttggcatatcgagagtagcagcagagactgggccatcatggtgcccccagcacagctgcccgatgaacacctggagaaggatggcagcaactccaaagtggagccccttgcttaggccacctgcctcctgtgcctatgtgatcagctgccacccggcactgccctccgggagctgccacgggcaacatgtgaaaatggggagacctgcaggactgtggcccgagccttggggtgggctggcagtggca

SEQ ID NO: 89655 - DNA, 601 bp, Human
attttattttatattttattttattttattttttgagacggggtcttactctgtcacccaggctggagtgcagtggtgggatcgtagctcactgcagcctcaaactcctgggctcaagtaatcctcctgcctcagcctcccaagtagctgggactataggtacatgtcaccatgcccagctaattaaaaaaatttttttttgtatagatcgggtctcactgtattgaccaggctggtcttaaactcctggtctcaagagatcctcctgccttggcctcctaatatgccggcattacaggcrtgagccaccacgcccagccttctctctctttatataaggctggaccataggcatttaagaacctaagtcagtcagtcagtcagcaaatatttactggagcagatccacggtggtctgttggcatatcgagagtagcagcagagactgggccatcatggtgcccccagcacagctgcccgatgaacacctggagaaggatggcagcaactccaaagtggagccccttgcttaggccacctgcctcctgtgcctatgtgatcagctgccacccggcactgccctccgggagctgccacgggc

SEQ ID NO: 89656 - DNA, 601 bp, Human
aattttccaaggagaccctggaagactcaaaattcttccagtctctcctacctccctcctgccagtatcatcgcagggtcaggcttggaggccacgtttgactgtctctattttattttatattttattttattttattttttgagacggggtcttactctgtcacccaggctggagtgcagtggtgggatcgtagctcactgcagcctcaaactcctgggctcaagtaatcctcctgcctcagcctcccaagtagctgggactataggtacatgtcaccatgcccagctaattaaaaaaatttttttttgtatagatcgggtctcactgtattgaccaggctggtcttaaactcctggtctcaagagatcctcctgccttggcctcctaatatgccggcattacaggcatgagccaccacgcccagccttctctctctttatataaggctggaccataggcatttaagaacctaagtcagtcagtcagtcagcaaatatttactggagcagatccacggtggtctgttggcatatcgagagtagcagcagagactgggccatcatggtgcccccagcacagctgcccgatgaacacctgg

SEQ ID NO: 89657 - DNA, 601 bp, Human
ggcaccgccgaggctgagaagacaaaggcaggatggggttgggtgggaggcagcagaggttggggttttacttcccccttgtccatctcacttttctccagggctcctctgtgatctcctgcggcacacactccacgccaggcccttggccatcattttaaacacacgatgggtgacagaccacctggctgatgtgtggacgaccctaaaattcttatttaccgagtccaggagccagaattcttccctgttgctcccaagcctgccctgccctccccgcaccttccccaggccctcctakcatacctgctgttacggctcatcttcattgatttgcctggtgggggaaggaaaagcaacaggtgagagggcagggggaggggtgggtctagggatctctgaggctggggatcctccactgtgtcagagacaaaatcctcagcccgcccctccttctccagccccaaccccctcatcggtcaccccaggcagcgctcacctgcgcttcttattgcccccacagcggaatcttctgccttgaaaagagaaaaggagatttgtttccatggactaattttccaaggagaccctggaagactca

SEQ ID NO: 89658 - DNA, 601 bp, Human
gcaggcaggtgagggaagcagcggtctctgacgccggctttattataagcatgaggtggcacgaggcaggagttggcgatgccacctgggggtcacattgagtctggagcttccttcagcccaagcgctggcagtgacggggacaaaggtctaaagcccagggaagaaggggaggcgccagaggcagggccatgcttggcttcccagctggccccagtgcagtgggtggcaccgccgaggctgagaagacaaaggcaggatggggttgggtgggaggcagcagaggttggggttttacttyccccttgtccatctcacttttctccagggctcctctgtgatctcctgcggcacacactccacgccaggcccttggccatcattttaaacacacgatgggtgacagaccacctggctgatgtgtggacgaccctaaaattcttatttaccgagtccaggagccagaattcttccctgttgctcccaagcctgccctgccctccccgcaccttccccaggccctcctagcatacctgctgttacggctcatcttcattgatttgcctggtgggggaaggaaaagcaacaggtgagagggcag

SEQ ID NO: 89659 - DNA, 601 bp, Human
caggcaggcaggtgagggaagcagcggtctctgacgccggctttattataagcatgaggtggcacgaggcaggagttggcgatgccacctgggggtcacattgagtctggagcttccttcagcccaagcgctggcagtgacggggacaaaggtctaaagcccagggaagaaggggaggcgccagaggcagggccatgcttggcttcccagctggccccagtgcagtgggtggcaccgccgaggctgagaagacaaaggcaggatggggttgggtgggaggcagcagaggttggggttttayttcccccttgtccatctcacttttctccagggctcctctgtgatctcctgcggcacacactccacgccaggcccttggccatcattttaaacacacgatgggtgacagaccacctggctgatgtgtggacgaccctaaaattcttatttaccgagtccaggagccagaattcttccctgttgctcccaagcctgccctgccctccccgcaccttccccaggccctcctagcatacctgctgttacggctcatcttcattgatttgcctggtgggggaaggaaaagcaacaggtgagaggg

SEQ ID NO: 89660 - DNA, 601 bp, Human; identical to SEQ ID NO: 89649

SEQ ID NO: 89661 - DNA, 601 bp, Human; identical to SEQ ID NO: 89650

SEQ ID NO: 89662 - DNA, 601 bp, Human; identical to SEQ ID NO: 89651

SEQ ID NO: 89663 - DNA, 601 bp, Human; identical to SEQ ID NO: 89652

SEQ ID NO: 89664 - DNA, 601 bp, Human; identical to SEQ ID NO: 89653

SEQ ID NO: 89665 - DNA, 601 bp, Human; identical to SEQ ID NO: 89654

SEQ ID NO: 89666 - DNA, 601 bp, Human; identical to SEQ ID NO: 89655

SEQ ID NO: 89667 - DNA, 601 bp, Human; identical to SEQ ID NO: 89656

SEQ ID NO: 89668 - DNA, 601 bp, Human; identical to SEQ ID NO: 89657

SEQ ID NO: 89669 - DNA, 601 bp, Human; identical to SEQ ID NO: 89658

SEQ ID NO: 89670 - DNA, 601 bp, Human; identical to SEQ ID NO: 89659

SEQ ID NO: 89671 - DNA, 601 bp, Human; identical to SEQ ID NO: 89649

SEQ ID NO: 89672 - DNA, 601 bp, Human; identical to SEQ ID NO: 89650

SEQ ID NO: 89673 - DNA, 601 bp, Human; identical to SEQ ID NO: 89651

SEQ ID NO: 89674 - DNA, 601 bp, Human; identical to SEQ ID NO: 89652

SEQ ID NO: 89675 - DNA, 601 bp, Human; identical to SEQ ID NO: 89653

SEQ ID NO: 89676 - DNA, 601 bp, Human; identical to SEQ ID NO: 89654

SEQ ID NO: 89677 - DNA, 601 bp, Human; identical to SEQ ID NO: 89655

SEQ ID NO: 89678 - DNA, 601 bp, Human; identical to SEQ ID NO: 89656

SEQ ID NO: 89679 - DNA, 601 bp, Human; identical to SEQ ID NO: 89657

SEQ ID NO: 89680 - DNA, 601 bp, Human; identical to SEQ ID NO: 89658

SEQ ID NO: 89681 - DNA, 601 bp, Human; identical to SEQ ID NO: 89659

SEQ ID NO: 89682 - DNA, 601 bp, Human; identical to SEQ ID NO: 89649

SEQ ID NO: 89683 - DNA, 601 bp, Human; identical to SEQ ID NO: 89650

SEQ ID NO: 89684 - DNA, 601 bp, Human; identical to SEQ ID NO: 89651

SEQ ID NO: 89685 - DNA, 601 bp, Human; identical to SEQ ID NO: 89652

SEQ ID NO: 89686 - DNA, 601 bp, Human; identical to SEQ ID NO: 89653

SEQ ID NO: 89687 - DNA, 601 bp, Human; identical to SEQ ID NO: 89654

SEQ ID NO: 89688 - DNA, 601 bp, Human; identical to SEQ ID NO: 89655

SEQ ID NO: 89689 - DNA, 601 bp, Human; identical to SEQ ID NO: 89656

SEQ ID NO: 89690 - DNA, 601 bp, Human; identical to SEQ ID NO: 89657

SEQ ID NO: 89691 - DNA, 601 bp, Human; identical to SEQ ID NO: 89658

SEQ ID NO: 89692 - DNA, 601 bp, Human; identical to SEQ ID NO: 89659

SEQ ID NO: 89693 - DNA, 601 bp, Human
tcatgccagtgtacctgggagtgggaaggagggtgggagtcagggaaggaagagacacaccaaggcctggggctggcccctccttaccaagcacacttggggaaaacagccaccccctaccccccgactacctcggtgtggaagcggacataggggcagccaacgtccagcacaacctcctggctaagccgactgttggggctgatctgtagcaagaaccaggcgctgccccgcaggccgccctcggtgcccactgccagggtccctgcctggcccagcacaggcttcctatgggacaggrgtggacatactgatccagagcagcctgtgttcccaccacctccaccatccccacatgctgcccagcctataccgtgtctccaggtggtagtccatgacgtcccatgcatcccagtacaaggggacatcatcaaatagcacaaactggttccccacggcgccctcagcaatggcctccctggaaggacatgggattggtgctgtacaaccaactgacctcgctgtctccagctgctcttggtggggtagggtggagtgagtagacccagtggacaggggactactgcccagcctgccctgc

SEQ ID NO: 89694 - DNA, 601 bp, Human
tcagacctcaaatcgagcccagtcccaagaggtattgtagtgggtaggtcgctgcaggtgcccaaactggatctcataggtggcctgggaactccgcacgcgagcagggaactccaccttcaggaacttgtgggcctcatgccagtgtacctgggagtgggaaggagggtgggagtcagggaaggaagagacacaccaaggcctggggctggcccctccttaccaagcacacttggggaaaacagccaccccctaccccccgactacctcggtgtggaagcggacataggggcagccaacrtccagcacaacctcctggctaagccgactgttggggctgatctgtagcaagaaccaggcgctgccccgcaggccgccctcggtgcccactgccagggtccctgcctggcccagcacaggcttcctatgggacaggggtggacatactgatccagagcagcctgtgttcccaccacctccaccatccccacatgctgcccagcctataccgtgtctccaggtggtagtccatgacgtcccatgcatcccagtacaaggggacatcatcaaatagcacaaactggttccccacggcgccctc

SEQ ID NO: 89695 - DNA, 601 bp, Human
aactctaattactagaaactattagtaattcaattgttactaaaataattttataccaaactgcatggctgtttcacatctgctcctaactgtggagactctctagattcaggataaggtatataggaacaaagtccaaacagggggggatggaggagggatagcattaagagatatacctaatgctaaatgacgagttaatgggtgcagcacaccaacaaggcacatgtatacatatgtaacaaacctgcacgttgtgcacatgtaccctaaaacttaaagtataataataataaaattaaaaaaaaaaaaaaaaaacaaagtccaaacaggacaccagttaaaaaaggaagtaataaggccctacaagataggtccctaaacactcactaagatggtgaattttccactgaggatctcagaacgaagaggttcctcatgaggtttcagctttacaatgccttccttccttcgagtttcctaaaaaggcagcacagcaaaatgtattaatatgaaaatactgtatatccaggacagcaccatgtaaccaccaaatctcagagataaggtggttatcaatgaatgaatgaattataaattt

SEQ ID NO: 89696 - DNA, 410 bp, Human
cctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccaccgccgccccacmgccgggaggatggagttcagcgggcagcggagctgtctcagtctttgccgccgcgccggcgagcgccgcccgcgaggcagcggatggaggagcggacgggccccgcggg

SEQ ID NO: 89697 - DNA, 413 bp, Human
catcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccaccgccgcccsacagccgggaggatggagttcagcgggcagcggagctgtctcagtctttgccgccgcgccggcgagcgccgcccgcgaggcagcggatggaggagcggacgggccccgcggg

SEQ ID NO: 89698 - DNA, 423 bp, Human
agatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcctggggcagtgcggagccgggacagtcgcggcgctgacgcccgcgggccccagctgcagatatgaagcggagccgctgccgcgaccgaccgcagccrccgccgccccacagccgggaggatggagttcagcgggcagcggagctgtctcagtctttgccgccgcgccggcgagcgccgcccgcgaggcagcggatggaggagcggacgggccccgcggg

SEQ ID NO: 89699 - DNA, 518 bp, Human
ctatattaaaattaaaaacttatgccaggcgcggtggctcacgcctgtaatcccagcactttgggaggccgaggagggtggatcacgaggtcaggagatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggccyggggcagtgcggagccgggacagtcgcggcgctgacgcccgcgggccccagctgcagatatgaagcggagccgctgccgcgaccgaccgcagccaccgccgccccacagccgggaggatggagttcagcgggcagcggagctgtctcagtctttgccgccgcgccggcgagcgccgcccgcgaggcagcggatggaggagcggacgggccccgcggg

SEQ ID NO: 89700 - DNA, 545 bp, Human
gtgacaaaagaaaagagataaattggactatattaaaattaaaaacttatgccaggcgcggtggctcacgcctgtaatcccagcactttgggaggccgaggagggtggatcacgaggtcaggagatcgagaccatcctggctaacacggcgaaaccctgtctctactaaaaatacaaaaaaggtctcttccgtgaggagcgcagaggaggtcgcggcgccggaggccccagaaggctcgaaggcgccgcgggctggggtcggtggcttagggagcccgtccggccatggtggccgcgggtrgtggttggcgcggctgcgctgcggcctggggcagtgcggagccgggacagtcgcggcgctgacgcccgcgggccccagctgcagatatgaagcggagccgctgccgcgaccgaccgcagccaccgccgccccacagccgggaggatggagttcagcgggcagcggagctgtctcagtctttgccgccgcgccggcgagcgccgcccgcgaggcagcggatggaggagcggacgggccccgcggg

SEQ ID NO: 89701 - DNA, 601 bp, Human
ttttttaagcctcctctttggttgaatctcaaaaacgtttttagacaaaattccacttactggatcctctttggttgaatctcaaaaatgtttttcgacaaaaaaccacttactggataggcacagtggctcactcatcccagcactttgggaggccagagcagggggactgcatgaggccaggagtttgagaccaacctgggcaacagagccagaccccatctctaaaaaaaaaatgttttttaattagtcaggcaatgtggcatgagcctgtagtcccagctatgagggaggctgaggytggaggattggttgagcccaggatttcaaggctgaagtgagccatgattgcaccactgcattccagccagggcagtggaataagactctttctcgtatgtaaaaaaccaattccacttatgtttcctattttttgttttcttccattggctgtttttttgtataaactgtagacagaagcaaagtggctctcatttataaatgaatttgctgattcccacagaggaaccttatcttgtctgaccagtgcccaaatttcttcccctgcaaacaaactgacgcaaagaaaacactctgccaa

SEQ ID NO: 89702 - DNA, 601 bp, Human
ctcctctttggttgaatctcaaaaacgtttttagacaaaattccacttactggatcctctttggttgaatctcaaaaatgtttttcgacaaaaaaccacttactggataggcacagtggctcactcatcccagcactttgggaggccagagcagggggactgcatgaggccaggagtttgagaccaacctgggcaacagagccagaccccatctctaaaaaaaaaatgttttttaattagtcaggcaatgtggcatgagcctgtagtcccagctatgagggaggctgaggctggaggattrgttgagcccaggatttcaaggctgaagtgagccatgattgcaccactgcattccagccagggcagtggaataagactctttctcgtatgtaaaaaaccaattccacttatgtttcctattttttgttttcttccattggctgtttttttgtataaactgtagacagaagcaaagtggctctcatttataaatgaatttgctgattcccacagaggaaccttatcttgtctgaccagtgcccaaatttcttcccctgcaaacaaactgacgcaaagaaaacactctgccaaagagccaggc

SEQ ID NO: 89703 - DNA, 601 bp, Human; identical to SEQ ID NO: 37827

SEQ ID NO: 89704 - DNA, 601 bp, Human; identical to SEQ ID NO: 37828

SEQ ID NO: 89705 - DNA, 601 bp, Human; identical to SEQ ID NO: 37829

SEQ ID NO: 89706 - DNA, 601 bp, Human; identical to SEQ ID NO: 37830

SEQ ID NO: 89707 - DNA, 601 bp, Human; identical to SEQ ID NO: 37831

SEQ ID NO: 89708 - DNA, 601 bp, Human
tggtcacggtgaccatagaaaccaggatgagtctcaggattaaatattgaaatgaactatttcagtggggcaagggagagatggcatctacacctagaaatcaggaaataatcatgggtctccttgaatgtggaacgaaataggaaacctcccaggacagaaggcccaggctgcagagtgtgacccagtgtctctcaccctgtgtggctcactctgtgttctcagagttgatctgggtccttctgggatgcccttaccctcccagttgcttcaggctcaaggcagacaggtgagaactcasaacccctggagtctccttccagcactaaagattcagtgggaggaaaaagccccggctgctggaatcagcgctaatatttccataggtagcctgccttgtgcagttcacaaaggtggattccaaaccctaccgtattggcatccaaggtaggtgcagatgtgtagaagggtgacaagctcacagtcaactaactggaaaatcacaaagtccagagcacaaccagctcacatgaagccacgtcctgagctcgttcctctcccttacagtggggggtgacctcagatcccctcatgaacaagc

SEQ ID NO: 89709 - DNA, 601 bp, Human
accctttgaaaatcactgatcagaaccagcgggctctaaatttggcaccaagaatgccaagcaactggtgaacaaactttctttatatatcaattcattaaactttgtctccaggctgctttgccacttcacattgagaatctttagggagtgataaatggaaaaggcaaaaaggagaaaagaaagccttagagatcacccgtctacctctgacctcaccagtcccttctcacacagacacagacacacataagcacacaagtatagacacacacagacacacggggacaggcatcggcattttttttttttttttgagacggagtttcgctctgtcactcaggctggagtgtagtggcgtgaatctcggctcactgcaacctccacctcccgggttcaagagatttgcctgcctccacctcccgagtagttgggattacaggtgtgcgccaccacgccgggctaatttttgtattttaactagagaaggagtttcaccatgttggccaggctggtctcaaactcctaacctcaagtgatctgcctcccttggcctcccagagttctgagattacaggtctgagcccccgcacccagccag

SEQ ID NO: 89710 - DNA, 601 bp, Human
tctgtggaagggactttcttttggccctaggccccttcctgcccctgtcgtcagcaggtcagtaagcaaggcgagcttgggggtggccccagtcgagatgcccttcaccccttgaagatcacccctcttttggtggtggtggtactggtttgtctcagttggaggccggctgaatgggggcgcctcaacttccggttgggggaggggaggaaggccgtcctggggaggggggacaccctcacttcctgtgggggggtggtgatggtttgggggtgtccgacccacttccagtgctggtgakggcttgaaaaggtggtgcttggtgccattcgcggagacattatcttgcagcttggggattgtgttttatgtgaaaagttagattattccaagttgtgctgaacaccaacctgcagtcagaatttatgagtttgcttccacgtggaatatggagcatttcctccccagcaaaattgtctgtgttttcttcaaagaattcgaaagcccttgttaaaaatctctatgcacctttgcaagacgacatagcttgtgtgactgatgaattgccaacacctgcacccctactcaagtccagccttgg

SEQ ID NO: 89711 - DNA, 601 bp, Human
tagaacctgtttttattctttttaaaaatgtttctttagagaggcttgctgtcctccaaaggtttttttttcttaatgccctttgtgcagttttctttgcatgtttaatagaaatatagtatcaaaatttaaagaattaatatttttgtacatgtactgttacttcaagttaatgaatttgagatttcattccattacttgccatatatgtaacaaagaaagtgtcaaatctttttttcaaatacttggattagataaccattttcttttccaaagacagtcattggatacactgctcacrgcagtttgaaatattaaaaccgtaggtcacaattctggattccatctgactgaaattagattatccacagagatgttatacataatacagaagtgtcttttcattctttcatctactttactttgtaaaatcaggctaatgttttgcaactgttgctttccttgtttgtcgttttggtggtggtttgtttttgttgttgtttttgccgtagggttgaggattaaagaaagtatcttaagaacctgaatggtttttcaccttactgctttgctgtctctatttcatagccttcacaggtat

SEQ ID NO: 89712 - DNA, 601 bp, Human
gaccggcttgggtaacatagtgagatgctgtctctacaaaaaaataaaaaatagccagacatggtggtatatacacatgtggtcatagctactcaggaggctgaggccagaggatcgcgtaagcccaggagttcaaggctgtgagctgttatcgagccactgcactccaacctgggctacagagcaagactctgtctcaaaaaaaaaaaaaaaggaggggggagcctctagaacataggcctttaatctgtgtggttgttttgcaatttatatgtataatttttaaataatatgttggccrggcacagtggtttgtatctataatctcaacactttgggaggctgagacaggaggattgcttgaggccaggagtttgagactaacacaggcaacatagcaagaccccatctctactaaacaaaataataataatttaatatggtgggtttttttgttttttttgtttttttgagacggagtcttgctctgtctcccaggctggagtgcagtggcgctagtgagctcatgcaattctcctgcctcagcctcccaagtagctgggattactagcgcttgcctgcttcaaaagaaatgatttcc

SEQ ID NO: 89713 - DNA, 601 bp, Human
gagacaggaggattgcttgaggccaggagtttgagactaacacaggcaacatagcaagaccccatctctactaaacaaaataataataatttaatatggtgggtttttttgttttttttgtttttttgagacggagtcttgctctgtctcccaggctggagtgcagtggcgctagtgagctcatgcaattctcctgcctcagcctcccaagtagctgggattactagcgcttgcctgcttcaaaagaaatgatttccagcaccccattttttcttttccagcctcaaaattcatatctcctttttttcccccatgtccacatgtccttcattcctatacttcatagctttaattcctgttctcttgatacaaaccttcatgtttgttgcttgatggcatcataattatcataactttttggcttaataacagtagcagttatatcaacaaataataaaatgttcatacttttgagccaataattccacatatagaacttcattctgagaaaatactttaaataagaaaaatagttaaaggcacaaaatgttaatagcactgatatctatactgtctaaaacttgaaaccttctaaatattc

SEQ ID NO: 89714 - DNA, 601 bp, Human
ccagcaccccattttttcttttccagcctcaaaattcatatctcctttttttcccccatgtccacatgtccttcattcctatacttcatagctttaattcctgttctcttgatacaaaccttcatgtttgttgcttgatggcatcataattatcataactttttggcttaataacagtagcagttatatcaacaaataataaaatgttcatacttttgagccaataattccacatatagaacttcattctgagaaaatactttaaataagaaaaatagttaaaggcacaaaatgttaatarcactgatatctatactgtctaaaacttgaaaccttctaaatattcaacaatataataatgcctaagcaaattattgcctatctactcagtgggctgtaagacattcatttttcacaatagcgtctttaagaatacattgaaagatgttgtaagaatgtttttgcaaaaatgaaaaggagaaacatcagaagaaaaagtagaaaaactaatgtgattggtgtctatttctgaagcatttatattttctatataataataatttacatttactgaccacttacttgtgtcaggaacaatact

SEQ ID NO: 89715 - DNA, 601 bp, Human
tgcttttgctaagaacaggaaagatgagaattaaaaagaaaagtgaaggcatcagagacctgctgaggcatccaggacttaagaaaccacaaccatagaaccaaaggagcttcagagaagtgggctgatgttccatgcttctcttttttcctaggaatttgctaattcttagagcatgacaagatgctgtgaaacttagcagagggtttcttctaaaagcagagaagctgttagttttatggggcggagcagacaaaacttggattttagagatctccaggtagctagttcttgggtcaakatccctagagaaggacagtacccagaaacttttttaaaacttgttttcccctcacagtgtttgctaggcagagtctagaactgtaagaaagttaatttgtattgctttaagccaatagctttggataacttgtgacagcaacaatatgaaactattacagagacatgaggaaatgatgaagaagtctaacatacatatgactggaggagagaaagttagaagcagtaatattttaagagacagtgattgagaattttctaaaaccgatgacaaatatcaagccatggatttgaaaagtgc

SEQ ID NO: 89716 - DNA, 601 bp, Human
ttggtttatttattttttattttattttattttattttgagatggagtctccctctgtcacccaggctggaatgcagtggcgtgatctcagctcactgcaacctttgcctcctgtgttcaagcgattctcctgcctcagccttccaagtagctgggattacaggtgcatgccaccacacccagctaatttttgtatttttagtagagacaaggtttcaccatgttggccaggctggtctcgaagtcctgacctcaggtgatttgcctgccttggccttccaaagtgctagaattacaggcrtgagctaccatgcccagctggttttttttgtttttttaattgacaaaaattatatgtatttatcatgtacagcatgatgttttgaaatatgtatacattgtggaatagctaaattgcgctaattaacatatgtattacctcacacaatttatgtggtaaaaacactgagcatctactctcttagcaattttcaagaatataatacattgttattaactatagttaacatgttgtacaatagatatctcaaacttattcctcctatcaaactgaaattttgtgtcctttgaccaacatctt

SEQ ID NO: 89717 - DNA, 601 bp, Human
aatacattgttattaactatagttaacatgttgtacaatagatatctcaaacttattcctcctatcaaactgaaattttgtgtcctttgaccaacatcttcccagccccaccccacccctggtaactaccattctactctatacttccatgagttcaggttttctagattccacatatgagatcatatggtatttgtcagtgccaggctaatttcacttaacagataatgccctccaggctcattcattttgttgcaaatgacaggatttccttcctttttttaaagctgaatagtattcyattgtgcgtatataccacattttctgtgttcatctgttgatggatactgaggctgattccatatcttggctattgtgaataatctggcaataaccctgagagtgcagatatcttttcaacatagtgatttcatttcccttggatatattctcagagaatgcaacctttaagttccttaaagaaaataactgccaatctagaaatcacgatggcaattagaacacatttacaacagcgtgattatgaaaatacatgtgaatcagttaaagatatactcaatgaaaaatttatagccttaaa

SEQ ID NO: 89718 - DNA, 601 bp, Human
cagcctcccaagttgctgggactacagatgcgtgccaccatgcctggctaaattcttttattgtattttttttaagtagagatggggtttcaccatgttggccaggctgctctcaaacacctgacctcaagtgatccgcccgcctcggcctcccaaaatgctaggattacaggtgtgagccactgcacccagccatttgttttgtactttaagtttacttaaaccctccactccctcaatgacttgaaggactgtattatttttctctacattccctatacacaaaccatgtaggtggtaygcttctaccccaccattccatcaaaagggctctactaggttactaataacttccatgttgtcaaaaaacttgggcatcttttacattctcatttaacctcagtaacatgtaggtgcatcttttttttttttcttgagatagtctgacaccacgcattcctggctctctgcctacctctgttcatgtcctttttgcagttcctcctctactcatcttctaactgttgagttcctcagaacacaattctaactccttttaacctattatctctcctgaggttatatcatacattcatgcttt

SEQ ID NO: 89719 - DNA, 601 bp, Human
ctgacctcaagtgatccgcccgcctcggcctcccaaaatgctaggattacaggtgtgagccactgcacccagccatttgttttgtactttaagtttacttaaaccctccactccctcaatgacttgaaggactgtattatttttctctacattccctatacacaaaccatgtaggtggtatgcttctaccccaccattccatcaaaagggctctactaggttactaataacttccatgttgtcaaaaaacttgggcatcttttacattctcatttaacctcagtaacatgtaggtgcatcttttttttttttcttgagatagtctgacaccacgcattcctggctctctgcctacctctgttcatgtcctttttgcagttcctcctctactcatcttctaactgttgagttcctcagaacacaattctaactccttttaacctattatctctcctgaggttatatcatacattcatgctttaaaatactatctactatacttgctggaaactcctaaactcctgtctccatctcagacttttgttctgtatacagagtacaacttgatattttatctcaaaggcatcttaaaatgaacatg

SEQ ID NO: 89720 - DNA, 601 bp, Human
tttttgaagtttttgatgattagtcttctcagtgctaagctaaattggcagtgtgtgcagattttatttaagcccccacagaggaatacacctacccacattttttagattgaaactttttttttgttttttgagacggagtttcactcttgttgcccaggctggagtgcggtggcgtgatctcagctcacagcaacctctgcctcctgggttcaagcgattctcctgcctcagcctcctgagtagctgggattacaggcatgcgccaccacacctgactaatgtttgtatttttctagtrgagatggggtttcaccatgttggccaggctggtcttgaactcctgacctcagatgatctccctgcctcggcctcccaaagtgttgggattacatgtgtgagccactgtgcgcagccctaagttgaaactctttaaaagtaaagatagagagttctcaatagcagtcttgactaaataactttgtcttcttttctagaactgcaattttgttcgtttttttgagacaagatctggctctgtggcccaagctggagtgcagtggcatgataactcactgcagccttgaactcctaggcaaaa

SEQ ID NO: 89721 - DNA, 601 bp, Human
ctcttcctactgcctcaggttgtctccttgtagtttatgcagcatatcatcctttatcaaatatttgagatgctttttgtctccaaattttgagtgaatttgttgtagaaatcacagttaagctttttttccctcatagctcacattactacatcttgattgtaatttatcaactttgtcttttaaatattctaatgttactaaacacccagggccaaattaaatatttggacagagtttctagtaagaataaatgcctccagagaagcttctgtggaaaaatattgtaatgatgagcttragagtaccaataacttttctttttcgtgtaaggcaatttagagtccaatttctgaaggcacagagatgccagtggaattagagatgaatcaaacacattacattttaggtttatcttaaggtatattggcaagaagtaaaacaacaacttaccaaaagcttgttacttttcctgccagtgacataagaatgtacatataacaacctcagatatattgtaattttcagagttaaacctcttaaggaaatgctgagctcattttcctggtctgttttcccataattaaatggtattcttgtt

SEQ ID NO: 89722 - DNA, 601 bp, Human
aacccaggctggagtgcagtggtgtgatccctcatcactgcaacctccacctcccaggtttaagcgattctccttcctcagcctccagagtagctgggattataggctcctgccaccataccgggctaatttttgtatttttagtagagacagggtttcaccatgttgtccaggctggttttgaactcctgactttaagtgatctgcccacctcggcctcccaacactttgaacattttgatgtgtttccttccaatctttgttcttatatatctattttttatgatgatgatgatgatgtttattattattattattattattattattattattattaagttagggtctcactctgtcacccagactggagtgcagtggcacgatctcacctcactgcaacatccacctcctgggttcaagctattctcctgcctcagcctctggagtagctgggattacaggcgcccaccaccatgcctggctaatttttgtattttcagtagagacagggtttcaccatgttggccaggctcgtcttgaactcctgacctcaagtgatccacccatctctgcttcccaatactttgaatattttgat

SEQ ID NO: 89723 - DNA, 601 bp, Human
gttttagagctacctaccttagtatgaatctggattttcaaacgtgtaaggacccagagctgtgtggtccttctcaggtgttttctcagctggtgttttctgtttccttcagctctccagtgcatctgtgaatgtattaggataattaacaattaccttagctggttacctaacccattcaattcttctttctctgtttttctcatatatttgaataaataccgttatacacatcagccattaccctttttccacgtcccctactagattatgaactgtaaaataataagtgttgttgggwtttttaaatcttatttacctctgtatctttgatgcctaacatagtgacatatgataaactgaaaaacattgtttttcaactttaaaaaaaaaactcgtgtctcctcttgataaatacataaattcccttttctgatataccctgcatgtgaatcaccaagatgtgagtaaaaagtatacatatgtggctgggtgcggtggctcacgcctgtaatcccagcactttgggaggccgaggcgggtggatcacaaggtcaggagatcgagaccatcctggctaatacagtgaaaccccatctct

SEQ ID NO: 89724 - DNA, 601 bp, Human
cagccattaccctttttccacgtcccctactagattatgaactgtaaaataataagtgttgttgggatttttaaatcttatttacctctgtatctttgatgcctaacatagtgacatatgataaactgaaaaacattgtttttcaactttaaaaaaaaaactcgtgtctcctcttgataaatacataaattcccttttctgatataccctgcatgtgaatcaccaagatgtgagtaaaaagtatacatatgtggctgggtgcggtggctcacgcctgtaatcccagcactttgggaggccraggcgggtggatcacaaggtcaggagatcgagaccatcctggctaatacagtgaaaccccatctctactaaaaatacaaaaaattagccgggcatggtggtgggcacctgtagtcccagctactcaggaggctgaggcaggagaatggcgtgaaccctggaggcagagcttgcagtgagccaagatcacgccactgcactccagcctgggtgacagagcgagactccgtctcaaaaaaaaaaaaaaaagagtatacatatgtgtctttaccaaacaagaacattaactttttgtgctttg

SEQ ID NO: 89725 - DNA, 601 bp, Human
attagccgggcatggtggtgggcacctgtagtcccagctactcaggaggctgaggcaggagaatggcgtgaaccctggaggcagagcttgcagtgagccaagatcacgccactgcactccagcctgggtgacagagcgagactccgtctcaaaaaaaaaaaaaaaagagtatacatatgtgtctttaccaaacaagaacattaactttttgtgctttgtgtacttaaaacaagcttggttttgttttttgtttttttcctccaaatagaaaattgactgtcactgaaaacaccttttcatrtatcacaggccttctagagggagtaaggctttaccagcattccccatcccagcttatatggacccacctttttaccgtttcatagtacacccatgtcccaggaaataggggaagtactctacactaaggaaataattccaggttttattggattactttaactcttagttcaggcactggtccagaagttgtcttacttgggcaatcacctccttgtttactaataataaaagcagtgcttagattgcctctgtaggaagggcaacttgggaccaacaggcaccatgaaaaagccaacga

SEQ ID NO: 89726 - DNA, 601 bp, Human
taaaatgacaaattttgctttggaagaggaagtgttttttattttccctgcgttatcaccgtgctttacaaaaactgatacaaaatactattcttagatgttttggttttgtggagtttttttcttcacaacacattttccgtcctaatattgacagttctccatcaaggttccattgagggggcaaaaggcatatacagtgatccaattgtctagcaagaaatctgaactgtgccagtctcttttgatgatctagtacttctgtggtttttaagaagatatctgatttaagtttctaaayttttacttcaaaaaaacatgtaccatcacataaggaatttggagaaaaaaatcataaagatagaagtttaatttttgtttctaactctggcctctttttctccctttttatttttcgaaaacagagtctctacaaggaagataacggactgtaaaattctataaagcaaagctacacatcacttgacaccatacaccatcttggttacataatgaaggtgatcaacaaatgtttgttgaaatataaactctctaggcatttgcattagatggagcctggattatttcttttgtggccaaa

SEQ ID NO: 89727 - DNA, 601 bp, Human
atgatttccttactttcccttttccctctccaccttcattcagtctgttcttaaaatagcagccagaatgatcctataaacttgttaaattttatgccttatctgctgaaaaccttccagtagccccggttagctttcagacctcatctccttttcccactagttcagtccagccacatttgccacctcctcagtcacaccagggggacttctttgcactagttgtttcctctgctagggccactctttcccccacatacatgcatagttctttcatctccttctggtcttttcctaaagrttacctcagtgaagcctttcatggcctctgtatataaaattgcagacaccccatttccttgaactgttcctaacctctttccctgccctgttttttcttggtacttcaaactatgtatcattattcattttacttattttatcttgttttttgtctgttccagtacactgtgagctctataagggcaaggatctttgcctgttttggtcattgctgtattcccaatgcatagaaaatgcccaggatagtagataatatttgttgaatgaatggatcagtttctctatagtttggttccta

SEQ ID NO: 89728 - DNA, 601 bp, Human
cttccagtagccccggttagctttcagacctcatctccttttcccactagttcagtccagccacatttgccacctcctcagtcacaccagggggacttctttgcactagttgtttcctctgctagggccactctttcccccacatacatgcatagttctttcatctccttctggtcttttcctaaagattacctcagtgaagcctttcatggcctctgtatataaaattgcagacaccccatttccttgaactgttcctaacctctttccctgccctgttttttcttggtacttcaaactrtgtatcattattcattttacttattttatcttgttttttgtctgttccagtacactgtgagctctataagggcaaggatctttgcctgttttggtcattgctgtattcccaatgcatagaaaatgcccaggatagtagataatatttgttgaatgaatggatcagtttctctatagtttggttcctagggtagcctaccaacattttaaaaatcaataataaggccgggcgcggtggctcacgcctgtaatcccagcactttgggaggccgaggtgggtggatcacaaggtcaggagttc

SEQ ID NO: 89729 - DNA, 601 bp, Human
gcacgatctcggctcactgcaagctctgcctccagggttcgcgccattctcctgcctcagcctccccgagtagctaggactacaggcgcccaccaccacacccggctaattttttgtatttgagtatttgcatacacataatgagatatgttggggataagacccaagtctaaacaggaaatccatttatggtgtatccatttaccttacacatggcttgaaggtaattttatagcaatgattttatttattttgtgtatgaaacaaagtttgtatacattgaaccatgagaaagcaaagrtgtcactcagccacccacatgtacagtctgtgattgtttggcatcaccattattcctgattcagaattcatgtgctaccaataagaatcattctcttacacttatttgcacataagtacttaacagtaaaaaatgtgacataccattaatacaatgaaaaaataatgtgttcggggtaagcagtacagtagcatcaccagtgcacctgtgccagctgttaacaacaaacaatggcaagttgaataaactaattatcgtgtgccagtgtttttattgtgacccattacgtgaagtcccatg

SEQ ID NO: 89730 - DNA, 601 bp, Human
gtatccatttaccttacacatggcttgaaggtaattttatagcaatgattttatttattttgtgtatgaaacaaagtttgtatacattgaaccatgagaaagcaaagatgtcactcagccacccacatgtacagtctgtgattgtttggcatcaccattattcctgattcagaattcatgtgctaccaataagaatcattctcttacacttatttgcacataagtacttaacagtaaaaaatgtgacataccattaatacaatgaaaaaataatgtgttcggggtaagcagtacagtagcrtcaccagtgcacctgtgccagctgttaacaacaaacaatggcaagttgaataaactaattatcgtgtgccagtgtttttattgtgacccattacgtgaagtcccatgtggaatttttgtattttgtattttcatacaatgaaggagagttcttgttccacatccttgccagcatttggtggtatcagtgtttgggatttagggcattctaataggtgtgtagtggtagctcactattgtatgaatttcctcttgggtcatcaagtgggcactcaggaaatttcagattttggagcatttt

SEQ ID NO: 89731 - DNA, 601 bp, Human
cttatttgcacataagtacttaacagtaaaaaatgtgacataccattaatacaatgaaaaaataatgtgttcggggtaagcagtacagtagcatcaccagtgcacctgtgccagctgttaacaacaaacaatggcaagttgaataaactaattatcgtgtgccagtgtttttattgtgacccattacgtgaagtcccatgtggaatttttgtattttgtattttcatacaatgaaggagagttcttgttccacatccttgccagcatttggtggtatcagtgtttgggatttagggcattytaataggtgtgtagtggtagctcactattgtatgaatttcctcttgggtcatcaagtgggcactcaggaaatttcagattttggagcattttgaatttctgattttcagattagggatgctcaatttatatagccttttcagattgacttctttcacttagtaatatgcactaagtttcctccatgtctttccatggcttcataactcatatctttttagcagtgaataatattctattatctgaatgtatcacagttcagccactcacctactgaaggacatcttggttatgcccaagt

SEQ ID NO: 89732 - DNA, 601 bp, Human
tattaaggtaagaagtgcgattgctggattgtatggcaagagtatgtttaattttgtaaaaaacttcctgtcttttgaaatgtctgtactgttttgtatccccacataatgaaggagagttcctgttgctccgcatcattgtcagcacttagtggtgtcagtgtttgggattttggccattctaataggtttgtagtggtagatcattattgttttaatttgcagttatagttggccctgtgtatccttgggttctgcatccacaaattcaatcagtttggggtggaaaatacagtattcragagacacagaacctatggatacagggccgactttttgtaatcatgggttctgcagggccaattgtgggcatctacaaattttgagctcgcagtgtactggaacagacaaaaaacaagataaaataagtaaaatgaaaaaagatacatagtttgaagtaccaagaaaaaaacagagcagggaaggaggttaggaacagttcaaggaaagggggtgtctgcaattttatatacagaggccatgaaaggcttcactgagcaaaattgatgttaaagattcaatacttagacatgaatatcta

SEQ ID NO: 89733 - DNA, 601 bp, Human
ggttctgcagggccaattgtgggcatctacaaattttgagctcgcagtgtactggaacagacaaaaaacaagataaaataagtaaaatgaaaaaagatacatagtttgaagtaccaagaaaaaaacagagcagggaaggaggttaggaacagttcaaggaaagggggtgtctgcaattttatatacagaggccatgaaaggcttcactgagcaaaattgatgttaaagattcaatacttagacatgaatatctaacgtgaatggaaagttgaaaattccaatacagaatatacatcaatcrgccatgttcactaaagtagacatgaacactgactctattgtttgaagatagtctcactccttacaaataataaaggagaatgcatatatgaggaaacatttagagaatatattgagtgtcccccagtttcagagttaatccatttaaaagacacataatctgcaaaagtgccttgcttgagcaataaataaatactaattgaatgaggagcctccttcagttgaggggtatggtgtggctttaggcaaagtctggccacaatattatgatgaagctgtgaaatacataattgtatttgct

SEQ ID NO: 89734 - DNA, 601 bp, Human
acttgggaggctgaagcacaagaatcgcttgaacccaggaggtagaggttgcagtgagccaggatcacaccagtgcactccagcatggacaacagaatgatactctatctaaaaaataataataataatacaaaacacaatttgaaataggatttgagtagacagttctccaaaacagataaacaaatgcacaatatgcataagaaaaaatgcttaacatcattactcattaggaaaatatgaaccaaaatcacaatgagataccacttcacatctactaggatggctctaataaaaaagrtaataccaagtgtgctgaggatatggagaaattggaaccctaataggttactggtatgaatgtaaaatggtagaggtgctttgaaaaacagtttgattttctcaaaatattaaacatggtggtaccagatgttccagcagctccactcctaggtatatgcccaagagaactgaaaacatgtccacacaaaaatttatacacaaatgttcataagcagcagcattcataataaccaaaaagtagaaacaacccaagtctatcaactgatatgtggatcaacaaaatgtgcaatagccatcc

SEQ ID NO: 89735 - DNA, 601 bp, Human
tgcaatagccatccagtataatattattcagccataaagcagaatgaaattctgatacacgctacaatgtgaaccttgaaaactttatgctaagtgagagtagccagacacaaaaggccacatattgtatgattctatttatatgaaatatcagaataggtacagttataaagacagaaagtaggcaggcatgatggctcacgcctattatcccaacagttcgggagactgaggcaggaggattgcttgaggctaggaattcaagacagcctgggcaacatagcgaaaccctatctctacaaaaaaaaaaaaaaattaaaaattagccaggcgtggtcctagctactcaggaggctgaggcagagagatcacttgagacaagcagtttgaggcatcagtgagctatgattatgccactgcactccagcctgggtgacggagcaggaccctgtctcttaaaaaaaaaaaaaaaaacaaagtagattagtggttgcccaggcctaggaggactagcaggaagggagaatggggattgtttgctaaaggatattgtgtttctttttggggtgatgaaaatgttctaaaattggttagggtgttg

SEQ ID NO: 89736 - DNA, 601 bp, Human
caatctttataatcatcattaaaatattttaaattggcactcttttatatgtcaggtttttttcagtgagtggttagtgttagagggaattttgggatttccaaagctcaggtccagaccctggttcaaagtgttctaagtggcaaagtaataccatttttgtgaggcttcctggtagaagccttcactggataagtcccctctactaggtaacatctgcatgatagacctgtttgtataaagtgcagtgaagagccaaacttgtatattgctttgcctttgaacaaatttctcttctttmctcatttagagcagcattcattacatttcttaagtgctttgcataaaatttcaaagttcagtgtgacctctgtactgggacatcatcaggcacagatgctacatgtgaagggcttttggcaatcagtggcttggtagccgtgattccttttgaatcactccctcatggaccatatgaaatgcattctcccaggatcccagacatattcttgggaatcattgtattttccgacttactggactagtttagaggcctttgggtttcactgcacttttcttcatttccttcttttgttgatct

SEQ ID NO: 89737 - DNA, 601 bp, Human
tgaatctcaaggttcttgaaaggccattgacttctagggatacttttagaaagaagccagtcaatcccaggcgtagtggctcacacctgtaatcctaacactttgggaggccgaagtgggcggatcacttgaggctaggagttcaagaccaacctggccaacatggtgataccccgtctgtactaaaaatacaaaaattagctggtgtggtggcacgtacctgtaatcccagcaacttgggaggctgaagcacaagaatcacctgaacctgggaggcgtgggcaacagagcgagactgtcaaaaaaaaaaaaaaaaaaaaagccagtcaagtgagttccctaaggtatatacctggccatttgaatgtttgctcactatggttagtctgtatggtatctaacagatattacagttttcttttggtaaaatgaacattgacattggtgtgaggtgatgttagcagcccaggctttaatctcgcctttgtattgtataatgtgaattaaaacttaagtacacttgagtcagggttattcagtaaaacatgtggaatggaattttgtggtatttattagagctattccacttgtaaacacctta

SEQ ID NO: 89738 - DNA, 601 bp, Human; identical to SEQ ID NO: 38615

SEQ ID NO: 89739 - DNA, 601 bp, Human; identical to SEQ ID NO: 38616

SEQ ID NO: 89740 - DNA, 601 bp, Human; identical to SEQ ID NO: 38617

SEQ ID NO: 89741 - DNA, 601 bp, Human; identical to SEQ ID NO: 38618

SEQ ID NO: 89742 - DNA, 601 bp, Human; identical to SEQ ID NO: 38619

SEQ ID NO: 89743 - DNA, 601 bp, Human; identical to SEQ ID NO: 38620

SEQ ID NO: 89744 - DNA, 601 bp, Human; identical to SEQ ID NO: 38621

SEQ ID NO: 89745 - DNA, 601 bp, Human; identical to SEQ ID NO: 38622

SEQ ID NO: 89746 - DNA, 601 bp, Human; identical to SEQ ID NO: 38623

SEQ ID NO: 89747 - DNA, 601 bp, Human; identical to SEQ ID NO: 38624

SEQ ID NO: 89748 - DNA, 601 bp, Human; identical to SEQ ID NO: 38625

SEQ ID NO: 89749 - DNA, 601 bp, Human; identical to SEQ ID NO: 38626

SEQ ID NO: 89750 - DNA, 601 bp, Human; identical to SEQ ID NO: 38627

SEQ ID NO: 89751 - DNA, 601 bp, Human; identical to SEQ ID NO: 38628

SEQ ID NO: 89752 - DNA, 601 bp, Human; identical to SEQ ID NO: 38629

SEQ ID NO: 89753 - DNA, 601 bp, Human; identical to SEQ ID NO: 38630

SEQ ID NO: 89754 - DNA, 601 bp, Human; identical to SEQ ID NO: 38631

SEQ ID NO: 89755 - DNA, 601 bp, Human; identical to SEQ ID NO: 38632

SEQ ID NO: 89756 - DNA, 601 bp, Human; identical to SEQ ID NO: 38633

SEQ ID NO: 89757 - DNA, 601 bp, Human; identical to SEQ ID NO: 38634

SEQ ID NO: 89758 - DNA, 601 bp, Human; identical to SEQ ID NO: 38635

SEQ ID NO: 89759 - DNA, 601 bp, Human; identical to SEQ ID NO: 38636

SEQ ID NO: 89760 - DNA, 601 bp, Human; identical to SEQ ID NO: 38637

SEQ ID NO: 89761 - DNA, 601 bp, Human; identical to SEQ ID NO: 38638

SEQ ID NO: 89762 - DNA, 601 bp, Human; identical to SEQ ID NO: 38639

SEQ ID NO: 89763 - DNA, 601 bp, Human; identical to SEQ ID NO: 38640

SEQ ID NO: 89764 - DNA, 601 bp, Human; identical to SEQ ID NO: 38641

SEQ ID NO: 89765 - DNA, 601 bp, Human; identical to SEQ ID NO: 51055

SEQ ID NO: 89766 - DNA, 601 bp, Human; identical to SEQ ID NO: 51056

SEQ ID NO: 89767 - DNA, 601 bp, Human; identical to SEQ ID NO: 51057

SEQ ID NO: 89768 - DNA, 601 bp, Human; identical to SEQ ID NO: 51058

SEQ ID NO: 89769 - DNA, 601 bp, Human; identical to SEQ ID NO: 51059

SEQ ID NO: 89770 - DNA, 601 bp, Human; identical to SEQ ID NO: 51060

SEQ ID NO: 89771 - DNA, 601 bp, Human; identical to SEQ ID NO: 51061

SEQ ID NO: 89772 - DNA, 601 bp, Human; identical to SEQ ID NO: 51062

SEQ ID NO: 89773 - DNA, 601 bp, Human; identical to SEQ ID NO: 51063

SEQ ID NO: 89774 - DNA, 601 bp, Human; identical to SEQ ID NO: 51064

SEQ ID NO: 89775 - DNA, 601 bp, Human; identical to SEQ ID NO: 51065

SEQ ID NO: 89776 - DNA, 601 bp, Human; identical to SEQ ID NO: 51066

SEQ ID NO: 89777 - DNA, 601 bp, Human; identical to SEQ ID NO: 51067

SEQ ID NO: 89778 - DNA, 601 bp, Human; identical to SEQ ID NO: 51068

SEQ ID NO: 89779 - DNA, 601 bp, Human; identical to SEQ ID NO: 51069

SEQ ID NO: 89780 - DNA, 601 bp, Human; identical to SEQ ID NO: 51070

SEQ ID NO: 89781 - DNA, 601 bp, Human; identical to SEQ ID NO: 51071

SEQ ID NO: 89782 - DNA, 601 bp, Human; identical to SEQ ID NO: 51072

SEQ ID NO: 89783 - DNA, 601 bp, Human; identical to SEQ ID NO: 51073

SEQ ID NO: 89784 - DNA, 601 bp, Human; identical to SEQ ID NO: 24496

SEQ ID NO: 89785 - DNA, 601 bp, Human; identical to SEQ ID NO: 24497

SEQ ID NO: 89786 - DNA, 601 bp, Human; identical to SEQ ID NO: 24498

SEQ ID NO: 89787 - DNA, 601 bp, Human; identical to SEQ ID NO: 24499

SEQ ID NO: 89788 - DNA, 601 bp, Human; identical to SEQ ID NO: 24500

SEQ ID NO: 89789 - DNA, 601 bp, Human; identical to SEQ ID NO: 24501

SEQ ID NO: 89790 - DNA, 601 bp, Human; identical to SEQ ID NO: 24502

SEQ ID NO: 89791 - DNA, 601 bp, Human; identical to SEQ ID NO: 24503

SEQ ID NO: 89792 - DNA, 601 bp, Human; identical to SEQ ID NO: 24504

SEQ ID NO: 89793 - DNA, 601 bp, Human; identical to SEQ ID NO: 24505

SEQ ID NO: 89794 - DNA, 601 bp, Human; identical to SEQ ID NO: 24506

SEQ ID NO: 89795 - DNA, 601 bp, Human; identical to SEQ ID NO: 24507

SEQ ID NO: 89796 - DNA, 601 bp, Human; identical to SEQ ID NO: 24508

SEQ ID NO: 89797 - DNA, 601 bp, Human; identical to SEQ ID NO: 24509

SEQ ID NO: 89798 - DNA, 601 bp, Human; identical to SEQ ID NO: 24510

SEQ ID NO: 89799 - DNA, 601 bp, Human; identical to SEQ ID NO: 24511

SEQ ID NO: 89800 - DNA, 601 bp, Human; identical to SEQ ID NO: 24512

SEQ ID NO: 89801 - DNA, 601 bp, Human; identical to SEQ ID NO: 24513

SEQ ID NO: 89802 - DNA, 601 bp, Human; identical to SEQ ID NO: 24514

SEQ ID NO: 89803 - DNA, 601 bp, Human; identical to SEQ ID NO: 24515

SEQ ID NO: 89804 - DNA, 601 bp, Human; identical to SEQ ID NO: 24516

SEQ ID NO: 89805 - DNA, 601 bp, Human; identical to SEQ ID NO: 24517

SEQ ID NO: 89806 - DNA, 601 bp, Human; identical to SEQ ID NO: 24518

SEQ ID NO: 89807 - DNA, 601 bp, Human; identical to SEQ ID NO: 24519

SEQ ID NO: 89808 - DNA, 601 bp, Human; identical to SEQ ID NO: 24520

SEQ ID NO: 89809 - DNA, 601 bp, Human; identical to SEQ ID NO: 24521

SEQ ID NO: 89810 - DNA, 601 bp, Human; identical to SEQ ID NO: 24522

SEQ ID NO: 89811 - DNA, 601 bp, Human; identical to SEQ ID NO: 24523

SEQ ID NO: 89812 - DNA, 601 bp, Human; identical to SEQ ID NO: 24524

SEQ ID NO: 89813 - DNA, 601 bp, Human; identical to SEQ ID NO: 24525

SEQ ID NO: 89814 - DNA, 601 bp, Human; identical to SEQ ID NO: 24526

SEQ ID NO: 89815 - DNA, 601 bp, Human; identical to SEQ ID NO: 24527

SEQ ID NO: 89816 - DNA, 601 bp, Human; identical to SEQ ID NO: 24528

SEQ ID NO: 89817 - DNA, 601 bp, Human; identical to SEQ ID NO: 24529

SEQ ID NO: 89818 - DNA, 601 bp, Human; identical to SEQ ID NO: 24530

SEQ ID NO: 89819 - DNA, 601 bp, Human; identical to SEQ ID NO: 24531

SEQ ID NO: 89820 - DNA, 601 bp, Human; identical to SEQ ID NO: 24532

SEQ ID NO: 89821 - DNA, 601 bp, Human
gcccccatacggtgcccctgaccaccttctccgcccagcctggaccctaaatgccagcctaagcctccatcagaggaggtgggaccggaagaggtctgggctgagagtgcaactgcccatccctggccttcctggctgtgtgggtagggggttcctgtgggttcctctataccgtagtggctggctctggctctggctggcctctgggcaaggtccttccagagatgcttctggggtcgtgtcttcctcctgggcctgcagccaccgaagctcctcaggctccaaggcctggtaccggagkgggggcccaccttcgggagccagcacagggctagcagcctcttgatcagctccgcaggcccctctgaccccaggcctcaccacggcccccgggagctgcaggaatcgctgcatcaggttcttctccaggaatggactgagctggccagggcgctggggctcctgtcacagtcaccagatggcccgcccccaaaacttggtaaccggacactggcagggagggaggctccggtttcctcttcactgctcagagacaaggcctctagagggaaagaagggcagggacaggagaccaagccta

SEQ ID NO: 89822 - DNA, 601 bp, Human
atcttctgaggagtcaccctgggatggcttttccctgggcttccgtggaaggagggccaagtttgcccaatctcctttaactctgggtattcccttcctcaccacacccacaaatgccacatgcgcctgtcaaatgcacacaccccagggcatcctccccacccagcctagtgagtacattccaggcccctgcaggagaaggggaatgaaagggggcaggaccactgggcctaaagcagccagcacaggtaagattgactgtcgaatatgcactgacacagaatatgcactgacacagacygcagccaccacctgaggtgagaccgccctgggcctctcgtcctcactcccaccaacttctgttcccaagaggcagaggcagggactaaggcacaacaccctaaggccatgaaacattatctcccatagtcagatccccttacgctgctgcactcactctgacctgacccctagtctgacctagcctaagggactcttctgggggtggctggagccagccagggggcctggcatggcactgggggtcagtcatgctcacctcccttgatatacacctcgctgtcacctcttaccacctaag

SEQ ID NO: 89823 - DNA, 601 bp, Human
tttgacccaggcacaagaacccagcttgagaaatatcacagtgataaaaattaaaaatcaggccgggcacggtggctcacgcctgtaatcccagcactttgggaggccaaggcaggcggatcacaaggccaggagatcgagaccatcctggctaacatggtgaaaccctgtctctactaaaaaatttaaaaaaaattagccgggtgtggtggcgggcgtctgtagtcctagctactcagtaggctgaggcaggagaatggcgtgaacccaggaggtggagcttgcagtgagccaagatcgygccactgcactccagcctgggcaacagaacgagactccatctcaaaaataaaaaataaaaaaaaaatcaatgtgtgcaaagttagtcacagacatgcaacatttagaaatgacagaaaatcagaaattggggatagcactgttaggagaggaaagagcatgataacaatcataaagtggcaaatgactgctgctaatgctgagaaacaagtgatgaatgctgagaggaagagaagaaccagacagaacacgcaccttagtcacagggctgcagaaatgcgtgagtacctgacgtcagaca

SEQ ID NO: 89824 - DNA, 601 bp, Human
tgacaatagggatgctaggagaacttctgttctaatatttggtcttccacccagttcctcacgcagagatcctaagacctttataacttcctgagtgagaggaacaactgacatggaaatcccttggaatttcctgggtgatagaagcatcttttgttatcagatggttggaactttttttctttctttctttctttttttttttttttttgacactgagtcttgctctgtcgcccaggctggagtggtgcagtgaggcaatctcggctcactgcagcctccgccttctgggttgaagcarttctcctgcctcagccttccaaatagctgggactacagttgcccaccaccacacctggcaaatttttgtatttttaatagagatgggtttcatcatgttggtcaggctggtctcgaactcctgacctcaagtgatccacccgccttggcctccaaaagtgctgggattataggcgtgagctgctgtgcccagctgagggttgaaactttcaatcccactatttgacctctggggaatggggagtggggctgatggttgagttgatcacatggccaaagatgcgatcaatcatgaagcctt

SEQ ID NO: 89825 - DNA, 601 bp, Human
aacagaaggtcaaaggtcatggggggaatttcataaaaggtctaacttgataaattacgaaccaataagaatctccccccgcccccacccccccgcccccgccccacttaaataaatgctattgggacaactgctttgcagcactttttttttttttagatggaattttgctctcattgcccaggctggagtgcaatggcacgatctcgggtcactgaaacctctgcctcctgggttcaagtgattctcctgcctcagcctcccaagtagctgggattacaggcatgcaccaccacgctcsggtaatttttgtatttttagtagagacagggtttcaccatgttggtcaggctggtctcaaactcctgacctcaagtgatcttcccgcctcatcctcccaaagcgctgagattacaggtgtgagccaccacacctggccagcagcaaataatttaacttgtatacatatttcaccccaaaataaatcccgcatttgcttaacagttaattatttttaaatacaaaagaaggaagggaagattttattaaggtcataaaattattagcagcaacaatatggctaggtttaattggtacgttt

SEQ ID NO: 89826 - DNA, 601 bp, Human
tggcctcacaacaaaagccagacctgtcactgaacattgaacagccattcaaggaagtcattaaactctagtgggatgaataaagatttgagtaagtgatcccttgcacttggctgagaggaataagggtaatgctgagccaatacacaggtttctttttttttttagatctcatacttcatttcaaaagtttgaaatttcaaagggaacattttgtcaaacttaagtgacagcaaaattcatctggaaaaaaaaaatcagtaggtaagaactccaaagaatatttttgggaaaagaaggmaacaatcatagacaactcaccctattggacttcaaaacataaacaccacgagacgatgataaaagctgtttggtaccaggttaaaaacagaaggtcaaaggtcatggggggaatttcataaaaggtctaacttgataaattacgaaccaataagaatctccccccgcccccacccccccgcccccgccccacttaaataaatgctattgggacaactgctttgcagcactttttttttttttagatggaattttgctctcattgcccaggctggagtgcaatggcacgatctcgggtcac

SEQ ID NO: 89827 - DNA, 601 bp, Human
tgccaaaacaagagcagggtgcccttgccctgcctccagtatgtttccaagtcctgacctctcagaccaaactgattccagggactggaagggtcccagagactccatagatggcctcacaacaaaagccagacctgtcactgaacattgaacagccattcaaggaagtcattaaactctagtgggatgaataaagatttgagtaagtgatcccttgcacttggctgagaggaataagggtaatgctgagccaatacacaggtttctttttttttttagatctcatacttcatttcaaaartttgaaatttcaaagggaacattttgtcaaacttaagtgacagcaaaattcatctggaaaaaaaaaatcagtaggtaagaactccaaagaatatttttgggaaaagaaggcaacaatcatagacaactcaccctattggacttcaaaacataaacaccacgagacgatgataaaagctgtttggtaccaggttaaaaacagaaggtcaaaggtcatggggggaatttcataaaaggtctaacttgataaattacgaaccaataagaatctccccccgcccccacccccccgcccccgccc

SEQ ID NO: 89828 - DNA, 601 bp, Human
gtacttttgatacaggagtgtaggaaatgaatgtagccagaaacagagagccaggaaacaagaggaagggtttggggtgggaaagtatggacctggctcagggaaaaggactagttggatggataagaaggaccagcggaaaagaggtagatgccaaaacaagagcagggtgcccttgccctgcctccagtatgtttccaagtcctgacctctcagaccaaactgattccagggactggaagggtcccagagactccatagatggcctcacaacaaaagccagacctgtcactgaacattraacagccattcaaggaagtcattaaactctagtgggatgaataaagatttgagtaagtgatcccttgcacttggctgagaggaataagggtaatgctgagccaatacacaggtttctttttttttttagatctcatacttcatttcaaaagtttgaaatttcaaagggaacattttgtcaaacttaagtgacagcaaaattcatctggaaaaaaaaaatcagtaggtaagaactccaaagaatatttttgggaaaagaaggcaacaatcatagacaactcaccctattggacttcaaaac

SEQ ID NO: 89829 - DNA, 601 bp, Human
ctcgctctgtcgcccaggctggagtgcagcagtggcgcaatctcggctcactgcaagctccacctcctgggttcatgccattctcctgcctcagcctaccgagtagctgggactacaggtacccgccaccaccacgcccagctaattgtttgtatttttagtagagacggggtttcaccgtgttagccaggatggtctcgatctcctgacctcgtgatctacccgtcttggcctcccaaagtgctgggattacaggcatgagccacgctgggattacaggcatgagccaccgcacccagcacccagcatgccacatgttcttaatccagtctatcactgatggacatttgggttggttccaagtctttgctattgtgaacagtgctgcaataaacatacgtgtgcatgtgtctttatagtagaatgatttacaatcctttgggtatatacccaataacgggatcactgggtcaaatggtatttctagttctagatccttgaggaatcgccacactgtcttccacaatgggtgaactagtttacactcccaccaacagtgtaaaaatgtttctatttctccacatcctctccagcacctgtt

SEQ ID NO: 89830 - DNA, 601 bp, Human
agtctcgctctgtcgcccaggctggagtgcagcagtggcgcaatctcggctcactgcaagctccacctcctgggttcatgccattctcctgcctcagcctaccgagtagctgggactacaggtacccgccaccaccacgcccagctaattgtttgtatttttagtagagacggggtttcaccgtgttagccaggatggtctcgatctcctgacctcgtgatctacccgtcttggcctcccaaagtgctgggattacaggcatgagccacgctgggattacaggcatgagccaccgcaccccgcacccagcatgccacatgttcttaatccagtctatcactgatggacatttgggttggttccaagtctttgctattgtgaacagtgctgcaataaacatacgtgtgcatgtgtctttatagtagaatgatttacaatcctttgggtatatacccaataacgggatcactgggtcaaatggtatttctagttctagatccttgaggaatcgccacactgtcttccacaatgggtgaactagtttacactcccaccaacagtgtaaaaatgtttctatttctccacatcctctccagcacct

SEQ ID NO: 89831 - DNA, 601 bp, Human
tggagtctcgctctgtcgcccaggctggagtgcagcagtggcgcaatctcggctcactgcaagctccacctcctgggttcatgccattctcctgcctcagcctaccgagtagctgggactacaggtacccgccaccaccacgcccagctaattgtttgtatttttagtagagacggggtttcaccgtgttagccaggatggtctcgatctcctgacctcgtgatctacccgtcttggcctcccaaagtgctgggattacaggcatgagccacgctgggattacaggcatgagccaccgcagccagcacccagcatgccacatgttcttaatccagtctatcactgatggacatttgggttggttccaagtctttgctattgtgaacagtgctgcaataaacatacgtgtgcatgtgtctttatagtagaatgatttacaatcctttgggtatatacccaataacgggatcactgggtcaaatggtatttctagttctagatccttgaggaatcgccacactgtcttccacaatgggtgaactagtttacactcccaccaacagtgtaaaaatgtttctatttctccacatcctctccagca

SEQ ID NO: 89832 - DNA, 601 bp, Human
atggagtctcgctctgtcgcccaggctggagtgcagcagtggcgcaatctcggctcactgcaagctccacctcctgggttcatgccattctcctgcctcagcctaccgagtagctgggactacaggtacccgccaccaccacgcccagctaattgtttgtatttttagtagagacggggtttcaccgtgttagccaggatggtctcgatctcctgacctcgtgatctacccgtcttggcctcccaaagtgctgggattacaggcatgagccacgctgggattacaggcatgagccaccgcgcccagcacccagcatgccacatgttcttaatccagtctatcactgatggacatttgggttggttccaagtctttgctattgtgaacagtgctgcaataaacatacgtgtgcatgtgtctttatagtagaatgatttacaatcctttgggtatatacccaataacgggatcactgggtcaaatggtatttctagttctagatccttgaggaatcgccacactgtcttccacaatgggtgaactagtttacactcccaccaacagtgtaaaaatgtttctatttctccacatcctctccagc

SEQ ID NO: 89833 - DNA, 601 bp, Human
aaaatagattaaattgaaattaaaaaaacacaaaaaacaaaagacagccacttaaagagacagacacagggagactaccatgtgaaggcagacgattggaaagatgcgtctacaagccagggaatgccagagactgccagcaaacaaccagaagctagaaggggcaaagaaggatttccctatgggtttcagagggagcatggtcctgccgacaccttgagttcagacttttggcctccagagctgtgagacaattcatttctgctgttccaaccaacccaattgttgtacttttttttttcaattactaaactttttttttttaattatacttttaagttctagggtacatgtgcacaacgtgcagctttgttacatatgtatacatgtgccatgttggtgtgctgcacccattaattcgtcatttacattaggtattcctcctaatgctatccctccctcctcccccaacgccacaacaggccccagtgtgtgatgttccccaccccgtgttcaagtgttctcattgttcaattcccacctatgagtgagaacctgcagtgtttggttttctgtccttgcagtagtttgctcagaatga

SEQ ID NO: 89834 - DNA, 601 bp, Human
tcattatattattctttatgccttttgtgaacctgtagtaaattttattttattttttagatacagggtctccctatgttgcccaggctggagtacagtggctattcacaggtgcagtcataatgcagtacagcctgaaatcaatttttttttttttttgagatggatctcacactgtcgcctgggctggactgcagtggcacgttctcggctcattgcaacctctgcctcccgggttcaagccattctcctgcgtcagcctcctgagtagctgggattatgggcacccgccaccatgccmagctaattttttgtatttttagtagagatggagtttcaccatgttggccaggctggtcttgaactcctgaccttgtgatttgcctgcttcggcctcccaaagtgctgggattacaggcatgagccaccacacccagcctgaaatcaatttttaaaaattatagttgtggaggtttcaacaaaagagaatggtttaaaaaacaccccaaatagtggtagttgtcttgagatggagcaagttgccttatgaaggagtgaggtccctatcagaaaagatgacctgttagacatgttctagagc

SEQ ID NO: 89835 - DNA, 601 bp, Human
caccatttacaaaacattttatattgcttaacaatatgcaaattactagcacaggaataaatacatacctatgaatgataaacaagagaagatatataggaggctttggctatttgagaaatgtgtcatttcttatggatattcattatattattctttatgccttttgtgaacctgtagtaaattttattttattttttagatacagggtctccctatgttgcccaggctggagtacagtggctattcacaggtgcagtcataatgcagtacagcctgaaatcaatttttttttttttttgagatggatctcacactgtcgcctgggctggactgcagtggcacgttctcggctcattgcaacctctgcctcccgggttcaagccattctcctgcgtcagcctcctgagtagctgggattatgggcacccgccaccatgcccagctaattttttgtatttttagtagagatggagtttcaccatgttggccaggctggtcttgaactcctgaccttgtgatttgcctgcttcggcctcccaaagtgctgggattacaggcatgagccaccacacccagcctgaaatcaatttttaaaaat

SEQ ID NO: 89836 - DNA, 601 bp, Human
ttgttgtcatttcaacaatgttcacagcatctgcaccaggagttttttttttttttttttttttttttttttgaaacggagtctcgctctgtcgcccaggctggaatgcagtggcgagatctcgggtcactgcaagctccacctcccaggttcacgccattctcctgcctcagcctcccgagtagctgggactacaggtgcccgccaccatgcctggctaattttttctgtttttagtagagacggggtttcactgtgttagccaggatggtctcgatctcctgacctcgtgatccacccrcctcggccacccaaaatgctgggattacaggcgtgagccactgcacccggcagattccattttaagaaaggactttctttgttcactcataagaagcaagtcctcatccattcaagttttatcatgagattgcagcaattcagtcacatcttcaggctccacttttaattctacttctacttctaggtagaattccaccacatatgtagttacttcctccactgacgtagtgaacccctcaaagtcatccatggagtttagaatcaacttcttccaaactcctgttaatgttaatatttt

SEQ ID NO: 89837 - DNA, 601 bp, Human
aaaaaaattgaagtcagtcctcttaaactctgcctctgctttatcaactaagtttatgtaatattctaaatcctttgttgtcatttcaacaatgttcacagcatctgcaccaggagttttttttttttttttttttttttttttttgaaacggagtctcgctctgtcgcccaggctggaatgcagtggcgagatctcgggtcactgcaagctccacctcccaggttcacgccattctcctgcctcagcctcccgagtagctgggactacaggtgcccgccaccatgcctggctaattttttctgtttttagtagagacggggtttcactgtgttagccaggatggtctcgatctcctgacctcgtgatccacccgcctcggccacccaaaatgctgggattacaggcgtgagccactgcacccggcagattccattttaagaaaggactttctttgttcactcataagaagcaagtcctcatccattcaagttttatcatgagattgcagcaattcagtcacatcttcaggctccacttttaattctacttctacttctaggtagaattccaccacatatgtagttacttcctccactgac

SEQ ID NO: 89838 - DNA, 601 bp, Human
gcttggctgccaggttgatgacctgcagcttgacaatatcctcctctgctgtgaatgacttggccatttttcttaagacatcaggtgcaatcctggggacatgctcacagtactctccgatgagccacaggatgctggctcgggccatgggcacctgtggttgtgggagaggagtgaagatgggtaaatacgggaaagtgggtgggtaggattgtggacttccagggaaacagcactcctcatctgtgctggcctgttgtattatgggttctctggaaatgggagttgggggtggtgagakagagagaggttaaaaggtagacatttcctagacagcatttcccctcttccctagggcttcattagcatagagctttcaagaccctaagtcagtcatgatgtaaaagattgattttctggattcattgtaccctcagtactttatttccatgttactctccagaatctttgggaatgccttgtttagatgtttcagcttagcagtgcgatagaaaaacacaagatttgtcactcaaccatggttggctagagctttagagagaaaacaagagtagtagtaaagtccatcgtgctcattgag

SEQ ID NO: 89839 - DNA, 601 bp, Human
catggtgtttgatgtccctgacaccttgaaaagctcagcacattatgcttcattttaggagaatctcctggaaccatctcaggagatgccagacagctaggaggctctgaacaccctgatactacaacttagttgagcctcatccttggctgtgtatctcttataacctttcaccttgggaatgacagtggccaccagcaccacccaagcccaagcagagactcacccccttatctttggcacagactggccaagcattgtcaagctttggaaagaagcacagaccacatctgggatgcaygttctcccatcagtacctgccactgttgggcccttcccttatcccaatcaactgtggttcttcacagccccagagttccaaggtggcagacaggactcttgtactagcagactggaggtcacagcttcataggagagtctcttcaacagtgaccaccagcactacaaggtctttgtgggcactggggtagcattggttatgtgggcagaccagccaccttccctgattcttcttttccaaaataggagctagagttcagccctgcctagggagggccaaaagaatactgtctagggagtt

SEQ ID NO: 89840 - DNA, 601 bp, Human
ctgaggcagaagaagaatcacttgcacccaggaggcagaggttgcagtgaggcaagatcacgccattgcactccagcctgggaaaaaagagtgaaacaccatctcaaaaaaaaacactacaaataggccaggtgcagtggctcacgcctgtaatcccagcactttgggaggccgagtcgggcagatcacttgcggccaggagttcaagaccagcctggccaacatggtgaaaccccatctctactaaaaatatgaaaattagccagacttggtggcgggcgcctgtaatcccagctactcrggaggctgaggcaggagaatcgtttgaacctgggaggcggaggttgcagtgagctgagatcatgccattgcactccagcctgggtgacagtgcaagactccatctcaaacaaacaaacaaaaactaaaaatagtgctaccatatgatccagcaatcccaatgctatgtatatacccaaaagtaaggaaatcaacatattgaagttatatctgcacacctacgtttattgcagcactgttcaccatagccaagatttgaaagcaacttaagtgtctatcaacagacaaatagataaagaaa

SEQ ID NO: 89841 - DNA, 601 bp, Human
acaagggattaataaccagaatacgtaaggagatcaaataactcaataggaaaaaaaaattcaataatccaatttaaaaatgggcaaaagagctgaatagacatttctcaaaagaagacatacagatagcaaacacgtatatgaaaaggtgatcaacatcattgagcatcagagaaatgcaaatcaaaactacaatgaaaggccaggcacgggtggctcatgcctgtaatcccagtactttgggaggctgaggcaggcggatcacctgagatcaggagttgagaccagcctgaccaacacrgcgaaaccccatctttactaaaagtacagaaattaacggggcgtggtgacgcacgcctgtagtcccagctactcaggaggctgaggcaggagaatcacttgaaccacagaggcagaggttgcagtgagccaagatcgcaccactgcacactccagcctgggtgacagagcaagactccgtctcaaaaaacaaaacaaaacaaaaaaagatatatcatctcaccccaagtaggcttatatccaaaagataggcaataacaaatgctgacaagaacatggagaaaaggcaacccttgtacac

SEQ ID NO: 89842 - DNA, 601 bp, Human
ggtttcgccatgctggccaggctgctcttgaactcctgacttcaggtgatccaccagcctcggcctcccaagatgctgggattacaggcatgagccaccacgcctggccgtgaattcatttttgacaaaggtatcaagaacatacattagggaaaggagagtctcttcaataaatggcgctgggaaaacgggatatccacatgcagaacaataaaaccagacccctatctctcaccatatgcaaaaatcaaatcatagtggattaaaaacttaaatctaacacttcaaactatgaaactamtaaaagaaaacattagagaaattctccaggacattgtactgggcaaagatttcttgagtgataccccacaagcacgggcaaccaaagcaaaagtagacaaatgggatcacatcaagttacaaaggttctgcacagcaaaggaatcagcaaagagacaagccacagaataggaggaaaaaatttgcaaactacccatctgacaagggattaataaccagaatacgtaaggagatcaaataactcaataggaaaaaaaaattcaataatccaatttaaaaatgggcaaaagagctgaataga

SEQ ID NO: 89843 - DNA, 450 bp, Human
ggaggccgaggcaggcagatcgtgagatcaagagattgagaccatcgtggccaacatgatgaaatcctgtctctactaaaaatacaaaaattagctggatgtggtgatgcacacctgtagtccgagctactcaggaggctgaggcaggagaaccgcttgaacccgggaggtgaaggttgcagtgagccaagatggcgccactgcactccagcctggtgacagagcaagactccgtttcaaaaaaaaaaaaaatcagtagcattgtccaggcacagtggctcacacctgtaatcctagcaascactttgggaggccgaggcaggcagaatacctgaggtcaggagttcgagaccagtctgaccaacatggagaaaccctgtctctactaaaaatacaaaattagctgggcatggtggtgcatgcctgtaatcccagctactcgggaggctg

SEQ ID NO: 89844 - DNA, 601 bp, Human
gactctgttcttcctgaggtttatggtgacatactgttacgtgtagccttggacatggttaacccagctaatctggcagggacatcaagcagatgtccataaggggcaaagcccctcagatgctgacccagagtctgagcagctgctttggcagaattgccccacaccactctagagagccactatgattccacattcctacctccaatctggcccacaggccctcttcagctcagtcccttccagcaaagcagcacctgcgatactgttatagtcacagataagcaatcccaatcccatrcaccgctaatagaatagacttaaaaatatgaaaataagatgccatcacaacagatttcatcaccaacctgcccctctcttggccagacaccatctaaatggccagggctagtggatgcccttaccaacatagtcaattatcaagaggctgctgatccctcttttggtttggacaatgtcttcctccacagatttcccagctggctgatcacagactccctccttcaagtccttgcctagttctagaaagaactgtttggtatttggatccatctgtccacagccttaactgcatgttaac

SEQ ID NO: 89845 - DNA, 601 bp, Human
accctgctcggaagggacgatgagctgccgggtgaagcgcgcccggtcgcgaatatcatagttctggtcatatttggccagactcagcacatactgggtcagcagcttggtctggaggaacaggaagaggtgggtcagctgacggggggatggggacacaggaggctcagaaacagattctttaagccgacactttcaggcagaacgtctcctctccctgcttaggaccggcgcttccacccagctgtccctccccacctgcccttgttctgggctcagaattttctctcatctctctggmcatgcctcctgatgatcccaactttgacaactgccttgggccaacaaaagaggttttccttttggactttccccactcctggctctggactccattcttccctagatttgtggtccctaccactccaggcctgtccagcctctttactctagggcagcagggtatgtggaagtatggaatgctctgctggacctcacagtttccaggctccaccacccagggggaattagacaacaaaaagacagggcagataaacaggggtccctttggcaggggccaccctcatgccctatccaccca

SEQ ID NO: 89846 - DNA, 601 bp, Human
ggcactgcagggctccctactgctgcccccaccaacacacacacacacacacacacacacacacacacttcaaccctccaccccgctgacctccacgttgcgcacagatgggtctggggcttcctccggccagtctgggagctcctggtagcctgtggccttggcattaagcaggtgggacagtgagcccagctggaagtggtcccggtctagggataggtttagaggtcaggcaggtagcagcagtgagggaaagctctgggagctgttttccaggtggggctgggtggtgattctggtygggacttcccaggtgggtaggggaaggagatggatgtgtgccctaatggctcttccaccctgactgcacctttaggcccacatgctggaagaaaaggctgtctggccaggccagagcagggactgagggccagggaaaggcagcctacagaggtgggcaggaggagactctgggcccacagatgctgccgacctgtctgctcagcatgcacgtctagtcaggctctggactcagcagggagggatgaacagtcagagcatgagtgtgtagaagtctggatcagagttgaggcactgctgg

SEQ ID NO: 89847 - DNA, 601 bp, Human
agttcattgttaccctgtccctttccagcccatcctctcacccccacctcgagttgggcacataccacagctggaagttggctgcctgggttgagtcacagaaattaatgcccattacagcagtggcagattctccaggtgccagggactctgaagtggtataaggcagtgaaggggagagggagggccaccatcacctgataggtctagaacccagcctagccctactctcctctccactgtcacagctgaccagccctctacagaatcttggctttcttggctgctggagactgttccyggtttcctcctgaactctaagcaccctttcccccactcaccctcaccacatttaagttagtcctgaaacaaccaaggcccaaatctgctgctgcaagcacctcccgccctgatgtgaacttgcttatttcatcatctgtcttgtccaccagagtgttgatcatgttagatgctatctctgtgcccctatagcttggcccctggcctggcacaaggagggtatcagcaaccacagaaagactgactctgcccaggagcctcctcctccaccccatccaaagcccttcgcaccaatttcggg

SEQ ID NO: 89848 - DNA, 601 bp, Human
ttttcccccaaggttctgtccttggccttcctattttctcccacctcccagagtgatctcattcatattcacagcttccattaccacctctatgttcatgactccagcttcaaagtgtttcctgggcatagacccatattttcagttgcatactaaatagctcctcctgaatttcccaaatgcatttcaaaatcagcttatccaaaactaaccatgatcttccctcctcccttgcccaagccactcttctttcttctaggccagaggttttgcaaattacagcctccagaccaaatccagsccaccacctatatggcccacaatgtttttaatattttttaagtgttgggggagcaatcaaaagattaatatttcatgacacatgaaaattacatgaaatttaaacttcagtatctataaatataaatggaaatttcttggaacacagccatactcgttcatttacatactgtctgtggatgtttctatgtttcaacagccacagtcgtgttgtaactgcaacagagaccacatgattctcaaagcctaaaacatttatctttggcccgttacagaaagtttgctgacccctggtctagat

SEQ ID NO: 89849 - DNA, 601 bp, Human
agagagactgacagcctaggtgtcatggggaggtatagatgggagccaaacaggtcacagcatttggaagtcactgggtcagagcctgtatcacatcctttaccagcatggtgccaatcaccattttctcgctgttgacagtcagctgggcagctccagctggccgggcatccagggtcagcagaacgaggcttccaccagtcagtgtcctccctgcaaacctgaggtgggaatagaaggggtgaggaagagctgctaagggtgactgtgtttggaaggggatcagcagctggggctcctscttcaaaccagggcccccatgctcatcatttcccctctactggtggcctagtacctgtactcatcagatgtcccacaaggaacacgacccaggttggcagtggcagtcactttctgcaccacaatgtggtcactccgacaggtgtctggcagcatgagtttctctgtgatctcattcatgcccatcagctttcctgggggtagaggtcgtgatgagggcagaggccatggtgggtacagaggccagcacctgggtctgcttactgagcaacaagttctcccaggctgggaaggtatcatg

SEQ ID NO: 89850 - DNA, 601 bp, Human
gggaccccatcaccaccaagaccccacccagcccttaccgtaccgcaccctctgctagggctgcagcctcccgccccagacccctcactgcagcgcccaccctggccctgggggtcccagccacgccttagcccgctgctctcaccgcatcgctgctcctggaaggagagaaaccaaggaggggggttagtggtgggctgtgtcctgtctcctaagggacccctggagtcccctctgaacaagaggtcgggggaccgcgcttccccttccttgggttccaggagtctgactcgcaaacccrcttcctctcttcacccaagagtccctacgcctacctcgcaggccaagggtccagcctctcagctgcgacccctcttgggaacccgggaggtcgcccccaactcccactgccttggggcatcactcacccatccgccatgctgagactcaggccgggaatggcaggaggcagggcgaggacaggggcgtttggagggtcagtgagggggccgcccgggtgaccttcagggtcccagggaccgtcagtctcctccgggctgcttgagactccccgaggacactgagataaagggcgaggaca

SEQ ID NO: 89851 - DNA, 601 bp, Human
ggttaggaggagtggggaccccatcaccaccaagaccccacccagcccttaccgtaccgcaccctctgctagggctgcagcctcccgccccagacccctcactgcagcgcccaccctggccctgggggtcccagccacgccttagcccgctgctctcaccgcatcgctgctcctggaaggagagaaaccaaggaggggggttagtggtgggctgtgtcctgtctcctaagggacccctggagtcccctctgaacaagaggtcgggggaccgcgcttccccttccttgggttccaggagtcygactcgcaaacccacttcctctcttcacccaagagtccctacgcctacctcgcaggccaagggtccagcctctcagctgcgacccctcttgggaacccgggaggtcgcccccaactcccactgccttggggcatcactcacccatccgccatgctgagactcaggccgggaatggcaggaggcagggcgaggacaggggcgtttggagggtcagtgagggggccgcccgggtgaccttcagggtcccagggaccgtcagtctcctccgggctgcttgagactccccgaggacactgagat

SEQ ID NO: 89852 - DNA, 601 bp, Human
ggggatagaggctgtactgctgaattccgggactagaaacctcgcatccttgggagccggtacctgcagctccgcgaagcccagcccggccaactccagcggctggcagcgggtgctcagagcgcgccccttctctccgcgccgctcctccgcctctcgctccagctcttgctttgcaatctgcagcagcagagtctgcagaggggtgggagggaagcgcagcccacccggggcttcaggataaagaccaggcgtggggaaccgcctctgcccttctaaaccctccagtttggtctccacygttccaaggccccgtcccaccccgagcagtactccccgctaaagccacgccccgagcggccaaaccccgcccacttccgcccacctaccccgaaagccccacccattctcaagctccgccccctgagcacctgcctgctctttcccagtcccgcccgtcctcaccttcagctgcaattttctcgaggcggagatcttagattttttctgccagggtgagatggagcaaggaaggatcatggagggggattcggagacgacggtggaggggacctcaagacacccccagcaaacccagccg

SEQ ID NO: 89853 - DNA, 601 bp, Human
gttcaagcaattctcctgcctcagcttcacaagtagctgggattacaggcacccacgaccacgcccagcaaatgtttgtatttttactacaggtggggtttcactgtgttggccaggctggtctcaaactcctgacctcatgatccgcccgccttggcctcccaaagcgctgggattacaggcacgagccaccacacccggtaactttggtattttttatagagacatggtctcgccatgttgcccaggctggtctcgaactccagagctcaagcaatctgcctgccttagcatcccaaaktgttgagattacaggcatgagccaccacgcccaaccttcttttgttgttatttattgttaatctcttactgtgtctaatttagaaatgaaactttatcataggtatgtatgtgtgtataggaaaaaaaattacatatagggttcagtacaatccatggtttcaggcatccactcctatctttcctgtcttcttctttaagatagggtctcactgtattgcccaggctggagtgcagtggtgcagtcatagctcactgcaccctcgatctcatgggctcaagcgattttcctgcctcagcc

SEQ ID NO: 89854 - DNA, 601 bp, Human; identical to SEQ ID NO: 40582

SEQ ID NO: 89855 - DNA, 601 bp, Human; identical to SEQ ID NO: 40583

SEQ ID NO: 89856 - DNA, 601 bp, Human; identical to SEQ ID NO: 40584

SEQ ID NO: 89857 - DNA, 601 bp, Human; identical to SEQ ID NO: 40585

SEQ ID NO: 89858 - DNA, 601 bp, Human; identical to SEQ ID NO: 40586

SEQ ID NO: 89859 - DNA, 601 bp, Human; identical to SEQ ID NO: 40587

SEQ ID NO: 89860 - DNA, 601 bp, Human; identical to SEQ ID NO: 40588

SEQ ID NO: 89861 - DNA, 601 bp, Human; identical to SEQ ID NO: 40589

SEQ ID NO: 89862 - DNA, 601 bp, Human; identical to SEQ ID NO: 40590

SEQ ID NO: 89863 - DNA, 601 bp, Human; identical to SEQ ID NO: 40591

SEQ ID NO: 89864 - DNA, 601 bp, Human; identical to SEQ ID NO: 40592

SEQ ID NO: 89865 - DNA, 601 bp, Human; identical to SEQ ID NO: 40593

SEQ ID NO: 89866 - DNA, 601 bp, Human; identical to SEQ ID NO: 40594

SEQ ID NO: 89867 - DNA, 601 bp, Human; identical to SEQ ID NO: 40595

SEQ ID NO: 89868 - DNA, 601 bp, Human; identical to SEQ ID NO: 40596

SEQ ID NO: 89869 - DNA, 601 bp, Human; identical to SEQ ID NO: 40597

SEQ ID NO: 89870 - DNA, 601 bp, Human
cacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaargagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaa

SEQ ID NO: 89871 - DNA, 601 bp, Human
cacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatkgaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagttttt

SEQ ID NO: 89872 - DNA, 601 bp, Human
atagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttctt

SEQ ID NO: 89873 - DNA, 601 bp, Human
ctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagkgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatg

SEQ ID NO: 89874 - DNA, 601 bp, Human
atgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcytgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggc

SEQ ID NO: 89875 - DNA, 601 bp, Human
aagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttg

SEQ ID NO: 89876 - DNA, 601 bp, Human
acaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtaytctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatt

SEQ ID NO: 89877 - DNA, 601 bp, Human
ttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtatwcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctga

SEQ ID NO: 89878 - DNA, 601 bp, Human
ttcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctraagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcct

SEQ ID NO: 89879 - DNA, 601 bp, Human
gaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttstactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgctt

SEQ ID NO: 89880 - DNA, 601 bp, Human
ggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacrttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaata

SEQ ID NO: 89881 - DNA, 601 bp, Human
cagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatc

SEQ ID NO: 89882 - DNA, 601 bp, Human
gatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctygaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtg

SEQ ID NO: 89883 - DNA, 601 bp, Human
ttctaacatggtttaagaggcagggttagcataaagctaatgaaggttagtcttcagaactctgcactttcatgatccccttctagggaagtcggaagggctgtgtattcataatttcttatggagagtgaagttggaggggtactggcattttgtatttgttttatttttcttatagagggccctccatattgtttagctttcaggctcccacatgcctcttggtatgattgtgacgagaactagagagactttgagagagctgtttgtgaagtgttaacaattctttcttctgcactcyttccctaaaattgggttttcttgatgtgttccccatttcccacctgaagtcaatgactggcacccatccaaacatggctcacctgtagatgtgcttgaaattggtgcacctgaagcctgttcccctgaagcgtgctcacctgaaggctgttcacccgaggcctgctcaccagaaggctgttcaccggagccatgttcacctgaaggctgttcatctgaaggctgttcacctgactcaagctcactcaaaggctgttctccggagaggtgttcacctgaaggctgttctcctgaaggctgc

SEQ ID NO: 89884 - DNA, 601 bp, Human
cattccaactgccccctaccagaagtaagttgatgtgttctcaggcagaaattgcctcatgaagtccccatataccttcaaagatcttctttaacatgcactgctgggaattctgagtgatgcaggttccctctccacgaagacattttccttgatcattcatataagcacatgtgtagcaatttaatattgtgcctgaaaatttaagataagcctgatgacatttccttgtggaccagatgtgtagccttgattcacatctgggaggggtaatgggcaataggtagcatggatactacayatttatttcttagttctttttggggatctgggccctgtgtctgatagacctgtgccagaggaaattccttcattcttcttcatctctgaccctcattgctgatgaatcccaaatttctctctctaatatttttactccagtccatatctgcattgacttcctgggcatttatcattagatacccttctgtcatgtgacagcataggagcaaaatgtatgtgtgattttcatctcccttttgtactccccatcatactctcacccacaaggcacaaacacttggagtcatatttgaccgat

SEQ ID NO: 89885 - DNA, 601 bp, Human
agatcttattgcagaaagattgatttcgacagcatataatttgcatcctcgttccatgggagaagaggttcatagatgggcacatgttctcacacccttgaaccatgaattggagttttccacctgaaaggagcagagacagactagtgagcagaaagcttcgtcctccaaccttagcctttatctgtgatgctcagtgtctccatgcaggatggtcaagacctccacttgtccattatcccttctctttctcttctatttgcttcctctgggaacttgccccccatcagttgcccactcstttcttatattgtcagtccgtttctatggactccttttttggtttacaaggatgctcaggttaccccaaatttaaaatactttctcttaatcgtgctactcccctagcactatccttcctttccttacagccttcccagagtctgcctatcctcctcaccttggcccctcacagtttgaatcatgaccctactatgccgaaacctctctcaaaagtcatagagatctactcatcaaattctgcatccttttctcaggacttttttaacctctttgcttgcacatcatactgtggactaca

SEQ ID NO: 89886 - DNA, 601 bp, Human; identical to SEQ ID NO: 89883

SEQ ID NO: 89887 - DNA, 601 bp, Human; identical to SEQ ID NO: 89884

SEQ ID NO: 89888 - DNA, 601 bp, Human; identical to SEQ ID NO: 89885

SEQ ID NO: 89889 - DNA, 601 bp, Human; identical to SEQ ID NO: 89883

SEQ ID NO: 89890 - DNA, 601 bp, Human; identical to SEQ ID NO: 89884

SEQ ID NO: 89891 - DNA, 601 bp, Human; identical to SEQ ID NO: 89885

SEQ ID NO: 89892 - DNA, 601 bp, Human; identical to SEQ ID NO: 89883

SEQ ID NO: 89893 - DNA, 601 bp, Human; identical to SEQ ID NO: 89884

SEQ ID NO: 89894 - DNA, 601 bp, Human; identical to SEQ ID NO: 89885

SEQ ID NO: 89895 - DNA, 601 bp, Human; identical to SEQ ID NO: 89883

SEQ ID NO: 89896 - DNA, 601 bp, Human; identical to SEQ ID NO: 89884

SEQ ID NO: 89897 - DNA, 601 bp, Human; identical to SEQ ID NO: 89885

SEQ ID NO: 89898 - DNA, 601 bp, Human; identical to SEQ ID NO: 89883

SEQ ID NO: 89899 - DNA, 601 bp, Human; identical to SEQ ID NO: 89884

SEQ ID NO: 89900 - DNA, 601 bp, Human; identical to SEQ ID NO: 89885

SEQ ID NO: 89901 - DNA, 601 bp, Human; identical to SEQ ID NO: 89883

SEQ ID NO: 89902 - DNA, 601 bp, Human; identical to SEQ ID NO: 89884

SEQ ID NO: 89903 - DNA, 601 bp, Human; identical to SEQ ID NO: 89885

SEQ ID NO: 89904 - DNA, 601 bp, Human; identical to SEQ ID NO: 89883

SEQ ID NO: 89905 - DNA, 601 bp, Human; identical to SEQ ID NO: 89884

SEQ ID NO: 89906 - DNA, 601 bp, Human; identical to SEQ ID NO: 89885

SEQ ID NO: 89907 - DNA, 601 bp, Human; identical to SEQ ID NO: 89883

SEQ ID NO: 89908 - DNA, 601 bp, Human; identical to SEQ ID NO: 89884

SEQ ID NO: 89909 - DNA, 601 bp, Human; identical to SEQ ID NO: 89885

SEQ ID NO: 89910 - DNA, 601 bp, Human; identical to SEQ ID NO: 89883

SEQ ID NO: 89911 - DNA, 601 bp, Human; identical to SEQ ID NO: 89884

SEQ ID NO: 89912 - DNA, 601 bp, Human; identical to SEQ ID NO: 89885

SEQ ID NO: 89913 - DNA, 601 bp, Human; identical to SEQ ID NO: 89883

SEQ ID NO: 89914 - DNA, 601 bp, Human; identical to SEQ ID NO: 89884

SEQ ID NO: 89915 - DNA, 601 bp, Human; identical to SEQ ID NO: 89885

SEQ ID NO: 89916 - DNA, 601 bp, Human; identical to SEQ ID NO: 89883

SEQ ID NO: 89917 - DNA, 601 bp, Human; identical to SEQ ID NO: 89884

SEQ ID NO: 89918 - DNA, 601 bp, Human; identical to SEQ ID NO: 89885

SEQ ID NO: 89919 - DNA, 601 bp, Human; identical to SEQ ID NO: 89883

SEQ ID NO: 89920 - DNA, 601 bp, Human; identical to SEQ ID NO: 89884

SEQ ID NO: 89921 - DNA, 601 bp, Human; identical to SEQ ID NO: 89885

SEQ ID NO: 89922 - DNA, 601 bp, Human; identical to SEQ ID NO: 89883

SEQ ID NO: 89923 - DNA, 601 bp, Human; identical to SEQ ID NO: 89884

SEQ ID NO: 89924 - DNA, 601 bp, Human; identical to SEQ ID NO: 89885

SEQ ID NO: 89925 - DNA, 601 bp, Human; identical to SEQ ID NO: 89883

SEQ ID NO: 89926 - DNA, 601 bp, Human; identical to SEQ ID NO: 89884

SEQ ID NO: 89927 - DNA, 601 bp, Human; identical to SEQ ID NO: 89885

SEQ ID NO: 89928 - DNA, 601 bp, Human
ggaccaggactgacccaggtctgagccccagctcagcggtcggctagctgtgcgagcttgcgcagtagctccccaagtgtggctcaggacgcacagcatcggcgtcagcatcgcccaggaacctgttagagatacacatttttggccccaacctgcatcgaccaagtcagaaattctgcagtgtgtgttttcgtaagtcctccaggtgactctgatgtactctcagggttcagaaccattgagagagagcagtttagctgacctcctccaggcctcacctgcgcatggtcacgactgtacyttccgcacacagtcgccgagatgcgtgtgaaaccccaagcacaaagcagagtgaatcgcagtggccagagcatacctgaagcaccagcgctggtcccctccctccccctctcctcacctgcctcctaggagtcggagggtccgtggaaatggtctcctcctgcacatctgtgctgctgtgactgggtgcaggtctgagcagaggctttcggagtgagctgagcaggcgagcccgagcacggcctctcagggagcgagcccataggctggggagccgtccctggagatgcccctgggctcc

SEQ ID NO: 89929 - DNA, 601 bp, Human
tagtcccagcccaggttcctggcctgctgctccctgaggagggtttgccagtgccagcccgtgcttccttgtaccaggacttggtctgctgggacccagtggaaagcccacggctgccgcccccacccaccttcccctgcttgccagccacagtcaccagctgtagacttgtgtggctgtgctgcggaagcagatctgggtggaggagggccccacgcacagacgtgaatatgaagggaccctctagaggttgtggcaaacacaggtgccccgccccatgccctgtctgcagtcacagccmttcctacatggagggtgctatcatcaatcttctggggggctgtggacactctgcatccccatacctgtggcagtcctggcacacggtaagctctcagtaagtgtggtgagtcactgctgaaggaactaacaaataaacctcccaccaccaaccacaggtagctggggcagaactagggaactgctgaaaggaggctggtgaaccctgccatgacatgcccgctgtgcccaggacccaggctcccacagctcgcgtccttcctctatcccagatccattcaaagtgaagtggcctccatac

SEQ ID NO: 89930 - DNA, 601 bp, Human
ggttctctgagacggaacaggaagtattttaaggaagacctccctaacctcctcccagctgggtggatccctccctctgggcccccacacatctcagtttcaaaagaccattcacattgtagtctaaattagtggatccctggtgtgtgatgtgtgcagttataatgggttgcctcagcccccaacgcacctttcattgccttcttctgtgataatgcccctgggccctgtacccatttctcccttgccagctggcatgatgtttagccctgtgcagaggcaggggcctctccccggttcygacatttctttctctgcttgccccggctgctggggggacatgagggacacttggccctgttctctcttcagcaataattagtcccagcccaggttcctggcctgctgctccctgaggagggtttgccagtgccagcccgtgcttccttgtaccaggacttggtctgctgggacccagtggaaagcccacggctgccgcccccacccaccttcccctgcttgccagccacagtcaccagctgtagacttgtgtggctgtgctgcggaagcagatctgggtggaggagggccccacgcacag

SEQ ID NO: 89931 - DNA, 601 bp, Human
ctcctggggaaagcccaccactgtcttcttgccccgctctgtgccctcacacaagcgattctctccacctgcgacgtgtttcctctccctcccctggccagtgtccatgggttctctgagacggaacaggaagtattttaaggaagacctccctaacctcctcccagctgggtggatccctccctctgggcccccacacatctcagtttcaaaagaccattcacattgtagtctaaattagtggatccctggtgtgtgatgtgtgcagttataatgggttgcctcagcccccaacgcaccyttcattgccttcttctgtgataatgcccctgggccctgtacccatttctcccttgccagctggcatgatgtttagccctgtgcagaggcaggggcctctccccggttccgacatttctttctctgcttgccccggctgctggggggacatgagggacacttggccctgttctctcttcagcaataattagtcccagcccaggttcctggcctgctgctccctgaggagggtttgccagtgccagcccgtgcttccttgtaccaggacttggtctgctgggacccagtggaaagcccacgg

SEQ ID NO: 89932 - DNA, 601 bp, Human
tagtctgaaggacttgagactcctgaagtgagaggggacagagctaggagaagggagggcagccagaagggcaggggtgcagggggcgggatgaggagagccaggctggcattagcaagagcttcttcatgtccttttggcccaagggggccgtgttctctgaggaaatgggacttgctccagggaagaggaagagctcagcatccactttccctctgccgaacagctcctggggaaagcccaccactgtcttcttgccccgctctgtgccctcacacaagcgattctctccacctgcgaygtgtttcctctccctcccctggccagtgtccatgggttctctgagacggaacaggaagtattttaaggaagacctccctaacctcctcccagctgggtggatccctccctctgggcccccacacatctcagtttcaaaagaccattcacattgtagtctaaattagtggatccctggtgtgtgatgtgtgcagttataatgggttgcctcagcccccaacgcacctttcattgccttcttctgtgataatgcccctgggccctgtacccatttctcccttgccagctggcatgatgttta

SEQ ID NO: 89933 - DNA, 601 bp, Human
gtgccatgaaatgacagctgcttcttttgaagaactgggctattcccatgtaaagctggctgcaatggatgatgtttctgactcatactctggctttaaaatcaaagtgtttgttagaaagcagctttgttttccttctatttcctgtttgaaaagtgaagcgttaacacgaaggagggtcccagcggagttcatgccgggactcaggttgcacacggccagtggtcccgggatatccagggagccactcagaggggacacttccagctgccatgcaaactcatcatgcacccagcccccscttgctccagctctgaccatagtgccctcaacacagggccctgggcagctaccctcaaacacctggatgccaagcatgagagggaaccaacttgccctccctggtctattatcacaaagaaccttggagcccctgcacaggaacccactccttagagggcacaaggggccaagttttgtttgagacaatgagctggcattggaagggagagatgacagctatcctctgtcctgcttccagggcagggcagagcaagctgcttttggccccgtctctgaggcagacatgagcacacttgtc

SEQ ID NO: 89934 - DNA, 601 bp, Human
tatccatgacctccaggggcagctcacagcagcgccacctgcatcacccacagaatggagggagacagcggctctccacacaaaggcactgagaaaaaagaataccctgaaagccacacaggtctcagggcagcagggagtgggagcactcatcacaggccagaagcccagcaagtagcatcagacacctcaggttaaagagaacgtagagattgtcgcttcccaccctccccattctagtcaattcggaccagtttggtacatgctggccatgtgcggtgaccacgctaagtactgtgcrtgtaccatttctcggaatacttcctgcaaccttatgaagttctcgcccaatttaacaagcactaaccaaactcagaaggcatttacccaatgctgcacgttacgaaaatgtaaaagaacgaacacggcttcaataccaggattgagcccaaaggtcacgttctttccctgcggctcccttccccatctggttctggggaagacactctgcacgcagcccccaggagaccacaggccctggactcccaaatcccagcagcaatgcaaagccacccccagaagagctgcccaggacaagtga

SEQ ID NO: 89935 - DNA, 601 bp, Human
agcagaacacagagctgccttctctgtcctgctctctctcccactcacctgctcagaggttgccagccgggccctgtctccctctctgccctcctgggtatcacggtccctcaacccagggaagctggtgccctcacttgtctcccatagtcctgtgtcatctgggcttctgtggcccctctcagctttcaggaccatccagtcttccccgtccctgttctttctctcgcaagtccccggtggcccagggtctagggagaagctgcattctgagctactgcccacatcgcttccccagggyggcgggagctctggaatggcaggccccgtccttgacagcctatccatgacctccaggggcagctcacagcagcgccacctgcatcacccacagaatggagggagacagcggctctccacacaaaggcactgagaaaaaagaataccctgaaagccacacaggtctcagggcagcagggagtgggagcactcatcacaggccagaagcccagcaagtagcatcagacacctcaggttaaagagaacgtagagattgtcgcttcccaccctccccattctagtcaattcggaccagtttggt

SEQ ID NO: 89936 - DNA, 601 bp, Human
aacaaggcctctgtgtccacggttgtaaggtgtgggctaccctgatgaggggtgctccagctgtattcatgattcacattcattcattacatgcctgatctctatctcagaggcccggccttctgttagtaagctctcagattcagggaaaggagtctcagagaactccacatccgtgtggagtcagacggatcagagcagaacacagagctgccttctctgtcctgctctctctcccactcacctgctcagaggttgccagccgggccctgtctccctctctgccctcctgggtatcacrgtccctcaacccagggaagctggtgccctcacttgtctcccatagtcctgtgtcatctgggcttctgtggcccctctcagctttcaggaccatccagtcttccccgtccctgttctttctctcgcaagtccccggtggcccagggtctagggagaagctgcattctgagctactgcccacatcgcttccccagggtggcgggagctctggaatggcaggccccgtccttgacagcctatccatgacctccaggggcagctcacagcagcgccacctgcatcacccacagaatggagggag

SEQ ID NO: 89937 - DNA, 601 bp, Human
tgtgggcctccagggaggtgtaggcgctcctggctcctggcagactcctggcccaggcctggcctgtgtctgcttccggagccatgcgctgcctgtgctgggatgaatgcatggcccctgcatccttaccccctcctcagagcccacaagcttccgagtgcgtcatcttcattattggccacaggaaacgacttcttggagtaagtgactggtgctccgaggcccatctggacaaaagcaggatccggggtggacgcagaagagcaggcccggagccctgcaccccagccttccctccccrtgcgctccacatgcgtcctttgttcagcctctccatttagctctcactttctggatgcagccaggcaccaccttccttccaaaagccttgtttctcagaaaacctttctgcctcctagaaacccaggattccgaggaggaggagggctggccttcctcttgggactattgatcagggctgtcagttcccagctctgtccaatgctctgaactggggacagtccgcatgcagctctgaggacccagatgctgtcactgggtcctggtgagtctgaaaacttgggatgtcggcaccacggtg

SEQ ID NO: 89938 - DNA, 601 bp, Human
tgatcatagctgagctcaaatgctgaccccagtggcctgtctctaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaatctttagatttcatagatatcaaatgggccaamaaaaatgtatcttggaataaacaaaatatgctaatgataacagtaagatatgtaggacatactacgtacaggtgctgttcttagcatttcatatctatcattttacccacacagtgaatctgtgagatggaagctattatcattccattttacagacacctacactgagactcaggcaggccagttgtcctgcccatgtacacacagctcctaagtggtagagtcaggatttgaacccagaccccgcagcctggctccatgctctcaacagctttgcagaaactaaagttggaatggaag

SEQ ID NO: 89939 - DNA, 601 bp, Human
cacaagaatttttttccagcttttatttcagatttggggatacagaaggatgcaaaatgaggcaacctagccacccaactggcccagtggtcaaggggggaaatgaggtggccgctagtcagcgctggagccatttctcgacggtgctttctgtttgtttgtttgtttttgttttgagatggagtctctctctgtcgcccaggctggagtgcagtggcgtgatctcggctcactgcaacctcaacggtgcttttttctgatcatagctgagctcaaatgctgaccccagtggcctgtctcyaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaatctttagatttcatagatatcaaatgggccaacaaaaatgtatcttggaataaacaaaatatgctaatgataacag

SEQ ID NO: 89940 - DNA, 601 bp, Human
tgcaaacttcacaagaatttttttccagcttttatttcagatttggggatacagaaggatgcaaaatgaggcaacctagccacccaactggcccagtggtcaaggggggaaatgaggtggccgctagtcagcgctggagccatttctcgacggtgctttctgtttgtttgtttgtttttgttttgagatggagtctctctctgtcgcccaggctggagtgcagtggcgtgatctcggctcactgcaacctcaacggtgcttttttctgatcatagctgagctcaaatgctgaccccagtgrcctgtctctaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaatctttagatttcatagatatcaaatgggccaacaaaaatgtatcttggaataaacaaaatatgctaa

SEQ ID NO: 89941 - DNA, 601 bp, Human
tccttgcagagttttgtggagatgcatcgtttttagtttttagcaagtggatattatagattggaatgcaaacttcacaagaatttttttccagcttttatttcagatttggggatacagaaggatgcaaaatgaggcaacctagccacccaactggcccagtggtcaaggggggaaatgaggtggccgctagtcagcgctggagccatttctcgacggtgctttctgtttgtttgtttgtttttgttttgagatggagtctctctctgtcgcccaggctggagtgcagtggcgtgatctyggctcactgcaacctcaacggtgcttttttctgatcatagctgagctcaaatgctgaccccagtggcctgtctctaagcactgtggctccaggaaggaaaggcctggagagacctagaccaaggcctcagtagggagggagagaatttactctttgcaaaacgtatggagtccttgttatttaccaaatatcatgttacagaccagggataaaaacaacaataatgaatttcagtgaatctaaaacacaatccattgtaaggcacatcattattctatctcccaagacaggaaaaaaaat

SEQ ID NO: 89942 - DNA, 601 bp, Human; identical to SEQ ID NO: 35318

SEQ ID NO: 89943 - DNA, 601 bp, Human; identical to SEQ ID NO: 35319

SEQ ID NO: 89944 - DNA, 601 bp, Human; identical to SEQ ID NO: 35320

SEQ ID NO: 89945 - DNA, 601 bp, Human; identical to SEQ ID NO: 35321

SEQ ID NO: 89946 - DNA, 601 bp, Human
ctagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccacatgcccatcctcactggccacrtgggctggtcagagtccagcctggatccccccagggcaggacaggacaggtaagaagggctgaaaacctgggaggcctccaggaggtgagggacctgccaccccttcccacaaggccctaaggccccaatcactagtctcgatttccacagctagtttagtccaggccaggaaagggcgtgcaaggggcctggcctggaagaaggggtccctggagccaggtgcaccaggagcctccagcttgcccaaatcaagctgccactatggccgggtcctgtgggcagtgctcactcaccaccgc

SEQ ID NO: 89947 - DNA, 601 bp, Human
ctggccaggcccgggtgagtgagttccccaggtaggtggaaggggcttctggggtaggggccacgcccgggggcaggtggcccaccctcccaatacccagtcccaccccgccctaccacaactgaggactctgcccaaggaccagtcagggacgaggcatcctctccaactgcactgcaaggccagcacaagtgaagggcgggacagaagcctccacacaacaaaggcagaggaccccatacttctctctgagtcagtgcagaggtcctgcggcagagctcctgctggaacccaaactgcrccgtaggctcctcactgagaactagggacttctccacatgcacccagcctcccctccggactccacagctgctagccctgcccggaccctgtgcaccccactcccaccccgtcatagcctctcagccccactgtcatttgggctcccctggcatgaactaacgtgtctctcaggatgtcctacgaggaccctcacggcagaaggaccgatggggaggagtggccccagagagcagttccttctctgtacccaccagggttcagcagaggctcctgctccaggcagtacagtggggcccac

SEQ ID NO: 89948 - DNA, 601 bp, Human
cttccaccagaaccagcccatgctggcaccctgatctcagacttccagcctccagaactgtcaggaaatgtgcttccgttgtttaggacaccttgtctatcgtattttgtcatggcagcttgatcagactaatacaacttctttcttaaaactttggtgtatttttccagattttctacaatgaacatgacctcataaaatcaagagtgtttttcgtttgttctgtttggtcttatgctgacactgggccaggtggaagggtgggtgagtccgtcttgcaggtggcaggagccccctccaygagcccccacaccccagggtccctgcccaacgtgatcggccctgcagggcagtcctggaaccagttcagggcttggggccctggctctgcctagggaggtctcaggcaggccccccaacgtctcagaactgcttccctcagttggaaatggagataataaggcccacctcatggcacccacaaagaatggggcagcctgcacctggcctctccctggaggaccttctcacatcacccccggagggaccaccatccccaccccacagaggagaaagcccagctccaaggccaagttgcagc

SEQ ID NO: 89949 - DNA, 601 bp, Human
tcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttcctgggttgggggcatggctccagcaccccagtgccaagggcacggtctctaagtagcaacatggatagctttacttctgttacagctccatrtctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggcacggtaaggaggtggctacctgcaagccaggaagggaacttccaccagaaccagcccatgctggcaccctgatctcagacttccagcctcca

SEQ ID NO: 89950 - DNA, 601 bp, Human
acacccctccaccttctgcccactgccagggtgcccattccactccacacctcgctggcccacttagcaggcttctgtgtagcttgtttctgtcggttgaggcaccctgggctttgggctccacaggggctggtgacccgcatacaggaggtgctccataaatgttagtcatgtgaatgcactaaatgctcaccactaagggcaagtggcaggctttgtgcagctatagagacagcattccccaggatgtccagccctgggagagagccttggcccacagcccatgaggcaacggatgttyctgggttgggggcatggctccagcaccccagtgccaagggcacggtctctaagtagcaacatggatagctttacttctgttacagctccatatctgcgtctcccccagattcacgtgtcgaagccctaacccccagtgtgatggtatttggaggcggggcctttgggaggtgattacggttagataaggtcacaaggctggggccctcaccatggcattagtggcctggaagagaaagagacctcagagagtacatgccctcctctctctccacccttccatcccctaccacgtgagggc

SEQ ID NO: 89951 - DNA, 601 bp, Human
gccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttgggagacaaatataggttgaacatccaaggggagttccagaagagaaaacaaaaaaactgagaaaagctagcaaagaaacaataccagaaaacttcccaaagctgagtacccagtcctccactgggcattcacagtgcactttcaggcccccaggggtcaagggaagtctgaagctccaggaggagaagctggtcacaaagaggcaacacg

SEQ ID NO: 89952 - DNA, 601 bp, Human
atgcaacactgatggtccccctcccctgctcacccaccatgtgttagacacggggatctgcatgaaagacacgtgttcctccccttccagagacccaccgaaatgagggtgatgcagagtgaggagtggggagcacagtggcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatcyggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctgctatgaacaaggaggcatcagacaaaaagaaagagtgcctggaaattaaaaatagaatcactaaaattaaaaaaaaaatcaatacaagtgttagaaaacaaggtcaaagaaatcttccagaaagaaaaacaaaggagaaagacaaatgaatgagatttggg

SEQ ID NO: 89953 - DNA, 601 bp, Human
cagccaggctgtgctacaaacccacctggagccacttcctcgctgcttctgcccatctcagcctcagcagagaaagaaggcttgaggacaggcctggtgcagcctgactcatctcatgagagacccggcctgtgctcagagtcgagttgctgtggcttctcatgcaacactgatggtccccctcccctgctcacccaccatgtgttagacacggggatctgcatgaaagacacgtgttcctccccttccagagacccaccgaaatgagggtgatgcagagtgaggagtggggagcacagtrgcaggctgctcccctggagaaacacccagagaaaggggttccaccactggtatccaggagcacccagggccgatgggcagaagaaaagctccatctcagcagagcagccaaccagcttccctcataaaagtgaccagaaaaccagtgaccaccaggcatccggaaaacatatcaatgcagaaaaagagggagaatgatgctagaggaagccgacagtgtgggaaaaagacaaaaattaggagaaacatctaatttgtgtcttcctaggcatagatggggatttaaaacaagaacaggctg

SEQ ID NO: 89954 - DNA, 601 bp, Human
tgggctgcctgcgtggagggctccagaaccttgccccatccagcccatacacccctcactggaggtgcaccctcctcggctcccaccccagtgagccccacactgggggcccctggaggctctgcccagtggaggcctcgcccagcccagggcacagccagtgcccccttgccccacaggaggcttgagcccacctgctcctccatgctccaccaggagccaacaaacacctgctgcctaattatctggagaatcctgtctccaccaagggctcatcttggtcctgcagctaattcaatcmagcagccagagcaagctgagtccccagaggacactaatgagcaagtgaccggtggccggcctgctcccaccctggggacgcactctgagccaggtctgggcccagcactgccatacacctgcctcccatgcccatctgcctgcctgaccctgcccgctacctggtgcctagccctgcagggcccacatccactcccatgggctagcatccagacctaagccccagccctcccacactcccccaggaccctggatctgctgcatgcacaaggctgaccactgcctgtgagcccagagtgtc

SEQ ID NO: 89955 - DNA, 601 bp, Human
ggtggcgggcctatgtcatccccacaccacagagggtcagggcacccctcccacgcctgctccccactcctggccctccaccactgactcactccccccgccccccacccatctgtcccccgatcctcgcttgcttctcacatgtacacccacccgccatccatcctcaggcccacagacacgtgcaggggcagccagaattcccatggtgtttcctgtgcccttccagggctccaggtgctgcggcaggagattggcagcagcttctggtgggggcagtctgcccttgaggggtcctgartctcctagggaagtgagtaccagcccctgatgccctggccctggcccctgctccttgttgatcttggctgcaggggcagggtaggcagaccaggtcaataacaggcaaggacacctgccatggtgagaggtcactggacccagactgaagcagctccaggcctagctagctacatgctgtgggggaaactgaggcccagtgtgggcagagccttcaggactggcctcctgagtgtgcctagtgcttcctcagccccctcggctccactctttgccctggccggcagggctcgtccctgcc

SEQ ID NO: 89956 - DNA, 601 bp, Human
cacagtgctgcccggaggggccacgaggcatgtcctgcccaagcaggaaggctggcggcctggctagtaatgggggagggtgtggaggggctgggctgcaggccacgtgcagaggggcaggcagcgccctcctgtgtcatgggtggccgggaggggaatctccagggaggctctgagctgctgcttcccagggctggggtaagaggctgcagagggctggggctgggggtgggaccagctgtagcacagccgggacatcagtcagctcaggatcctctcggacaccagccatgtccccgtsaggcggtcacgtcacagaccacagttatgaggcagaacaggaggccacagctcagtgcaccaaggccagaaatagctccaggcgggggtggcgggcctatgtcatccccacaccacagagggtcagggcacccctcccacgcctgctccccactcctggccctccaccactgactcactccccccgccccccacccatctgtcccccgatcctcgcttgcttctcacatgtacacccacccgccatccatcctcaggcccacagacacgtgcaggggcagccagaattcccatggtgttt

SEQ ID NO: 89957 - DNA, 601 bp, Human
cccgtggcccctgacctgtcccctgggctctgcagcctcaaggccacaaggcctctctggccctctcgcccacctttctctctcctctatctgcctggccaactctaataggatgctctactgtccttctggagatagcctggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccayggatagcgtgcctgtccaccgtccccacccaggttggccctgcggccacctgagcctgcgagggccccagagggctctcctcagcctccaagctgcacacaaactggtacatctgtgcctctcccaccctcccaggccaattaacatctcttctttcctccagggtctcctcctgggacctccccggaggatggccctgctggctgtcagggctgggtcatagctaggagctcctgtctcagcccaggcctggctcaggagccacagtcaggggagggctggctctcctgcctggaaggc

SEQ ID NO: 89958 - DNA, 601 bp, Human
gtttgtcttcacagccggggccctgggatgagggagacgcagccaggtggggggagggtgtcctctgaccccatcccaggggccagactggtgactcaccagcctcctccctggccccatggtggactgcagcccctccccaccccaaaagacctccctggcccgtggcccctgacctgtcccctgggctctgcagcctcaaggccacaaggcctctctggccctctcgcccacctttctctctcctctatctgcctggccaactctaataggatgctctactgtccttctggagatagcmtggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccacggatagcgtgcctgtccaccgtccccacccaggttggccctgcggccacctgagcctgcgagggccccagagggctctcctcagcctccaagctgcacacaaactggtacatctgtgcctctcccaccctcccaggcca

SEQ ID NO: 89959 - DNA, 601 bp, Human
tttttatgagataatcaaacccaactttgcagcatgggtttgtcttcacagccggggccctgggatgagggagacgcagccaggtggggggagggtgtcctctgaccccatcccaggggccagactggtgactcaccagcctcctccctggccccatggtggactgcagcccctccccaccccaaaagacctccctggcccgtggcccctgacctgtcccctgggctctgcagcctcaaggccacaaggcctctctggccctctcgcccacctttctctctcctctatctgcctggccaaytctaataggatgctctactgtccttctggagatagcctggcctccctgcctgccatcaccccactttccactctcacccagtctcaccctggccccagttctcacggagcctccagtatgagctctgtccttcctgccccttgcacacggggtgagcaaccagccctgccatggccccagctctcacagagaaaccacggatagcgtgcctgtccaccgtccccacccaggttggccctgcggccacctgagcctgcgagggccccagagggctctcctcagcctccaagctgcacacaa

SEQ ID NO: 89960 - DNA, 601 bp, Human
tggggattgtcccataatttggtccatagttcatgtagcccacacctatacattgtcaccacccatcatagtaattacgggaacaggctgcccatcaaatgtagcctccttgtaattgctggccagcaatctgggtatcagccccttgagaagagctcctaacccttaaccagcgtagaacgggaattttctcaccataagcttcccttttctaatactcttcccagatccgcccaggtgatcttgaatttctggactgcacttgctattcagtaatcaaggaagcccaaatatggttccrgttaggggtttacttgaatcttcagcacccagccccgacatacacacgtcctgagactgctctttgcaacaattcagtccctggtgtcctgcctgggtaaaaccatttccttcaatttacctgggagattcactgatactaaagcagaaagatgaaagcacaaacacctgtggtgattgctgcttctctcttcctttttaacaaaatgtttgggtcaaggttttcttttgtgttgtggagatggcatttccctggaactgcaatggaatcctctgctgttggtgcgcttggacttacgtg

SEQ ID NO: 89961 - DNA, 601 bp, Human
ggtagtgcatgcctgtagtcccagctacttgggaagctgaggcaggaggattgattgagccccagggctttgaggctgtagtcagctatgattgtaccattgcactccagcctgagcaatgaaacaacaccctgtctcaaaaaaaacaaaaacaaaacaaaccaacaaacaaaaacaccaaaaaaacgaaaaacaaaaaaattaagatcctaccatttctattttgagatatcccttgcgctgatgctagcagctggcttaatctgtaaaaattgatagaaaagtgaaatagggcaacgtrtggcattgaaaagggcattttgcagaggattctcgtctcctgggtgccttgaggacccacggagcctcctctgccccatccactcacagattctttaggtatggtgttccccggacttaccctcagccatgagcattcactcggcactaggaataaaagaaagaggtttgagtaattaaacgtaaagggtgccagctcagatgaggagggcaggctgagtctgtgaagacattgacaacagcaaagcattcaccaggaacagaatcaggctcagggagaaactgagctggctctgggaaa

SEQ ID NO: 89962 - DNA, 601 bp, Human
tgggtgggacttctcagcaaaacgacagggagaagcagtggcctcggaagaccctgtgtttttataattggcacagttttaaggggtatatgctgactctctgattaactcagagagggtaggaggaaaagagagaacagtagatctggtagaagttctagaacttccaccaaaccctaagccaagagacaggagagaaaaaatcatgccaggtggaagagccctgcctggaaggtgcgaaatggcttcagttctgattcaattccatttctcctttggggacgtgcatttccttcttatyaaggggttggactgaatgacctcaatgcctctcaacctctaaagaacgaattgaaatgaagccctgagcccacctgatgggtctggggtgtctctaggcgaggggcctcccctcccagcttgccgccttccaggaggctgcagctttgctggttgaagcatgttgccgccatctactgttggtcccacccaagcgccgctggggccgggccacacctaggttttcttcccaaacccctagttattatcttggcaacctctcccttgaagacattctggctgccagaacactcgtttgtca

SEQ ID NO: 89963 - DNA, 601 bp, Human
gatgctgtgagaaagctttctccaaagtttacagttatccagaaagagatcagaatctcactgtcagaaaaacactggccagcaaaaagacagggagtgtctagcagtaatctcaggactgtgttatgacttgactgagattttgagatctaaggtgaaggcctctggtgaatcttctgataacctggtagttctgctgtgaagacaaccatgctagaaagaggaagaattagtctagtcaggtaatctcaccggcagaattaaaagtcatggtggtcgttgcaaagagcacactcggacrtattgtcagaaaaatctttctaatcggggaagggatcctggtaggtagtgagctctccatgactggaggaggttaagcatgattcagatagttctttggtcagatttgtagatgactttcttgaattgaaaaggaattttaaagacctccctcttcagtcctgagattctataattcaaagaagtagagagaaagattaaatctgcagacaaactagtgtttagaaatttaaggcattttctttgcattcacttatttcctcttgaacaaaaggcaacacacacatatatacccttgtat

SEQ ID NO: 89964 - DNA, 601 bp, Human
tgagggagaagtctactattgttttagtgaaacacactgctaagaaataagtagtagccaccaatacttccaatggtataaattctcataaatggtatttttttcagtgcctttgtatgaagcaagattcacaatggggcagagaatgaatctccccacaagctaccttgcaagtaatgggtgggtggaagtttcaggagcaggggttcttctgtttattatactctgctatttgataaatgcccagacatttacccattagttaccgctaatggctttttcataaagacctcagtgatcrcctcctcccagactgagggtttccctgggggcaggaggtatctagcacagtgtaaagactgggtaactagggatgattcagcccagaaactcaagaagataactcattctgttttcacctgtgttggggggaaggccattgaaaataatggaagcccctctaaactgacagtgaatgatattagtaaaacctgacaaataatgggccagtgaaaagatggagaagttgtagcttaagctaaacagcccctccttctggctggatacagcagctaaaaacagagagaactgtgtgttttgc

SEQ ID NO: 89965 - DNA, 601 bp, Human
gcttgattctcacatccattcttccagcctgcaatgggcagggcatatggtcaggtggatccaggggccaggcactcgcacacaccaccagggctgtgatgcatgggcccaggtagaggtgccgtgggaggggtcattgagacagagagtgtgagctgggcagaggaaatcagacttgactttaggggttacagagcaacccaaggagacaaaatgctgctgaattcccaacagcctatcagggagggaatgttttctgtgactcatttaagtggcctcacttggtggattatattctgtyattggcccctccagcccttcccccttttaagaagaggatgtttgtaaattagaagcaacaggaacaagaaagtcatttgaagagcccgaggaggattaaacataagtattcgttatgtaatatttgtaattccctgcaatcagcctgttcctttccccatagggggcaaggagatcaggatctggtgaggtgtgaatcttgggaggtatgaggaagttgggctgagaaagtgaactttctcctggtctttcctgagggtgtgctcttagaggtctccccccttaaggggcaagggttaga

SEQ ID NO: 89966 - DNA, 601 bp, Human
gagagtgtgagctgggcagaggaaatcagacttgactttaggggttacagagcaacccaaggagacaaaatgctgctgaattcccaacagcctatcagggagggaatgttttctgtgactcatttaagtggcctcacttggtggattatattctgtcattggcccctccagcccttcccccttttaagaagaggatgtttgtaaattagaagcaacaggaacaagaaagtcatttgaagagcccgaggaggattaaacataagtattcgttatgtaatatttgtaattccctgcaatcagyctgttcctttccccatagggggcaaggagatcaggatctggtgaggtgtgaatcttgggaggtatgaggaagttgggctgagaaagtgaactttctcctggtctttcctgagggtgtgctcttagaggtctccccccttaaggggcaagggttagacaaatgacaatttctaagaggaccgaaaggattgtatacaccctgcctcgtgaactagacagcagatatcttattacttgcacttaacatggggcagcctagcgattgagtaactgggttgggttggcaacagctacccggctt

SEQ ID NO: 89967 - DNA, 601 bp, Human
agctaaatagaatgtctttattaaaatctgatcccgatgcaagctgatttgttattttatttttaaatcagagggccagctttcaattaacattttctttccttctggtttcaggtctggttggtttccaatacggtagatgcatcagtaggtctttggaaaaactgtaccaacattagctgcagtgacagcctgtcatatgccagtgaaggtatatataaagatattgacccagtgctgacaataggtgtggtcagggaatgttcagcccctggagtgacctcatgcccttgttctcctygtcctgtgtctacagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctgtgagtatctcatgggtagactccagtttacacttttaagtccatcttaccatgggtgtttctggcaacttgaacagattagcacatggttcagtgaaacttccttgtgcaattttctcctctggttatttgttctcttgtgga

SEQ ID NO: 89968 - DNA, 601 bp, Human
caggagaatcgcttgaaccaaggaggcagagattgcagtgagccaagatcgcggcactgcacttcagcctgagcgacagagcgagactccgtctcaaaaaaaaaaaaaaaagcaagctaagaaatagtatttcacagattacacacaccgatggtattccaaaacctatattcttatcaaaaatacttccagcagaagatcagatattattttttctcatcagtatccgaatggaactaagaaaatggtaaggatggcaacctaaactgtgaggcccgttagattaggaaacacattgttytactcaccatcagtaccagaggctgacatataggaggtattccatacatatttgctaaaagaatgaataataaatccctgccccatctttaattaacctacctttattaaattacagtatctctgaatctgagtttccccacttacaaataaactggtgaggctcaaacgaccaagatccctttcacttttaagaatgtgtgaatctgggccaggcgtggtggctcacacctgtaatcccagcactttgggaggccgagatgggcagatcacctgaggtcgggagttcgagaccagcctg

SEQ ID NO: 89969 - DNA, 601 bp, Human
gcactaaacattatttttccagtatgcgcaaaatatttaaacaaaaaatatacgttctcataaaatattttccattaatatatcccttcccagaatctcctttgatatttaaaacagtcctttctgacagccaaagcatatataaggacacagtagttcagtacagcaaatggaaaaacttccaattaaagcaaagaaaaaaatctcttaaaaattgaatcatggccgggcgcggtggctcacgcctgtaatcccaacagtttgggaggccgaggcgggcggatcacgagatcaggagatmgagaccatcctggctaacacggtgaaaccccatctctactaaaaatacaaaaaattaatcgggcgtggtggcgggcgcctataggctgaggcaggagaatggcgtgaacccgggaggcggagcttgtagtgagctgagatcacgccgctgcactccagcctgggcgacagagcaagactccgtctcaaaaaaaaaaaaaaaaattgaaccacaggaaatcactattagcccttctgataataacaagctaaaaccttaaaatttaataaccagacaaattattgtttagccaaatgagca

SEQ ID NO: 89970 - DNA, 601 bp, Human
tcctttagaaataaatttaggccaggcgcggtggttcacgcctgtaatcccagcactttgggaggccgaggcggctggatcaccaggtcaggagatggagaccaacctggctaacatggtgaaaccccgtctccactaaaatacaaaaaaaattagccgggcgtgttggcggggcctgcagtcccagctactcgggaggctgaggcaggagaatggcgtgaacccggggggcggagcttgcagtgagccgagattacgccactgcactccagcctgggcgactgagcaagactccgtctcaaaaaaaaaaaaaagaaaaaaaatttagtgtcattccgttttatatcaaacaaaacagaaatttccataagtaaaagtattttatggagcttttattccagttgcagaagaatcaaaaaaaattccaaaaccactggcctaaaactatcaactgccaaaaacagtgcccaggacatagcgacacttaaaatgttttaccagtctttccagagtataatgtttcttttaattcggccatcttaataatagcaaccatttattcaatgtctactattgactgtgcgttctactacccctttac

SEQ ID NO: 89971 - DNA, 601 bp, Human
cactgaagtgaggcttactttatagaagataaacacccttatccgaagtgaaaacatgcaatgcagaaactcagtatagcattcagccatcctgcagaaagaaatccaccaactgaataattgttgtaaacaaataatgcaatttctcaattagatgtcttgataaaattattttgcccatacttaactctttaataagtatcacaatcatttgaactgtctgttctgtagcttatttataataatcatcacctaaaatagttatggctgcaatcctttagaaataaatttaggccaggcrcggtggttcacgcctgtaatcccagcactttgggaggccgaggcggctggatcaccaggtcaggagatggagaccaacctggctaacatggtgaaaccccgtctccactaaaatacaaaaaaaattagccgggcgtgttggcggggcctgcagtcccagctactcgggaggctgaggcaggagaatggcgtgaacccggggggcggagcttgcagtgagccgagattacgccactgcactccagcctgggcgactgagcaagactccgtctcaaaaaaaaaaaaaagaaaaaaaatttag

SEQ ID NO: 89972 - DNA, 601 bp, Human
tttctagcctcacacccgaacagcttgaacctttagtgagaatactcactgccgcaaacacgaacagcttgagaaacaaaagcatatgttaataataccaaataaccttgtttccttgcatttatgtactgacaaattgtattttaaaataaataattttaagagcaaacagcctgttcttagattgcctagtctgtatatttgactaaatttcaaagttactcatataaaacagtgttttattcactgaagtgaggcttactttatagaagataaacacccttatccgaagtgaaaacaygcaatgcagaaactcagtatagcattcagccatcctgcagaaagaaatccaccaactgaataattgttgtaaacaaataatgcaatttctcaattagatgtcttgataaaattattttgcccatacttaactctttaataagtatcacaatcatttgaactgtctgttctgtagcttatttataataatcatcacctaaaatagttatggctgcaatcctttagaaataaatttaggccaggcgcggtggttcacgcctgtaatcccagcactttgggaggccgaggcggctggatcacc

SEQ ID NO: 89973 - DNA, 601 bp, Human
ctgggtatggtcgcacacacctgtggtcgcagctactagggaggctgagatgggaggatcacttgagcccaggaggtcaaggctgcagtgagccaagattgtgccattgcactccagcctgggtgacagagtgagactctgtctcaaaaaaaaaaaaaaaaaaaaaaagaaagaaagaaaaaggaaaactactacgccaggtaacctgaacacaagcgtctgatggcatcacttaaataactctgagaccacaccagtggactgagtcaagatttccaaacagctagtagaaaaacagatrggttcgtgagactgctaacacagatccagcagaacaagaattaattacataggactgaataaactgatgaaggatgattatgggtttcgtttaaaatattgctgatgccttagcgtcctattttctggatataaggaacccctttctcttttctctgaagctatctataactcacaacaatttaaggagactatgtttttgtaaaccgaaataaacacttatctttttctcccccgtcttactcctccagaattcaaaaactcttattatttttattttcatggcaatatagttatctgc

SEQ ID NO: 89974 - DNA, 601 bp, Human
cactggaacccagaaggcagaggttgtggtgggccaagatcgcgccactgaactccagcctgggcaacacagcgagactctgtctcaaaaaataataataaaataaagttaatcattacgcttatagatatgcttttgtctaacacttttttgggttgattttagttcgcatgccacaaaaatcaaacttccttgccaatttcattatcttttctaacaaagtttcataagatctttcactttttttctttttttttattattatactttaagttctagggtacatgtgcacaacgtgcargtttgttacatatgtatacatgtgccatgttggtgtgctgcacccattaactggtcatttacattaggtgtatctcctaatgctacccctcccccctccccccaccccacaacaggacctggtgtgtgatgttccccttcctgtgtccaagtgttctcactgtttaatttccacctatgagtgagacatgcggtgtttggtttttcgtccttgcaataggagatctttcacttttaagattatcagtaataggttaatcatcaccgttttaagtattttgtcatctacagatagttttct

SEQ ID NO: 89975 - DNA, 601 bp, Human
agaaaatatgaaactccctcagccacctcaaggacagtgttacagcaactaatcgaaaagaaaaaccacaacacagtgttacagcaattaatcgaaaagaaaaaccacaggcccttcctcttccccctcattcaatttaagcagtcttcattttccacagcagcaaattttctagatatgtcttgtagacctcaaagtactggaaaggaagctcccattcaaaggaaatttatcttaagatgctgtaaaactaattttttgtccatttgaaatatataagttgtgctataacagaaggaaggaaggaaggaaggaaggaaggaaggaaggaaggaaggaaggaaataaattaattaaagttcacctggtcaacaagcaattctatgcagctaattcccaaaacatcatctctagttctgtccctctaactttttgttggccatctctacctcccgttaaattaaattcatcacctttcccccaaaacaacaaaatccctcaccagtcaatggtacacaattctaaccttactggcatgccttggagccatctttgagcccctccccttttcccctagtctgacaattactgtcttgttgac

SEQ ID NO: 89976 - DNA, 601 bp, Human
aaaaaaagaaaaatatgtaagtgaaaaggaagaaaacgtattggttcttataaactgcgtttcaaatcggtattagtgagcaaagactgtcgaaaataagaaaagaataaataaatcattaggagaccatctaaacttcacacacaaaatattatttttgcagcatttaaaaaataagacataggaaatggggggaactatttccaccacgatagtcttttcttgttaaaataactcagataaaattttaaagcctggctataccaagaattggcaataatatggagctactggaacactsatactctactggggtgaatgtaaaatggtacagccacttgggaaaacagtttggcagtttcctaaaaggttaaacatacaacctactatacaatccaaggcaatagctagatactgtttattccacatctaggtatttactcaagagaaacaaaaacatatgtcaatacaaagacttgtatgcaaatgctcataccaatttatttgtaataacccaaactggaatcaacccaaatgtcatcaacagactaatggataaaaaactgtgatactgccatacaacagaaaataatgaaccctt

SEQ ID NO: 89977 - DNA, 601 bp, Human
ggcctgatatcaagataaagaagcacatataaacctttcttccattctccccaagttctcatttattacataaaaagaattcactcctttctataagtgaaatgagttttaaagcattctaatacaactgaaagctaaagaaaacaaagtattaaaatagtacaggttatttatctttggattttaaccaaatattagtcattttaggttcatgttcagatagttatctatacttagccatgacagactagccatgacaatttattcaataaagaaatatcacaaaatggtgtatactaayagtagaaatgagacatagtaacagagaagcaatgtgaggatacagttcacactctgaaatgagatttactcagagctttaagttttccttctcattagaaaataaacctttattgcaaatatatgtttagctaactagaaatgagttatttaataatttttatttttcattcaatactgacattaaataacgcttcagagtgtaacaaaaaaacactagtatcacagtatcattgtgtatataataaaaggtataagatctagattagtctatctcatcttgggctatcaaatacttctc

SEQ ID NO: 89978 - DNA, 601 bp, Human
aatatctataaagttctcaacaaccaaattctttgataactacagttacatctgagacctcctcctcaggacatccaatcgtttttcctacgatcagagccactacaatatttcctggtgctttaagagcaccatcttgcttcaacaaacacgttttaatttcactctaaaaaatacatatttgtatttccagacatctccctctaaaatttccctatactactgcccacataatcctttacagtcaaatcagtcttctcatttttctacaacatggcatcctgttcaacctctgtaacccggcctgatatcaagataaagaagcacatataaacctttcttccattctccccaagttctcatttattacataaaaagaattcactcctttctataagtgaaatgagttttaaagcattctaatacaactgaaagctaaagaaaacaaagtattaaaatagtacaggttatttatctttggattttaaccaaatattagtcattttaggttcatgttcagatagttatctatacttagccatgacagactagccatgacaatttattcaataaagaaatatcacaaaatggtgtatactaa

SEQ ID NO: 89979 - DNA, 601 bp, Human
gttctaggattcaagggatagaaaacagaccttcccaatttaacagaacatccttcaaaactgtaagttgtttacaccaagatccttcatacacagggacagtgctttaaagcaagatccagtctaaagctttagattttaaataattggctatctgcttctatgcaaaagccaactggaaacggatatgatctcagaaaaagaacaaagaaaataatgcacttttaaactgttccatttttaaagagctgatggaggaaggaaaggcacggtccaagtggtaggacaatggaaacagtayaaaactcaataagcttaagtgaaaatttctaaaagaaatatagtatcaatatcaattgttacaaaaataaaaacagtcatattttattcctagttcacaaattagctgacaaacccctccttccaaaatcttaaagattcattgtaatttctgaagagtcatcaactctggaatacatcgaaggtagacaaaatccccaagtgcaggcagcctatactcataaaggtaccctattctttttcttttttttttttcatctccagccatacagaggaaggtatccttttctttataatcacc

SEQ ID NO: 89980 - DNA, 601 bp, Human
tgagccgagatcgcgccattgcactccagcctgggcaacaaggacaaaactccggctcaaaaaaaaaaagaaaaagaaaaaagaaaatccagtagcaaagagcatacctagtttccacatcttcatttctaaataccattctctaataaaaggagccagaactccttggagaaatagttgattcaaggagtggaacagaaaaaggacacaatgagtctggactgcctggagtcgccagaaagtaaataagtacttaaaaaacaatgagggcggctggacgcggtggctcacgcctgtaatyccagcactttgggaggccgaggcgggcggatcaccaggtcaggagatcgagaccatccgggctaacaggtgtgaaaccccgtctctactgaaaaatgcaaagaattagccaggcgtggtggcgggtgcctgtagtcccagtcactcgggaggctgaggcaggagaatggcgtgaacccaggaggcggagcttgcagtgagccaagatggcgccactgcactccagcctgggcgacagagcaaaactccgtctcaaaataaataaataaataaataaacaaacaaacaatgagggcatgta

SEQ ID NO: 89981 - DNA, 601 bp, Human
tgcactctgggcgacagagagagactacgtctcaaaaaaaaaaagaatatacacattcacattctgagaacggagatataataaaagaaaaaaaaagaatatacacacgtatcaactcatttgtacataaacaaattcacaagaaaaaagcagaaattattaagactaagatacctatagagaagggtggggaaagactggaaaaaagggggtaggagatgggactaggatagaagggatggggaagaagaacattttcctgagtataaatttttgtattattttttactgttaggaacawgtcaattgtttcacataacaccaaagtaaattcgtttctcacaatggtggtataggctaatgattttaaaactcccttaatgtgtacactaagatgggcaaataagaaaatctatcatgataatgagagccaggtttctcactatcacagaatagaagtaaatatcccaagtaagaaaagggagaagactacaatgataattttgtggtagtagactggaattggcgataacatgaatttgtttttacgtatagcaaagacacagaactaggggtatgtgtgtctacatacatcatatat

SEQ ID NO: 89982 - DNA, 601 bp, Human
cttgaacccaggatgcagaggttgcaatgagccaagatggtgccactgcactctgggcgacagagagagactacgtctcaaaaaaaaaaagaatatacacattcacattctgagaacggagatataataaaagaaaaaaaaagaatatacacacgtatcaactcatttgtacataaacaaattcacaagaaaaaagcagaaattattaagactaagatacctatagagaagggtggggaaagactggaaaaaagggggtaggagatgggactaggatagaagggatggggaagaagaacaytttcctgagtataaatttttgtattattttttactgttaggaacatgtcaattgtttcacataacaccaaagtaaattcgtttctcacaatggtggtataggctaatgattttaaaactcccttaatgtgtacactaagatgggcaaataagaaaatctatcatgataatgagagccaggtttctcactatcacagaatagaagtaaatatcccaagtaagaaaagggagaagactacaatgataattttgtggtagtagactggaattggcgataacatgaatttgtttttacgtatag

SEQ ID NO: 89983 - DNA, 601 bp, Human
gaaaataaaaaatctgggatattctataggacagctgacccagtcttttcaattaagtcaacaaggtgagagataaaaagggaaagggggaggaccaactgaactgctctagaaaaaccacatgcaacttgtaaaccaaatgtttggactctgatttcaaacaaccaactataaagcaacatttctgagacacagatatctgagtatgaacagactaatttataacattaaagaattgttcatcgcaagttgtgtgaaagacagtggcattatgattctagaaaaaatattttttagagayggaaaataaagtatttacaagtgagatatcgatgtgtgaatctgctttaaaatatctcagctaattaaaaaaaaaaccagcctaaaagcctacacatagagagtagttgaataaactatggtacactcacacaatggtatactatgcactggcaaaaaacaatgaggaagatctctatgaaatgatatggaatgacattcaaaatgttaagttttggccgggcacggtggctcatgcctgtaattccggcactttgggaggccgaggcaggcggatcacaaggtcaggagtttgagacca

SEQ ID NO: 89984 - DNA, 601 bp, Human
caaataaagatagtaactttcaggcactagagtcaaaaaccaaatattataacaaaagatgcacctaacatcccaactgctcagaaaatctgaccatctgaacctactgaataatcttagcaacactacaatataggacaacttctgatgtgacaaatacaaagtactcagtactacctatgaggcattcatgtcaaaatgttaaatctgtctctaatcaagtcttcaaatctttctttccaagtaacacagggggataaaaataagtcaaataccacaataatttgttagaaaaaaaaaytgtctgggcgcggtggctcatgcttgtaatcccagcactttgggaagccaaggtgggtggatcacaaggtcaggagatcgagaccatcctggctaatgcgctgaaaccccgcctctactaaaaatacaaaaaaattagccgggcatggtggtgggtgcttatagtcccagctactcaagaggctgagacaggagaatggcgtgaacccgggaggcggaggttgcagtgagccaagatcatgccactgcactccagcctgggcaacagagtcagactccatctcaaaaaaataaatgaatg

SEQ ID NO: 89985 - DNA, 601 bp, Human
ggcagaagagtgtcgagaacccaggaggcagagcctgcagtgagccgagatcgtaccactgcactccagcctgggcgacagagtgagacgctgtctcaaaaaaaaaaaaaaaaatttaagtggtcactggaaacacttccagtgaacttggcaaaagcaacccaaaatctctctggaggaatatgcccccaagtcattcagaattctcaaggacagcctctctgaagatctgttcacagtccaaaactatataaaacactcgaggaaacatttaaccttaagcaagaatccagcaggtgcaaaaaaaaaaaaaaacagaagtagatttttaagaacttcagaaaactgaacaacttgatagagattataaatatttaaatgatgaaaacacataaaagatggaataaaatatatgacacaagaaaagacatcatcaaacaataacatatctctaataagaaaatacaagaagcaatcctcagtgcatgctaaaataatcaatagatgagtggttaataaggaactaggtatttggcaaaatacaaaaggatcatcccacaaataacttaaggacacaagaggaaagggctcaacttacaaa

SEQ ID NO: 89986 - DNA, 601 bp, Human
attcatccaaaaatcatgaaaaccaggaccaggctgttatatgctgttcattagcgtccacacaaatgtaattttattgctgtgtctggtctcatattcatttgtaatgctttctggaaaataatttttaaatggagtgaaaggtagaagatgagcttcattttaactgggagggaagtaaagcaagtaaacatatattaagttttcaagatgtcacaatttcttatgccaggaaaataaaaatatctcaaactgataataagactagacacacaagccattttatacaaatttactttayacatttttattacaatccaaagcatttaatttatttgattaggtaaggataaaacaacaaatcttccaaaatattcacaagccctaatttggtaagtatactcaatctgaattcggcttcccataatgaaaatgttcagtttcaataaatctagactaaagggatgaaatttcaccctttacaagatgtaattacatacacaggtgactaattaagacattgagacttgagctataaaaactaagtgacccagatctatactagatcataaatcatgtcatgatccttgaagttacttat

SEQ ID NO: 89987 - DNA, 601 bp, Human
ggatctgctttatgagactgtgcccttctctagtgcaggggtcctcaagccccaggctgtggaccagtagcagtcagtggcctgctaggaactggccgcacagcaggtgagcagcaggcaagcgagcattactgcctgagctctgcctcctgtcacatcagtggcagcattagtctcaggagtgcgaaccttattgtgaacagcgcatgcaacagatctaggttgcacacctccatttgtgcatctaatgcctgatctgaggtggcacagtttcatccagaaaccatcccacccaccccgmtactgcccagtgcctgtggaaaaactgtcttccacagaaccagtccctggtgccaaaaagtttagggaccactgctctagggaaagcagaaaatggcaataggccccagcgagctaggaaagaggcattcattgcattcaaggatgcagcactgaagctaacccaagaggagtggtagctactgaggcctgctcagaggacatggtacagggatgtgatgcaggaaaagtcctgagggaaaaaaacattctcaagatctgctaggatatgacacaaacattttctattatgaggaaaatg

SEQ ID NO: 89988 - DNA, 601 bp, Human
taatcgcttgaacccgggaggcggaggttgcggtgagcccagatcacaccactgcacaacagcctaggtgacacagcgaggctccatctcaaaaaaaaaagaaagagaacctaacaggaagagataaatgctatgcctaaaaggtaacaagtagatgtcttcagtttatgcagtgacccagcagcagaatgagtctttagtctcaggatctgctttatgagactgtgcccttctctagtgcaggggtcctcaagccccaggctgtggaccagtagcagtcagtggcctgctaggaactggscgcacagcaggtgagcagcaggcaagcgagcattactgcctgagctctgcctcctgtcacatcagtggcagcattagtctcaggagtgcgaaccttattgtgaacagcgcatgcaacagatctaggttgcacacctccatttgtgcatctaatgcctgatctgaggtggcacagtttcatccagaaaccatcccacccaccccgctactgcccagtgcctgtggaaaaactgtcttccacagaaccagtccctggtgccaaaaagtttagggaccactgctctagggaaagcagaaaatg

SEQ ID NO: 89989 - DNA, 601 bp, Human
agggaactagactaagaccaaggatataaataaggtaagaacatacctattccctggatgcctgcctgaatccaaattaaaaccttctgaatggccaggggcggtggctcacacctgtaatcccagcactttaggaggcccaggcaggcggatcacctgaggtcgggagttctagaccagcctgaccaacatggttaaaccccatctctactaaaaatacaaaaattagccggttgtggtggcaggcacctgtaatcccagctacttgggaggctgaggcaggcgaatcgcttgaacccastgggtggaggatgggaggatgcagtgagccaaaatcacgccactgcactccagcctgggcgacaaagcgagactccacctggccggggtggacgcagtggggaagaagcttggaaatcgttactctatcctaatagtgagtaaaaagctaaacaacaacaacaacaaagatcaacaactcttcttagatccaccagagaagtaaggtcacagggcaaaccactgcccccacaattggatagacagacaaggtgataacaaaggatcataatttatcaaagcagaaatccacagacaaaaa

SEQ ID NO: 89990 - DNA, 601 bp, Human
tcttctacatatataacatcttacaaacaattttaccaccattcttcaaacaaacatacatacttccacagtcatcttcaattctactaaacagtacagtctacatgcttgcaggcttatctccatgcacataccacctttttttttttcccacaatctctaggagactcatttcagaaaacttcactttcaagattactaacagttgtctgctcatgattaggcttcaaaagaaaaatgttaaatttatttatatagaaaacagatttcatatccttattttacaaccgagttctctaayacttatgtgtctatcaaaaataaattaatgaaagcttgaaaacagttatgaattcattatactgctttcacatccacttcaaacttcctatatataaactgatataacatgggttcacttacccagctcagtctcactataaggatttttaaacaaaatcagtccagtccactgaacagtatcagcttactgcaggtacattgtctttcataataaataacagtatcagtaatgcaataccaacacacagggaactagactaagaccaaggatataaataaggtaagaacatacctattc

SEQ ID NO: 89991 - DNA, 601 bp, Human
agatgcatgtgatggtcatttatctgagcctcccagaatgactgggaaatgaacatcctacaagtcttgccacaaaccaagtgtttaacagaaaattaggcacaagtattagctacactgaaaccttgttgctgtgtttccccttgggaatgatggctaaggtagaaccataccgcacatatttaaacaataatttacataaaattacaaatactgtaaaatacaaccactactcttatgatgaaggaatctgcacttgtttatatcaatacaatctttcatcttgagggtcattcaacartatgactggtaatacataggtatgggcctaacaccctcccccagtctgtgagatctgacaaatcctacagtattttttaaatcaaatgctaaaaatattaattatacttttctactactcctatcttaatttttaatgggtataaattccaaggctgagattatttttcattgttttaaggttaatcaactaaccttatttaaagtgtacactgtatatagtaagctaaacatggactaaacgctgatgtctccaattctaatcctttaccacatggatcactctagcctccttctcctt

SEQ ID NO: 89992 - DNA, 601 bp, Human
cagaacaggaaatcagtatttgcaaatcgtatgtccgacaaaggtctggtttccagaatatataaagagctcttagaactcaataataaaaggacttaccaggcatagtggttcatacctatagtcccagcgactggggaggccaaagtgggaggaccacttgagtccaggagttcaagaccagcctgggcaacataacgagaacccccatctttaccaaaaaaatttaaaaatttgcctggtgtggtgtcacccacctatggtcccagctactcaggaggctaaaatgggagaatcgctygagcccagggagttgaggctgcaatgagccatgatcatgccactacattccaggctggggaacagaccaagaccctctctcaataataataataataataataataataataataataataatactatacaattttaaaataggtatttcacaaatcaagatttacaagtggtcaaagcacagaacatgttcaacatcagtcagtaaggaaatgtaaatcaaaacctcaataagacatgcctatacacccactaggatggttataactttttaaaaaaggagagagggccaggcacagag

SEQ ID NO: 89993 - DNA, 601 bp, Human
taataatatagccaattatactttttattcagctgaaaaatatgagggcctgaaaacaatgtaaatagtatttgagaagagaagacaaatccaagagctacttagaaggcagaataaacaagaattggtaactgattaaatgtgaggagtgaggaggtgggggcctagaatgactcaggatttttagtttctgcaaccgttaggtagaatgacagttgttcacaaattctgatattttgttatagggttttcttggatgtggtcttctctctgtacttaaaatttaaaaaaaaaaaaaaaaaaaagaaaagctttgttaaaggttgttttctcaagccccaataaaactaacggataatccaaacagcctctttccagacttcccatcccctacccttaaggccattttccagaatactctgaaattaatgattatattaccaccacatcccctcccacacaccctccccctccctccccctgcccctgcaatctgggattatgtaatttccttactttcagcatgaatcccaaacttcttagcatgacatataagagcctttctaatttgtttctctgcttttggttcctcatttctcac

SEQ ID NO: 89994 - DNA, 601 bp, Human
tcatattttaaaaacaagtagaaattaataaaagaggatagtgaaagcattcatgttagcaggttggtttctgtggttgtttttacagagaatatacagtaaccagataaaagagtctgggctgggtgcagtggttcacacctgtaatcccggcactttgggaggccaagatgggcggctaatgatgtcagcagtttgagaccagcccggccaacatggtgaaaccccaaaccccaacttgactaaaaatacaaaaattagttaggcgtggtggtgggcacctgtaatcacagctactcargaggctgaggcaggagaatcacttgaacctgggaggtggaggttgcaatgagccgagatcgtgccactgcactccagtctgggtgacagagcaacactccgtctcaaaaaaagagagtctggaatggaattagatagacatggtttgggacggtaagatgatgagttcaaatacggacgaactgaagcatcctaacctcactgtttttccttccgtatccagagtagggatggctttgtcatcccatgtttttacctgtccctcaatagggataataattctacctaattacttgcttgt

SEQ ID NO: 89995 - DNA, 601 bp, Human
atcatattttaaaaacaagtagaaattaataaaagaggatagtgaaagcattcatgttagcaggttggtttctgtggttgtttttacagagaatatacagtaaccagataaaagagtctgggctgggtgcagtggttcacacctgtaatcccggcactttgggaggccaagatgggcggctaatgatgtcagcagtttgagaccagcccggccaacatggtgaaaccccaaaccccaacttgactaaaaatacaaaaattagttaggcgtggtggtgggcacctgtaatcacagctactcragaggctgaggcaggagaatcacttgaacctgggaggtggaggttgcaatgagccgagatcgtgccactgcactccagtctgggtgacagagcaacactccgtctcaaaaaaagagagtctggaatggaattagatagacatggtttgggacggtaagatgatgagttcaaatacggacgaactgaagcatcctaacctcactgtttttccttccgtatccagagtagggatggctttgtcatcccatgtttttacctgtccctcaatagggataataattctacctaattacttgcttg

SEQ ID NO: 89996 - DNA, 601 bp, Human
tatcatattttaaaaacaagtagaaattaataaaagaggatagtgaaagcattcatgttagcaggttggtttctgtggttgtttttacagagaatatacagtaaccagataaaagagtctgggctgggtgcagtggttcacacctgtaatcccggcactttgggaggccaagatgggcggctaatgatgtcagcagtttgagaccagcccggccaacatggtgaaaccccaaaccccaacttgactaaaaatacaaaaattagttaggcgtggtggtgggcacctgtaatcacagctactyaagaggctgaggcaggagaatcacttgaacctgggaggtggaggttgcaatgagccgagatcgtgccactgcactccagtctgggtgacagagcaacactccgtctcaaaaaaagagagtctggaatggaattagatagacatggtttgggacggtaagatgatgagttcaaatacggacgaactgaagcatcctaacctcactgtttttccttccgtatccagagtagggatggctttgtcatcccatgtttttacctgtccctcaatagggataataattctacctaattacttgctt

SEQ ID NO: 89997 - DNA, 601 bp, Human
cattttcaatttctcctctaacccccaactcagtgcacactgaaatgggtaaaggaagacacatgagatgctacaagaagagaaagaagtacaaaaggttaataacctaagcatagggacagccagaaacagtgaaatggttttgtgtgcctatgtctattataatatatgaactagatttctcctcaggatatctttaatacacaaatcaattgatatttccatcttgatagagtaatacagttaaaaacaagtccacagcacacttcattagccacctcccatcttttctctattaatrcataaaatgaaaactaccagtatctttaaacaaacaagtgtagagaaataagaagttactctcactgcaatatctactaatctatactctgcgccgtgtgtgcaacatgcattacttgagattacgtgatacaaagtttgaaatgttgccatcacaggctgggctgaccagaagcaatttgcacactataaagacagaaaatgcaataagggctattgtctttcttgtacaatataatttaggtaggtttcctaactgtaactaatctaagcatttaactttgtaactcagtgtctagtt

SEQ ID NO: 89998 - DNA, 601 bp, Human
ctattcctatccccatctatactgccaggtttgtggcataaacattctactgtgggcaaacatggcaggccataaagagtggtagctacctttccctgcaagaggggactgaccttatttggaacgaggcatggaaaaatctgtacccaggaatgttgttaaaaacaagagtggactgggcgcagtggctcatgcctgtaatcccggcactttgggaggccaaggcagggagatcccaaggtcaagaggtcaagaccatcctggccaacatggtaaaaaccctgtctctattaaaaacacaaaaattagctgggcatgatggtgtgcacctgtagtcccagctactcaggaggctgaggcaggggaggctgaggcaggggaatcgcctgaacctgggaggcagaggatgcagtgagccaagattgcaccaccgcacttttgagattccgtcaaaaaaataataataataatattaataataataacgctttcagtggcaggcatcacgagggccattatctaactgactctggtgggggcaagcaacaaaatagcaaactagccagaaatctaacaggaagatcctaggaaaaagactgcc

SEQ ID NO: 89999 - DNA, 601 bp, Human
aatgaagaacagaaattcaaacctacatctcttaaattctgaagtctatgtgtatgtcatgggtcagagccttgatttttaaagaagagaaagcaaaatgctccctagattggggacaacagtcaaacactacccagaatgagcggtatggacaagattaatacaggataaaactgtggccatgagctgtgtaacaatgtggtcaacaacagactatgtataaaatggtggtcctataaaactacaatactgtattgtcactataccttttctatgtttagatacacaaatacttaccatrgtgttatgactgccaccacattcagtatcgtagcatgctgtacaggttcgtagcctagcagcaataagctatcttatatagcccaggtgtatagcaggctgtaccatctaggtttgtgtaacacactatgttcacacaatgatgaaatcactcaacatttctcagaacatgtccctactgttaagcgacacatgactatatataggaaggtagaccagaccatgttacaatttttcattttggccaggtgcggtggctcacgcctgtaatcctagcactttgggaggccgaggcgggcag

SEQ ID NO: 90000 - DNA, 601 bp, Human
gctgaggcaggagaatcgcttgaacccgagaggcggaggttgcagtaagctgagattgtgctactgcactccagcctggcaacagagcaagtctctgtctcaaaaacaaacaaacaaacaaacaaaacaaaaaaacacctcattttagggacactaaaactcttagaaattgtattttgaaattctaatatctaccatttgcaactgccctggtaatacctgattcaaacaactatcatcaaggattcaaaaaccactgaatcaaaatgtattggtaaaaaggatatttacaccatttcartgtatctccccacagattacttattaacaacaaagaagaaagtgataactttagagaaaataaacccagtggataccaccttaactgagtcatctaaattaacatcaccaataagggaacaaactggcattatatacctcttcatgtgatatacctttacagaacatagtgtcttttatacggtctctcttgcatattattcctgcccccaaaaaatgcataccccaaataaaattatgaggaaacagtgtgattcaagtcgagagacactacaaaacagttggtctttgacaatatcaa

SEQ ID NO: 90001 - DNA, 601 bp, Human
tttctaatcttatgttatcctttcacatgtcatattggttcctcaatgacttttgactcatttatttatttaaaatttaaagaaaaaatttattgaagatttgaaaaataattcctaaaagattgacttttccagaaaactagctacacaatgcatctcatctaccatgttaaaatgtgcactagacacaaatacaaaaaccatgcaacaagccaccattcttcaacaatttgagcaaagttaaatgccaaaggaacaacatggatgacttgcaaagaatgggctatttaagcaccatttwaaaaaaaaaaaggagcacaaatggatgagtgtgttcagttatatacactgaattgaacctttggcactaggaatcacagcattttgtcatatagcatgaacacatattataaaagtacgtagggtcaaaggaacaggaccaccagcattcaaaagcagctctgtcaactaggcaataaaacactctatagcatgtgtctctgttgtccattgttgaatacactggcaggaactttgaagtgaaaaaaaaggtaagataggaaaaaaggagctattactccttttattttctctgtttaaa

SEQ ID NO: 90002 - DNA, 601 bp, Human
agtagccatcgacgctcaccacctagacccattcgttcaccaaagttataaaatggtggtattgcaattctgccatttctttttcatttatcaattgaaatagctctcccatatctactattttgttagccagaggtacactcacataggaaaagcaggataaattgcttctttcttgtatttaccaatgttcaaggtaataaatttgttcctatcatgctctaatctaagagtaaccaattcctttttaaaataccattatgaactcaagaatttaaacacacttcacaggtttctaccratctctggccagtgggaattctacagtcatttctccagtctttctgaaatgaccctaaatagtctttaacagcctccttactaactgttatgacaatgttccagctcagcatgtacatttcttgcccaaaacctagaatcagcaattttgccagaaaggcttggtttcttttaaggtggaatggtttttcccaacaccacaatttgggtgctacagaagttcactgcacacagcactgtaaatgttcaattgctactcaattggtcatttttgatctagtcctcttcagtgttcacagtc

SEQ ID NO: 90003 - DNA, 601 bp, Human
cctttgctctgtagaagctttttagtttgatataatgcatctggtattttttgcttttgttgcctgcatttttgagatcttatccataaaatcctttcccagaccaatgtcctgaagcatttcctctatggtttcctctagcagttttatagtttcaagtcttacccttaggtctttgatccattttgagttgatttttgtataaggtgagaggtgggtttctagtttcattcttccacatgtggatatccagtttccccagcatcatttattgaaaagactatcctttccccaatctatrttcttggcacttttgtcaaaaagcaattggctatagatgcatggattaatttctgggttttctattctgttccatcggtgtatgtttctgtttttatgccagtaccatgctgttttggttactacaactttgtggtatattttgaagtctgttagtatgatgtctccagctttgttctttttgctcaggattgctttggctattcagggtcttttatggtcccatacaaattttaggatttttttttttttctatttctgtgcagaatgtcattggtattttaatagggactccactgaa

SEQ ID NO: 90004 - DNA, 601 bp, Human
atcagctcagggtaatcagcatatccataatctcaaacatttaacatttctgtgttggaaacattcagtatcctctttgaaattatataatgttttacctattaagtacagtcatcctacagtggtatagaatactcaagctttttctaactgtaattctgtattttttagcaaatctcttcttatctcttccttcccagcctctagtatcccctattctactctttacttttgcaagatcaacatttaccttccacatacgagtgagaacatgcatggtttaattttctgttcctggtcytatgtcacttaagataacatcctccaggtctatccatattgctgagaatgacaggatttcattctttttatggctaaatggtattccattgtgtatatataccacattttctttatctattcatctgatgttggacacctaggttgataccacatcttggctactgtaaatagtgctgcaacaaacataggggtgcagatgtctcgatacactgatttcctttcctttgggtaaatgccaagtagtgggactactggatcatatggtagttctatttgtaattttttgaggaacttccat

SEQ ID NO: 90005 - DNA, 601 bp, Human
cgcctccagggttcaagcaattctcctgcctcagcctcccaagtagctgggattataggcatgcaccaccatgcctggctaattttgtatttttagtagagatggggtttcaccatgttgaccaggctggtctcaaactcctgacctcaggtgatctgcccaccttggcctcctaaaatgctgggattacaggcgtgagccaccgagcccggccttaacactaaatataaatgtcactttcttttcatagccattcttaatttcctcccgccacaagccaagttagttttctttctctacrttctcataacagttagtgaactgttttataactgttcacctatccagcaactctataacagatgacctttttgagagtaaaactctagcttatttatataccaaggatcccacacaatggtaaggtgtacaaattaggcagacttactaaacactctggggatgcttgataaaattaaatgtttttaagaaaatatgtaattaacagagctgaacaaaaggcagaactaagaacactatcatgcaagggtgatataatgatttgtccagccaactatgacttgttcctgaaagtagggat

SEQ ID NO: 90006 - DNA, 601 bp, Human
tttttttgagcaaagtctcgctctgttgcccaggctggagtgcagtggcacaatctcggctcactgcaatctccaccttccgggttcaagtgacactcctgcctcagcctcccaagcggctgggactacaggtgcacactaccacaccccattaatttttgtattttttagtagagacagggtttcaccaggttggccaggctggtctcaaactcctgacctcatatgatctgcctgcttcagtctcccaaagtgctgggattttaactttttttttttttttttttgagacacagtcttkctctgtctcccaggctggagtgcagtggcgcaatctcagctcactgcaacctcggcctcccgagttcaagtgattctcttgcctcagcctcccaagtaggattttaactcttttttattcccgccaactatctttggatatgccctccctcctcctgatcctcactaaagccagacattagagtgctacaaagctgttccaacttgcaatttaaaaatcaaggatcacttaccatttggctgcctctgttggctgaaggcatgtatatccatgggagagaagatgtcagaatggatttca

SEQ ID NO: 90007 - DNA, 601 bp, Human
ctcagacagatgccagacatttatttacacaaaagtgccaaacccttaacattctcgtattccttttaaacctaattccagtcctctcttacaagttctcagcagtcatagcccgagtcattgtaaaggctgaccaaacacagaaccaaaactaaggaaaacaaggtgggaggggtacacagaaaagtttaagtaggtattttatttagcaagctgaggtacttaaattcaaatatattctagattaacagagttttcatttaaaaagaagaggcgtttttgtgtgtgtgtgtgttttttktttttttttttttttgagacataatttctttcttgttgcccaggctgaaagtgcaatggcgtgatcttggctcactgcaacctctgcctcccgggttcaagcgattctccagcctcagcctcccaagtagctgggattataagcacacgccaccacgcctggctaatatttttgttattttagtagagacggggtttcaccatgttggccaggctggtctcaaactcctgacctcaagtgatccacctgccttggcctcccaaagtgtgggattacaggcatgagccaccgcgcctggcc

SEQ ID NO: 90008 - DNA, 601 bp, Human
atacactcagacagatgccagacatttatttacacaaaagtgccaaacccttaacattctcgtattccttttaaacctaattccagtcctctcttacaagttctcagcagtcatagcccgagtcattgtaaaggctgaccaaacacagaaccaaaactaaggaaaacaaggtgggaggggtacacagaaaagtttaagtaggtattttatttagcaagctgaggtacttaaattcaaatatattctagattaacagagttttcatttaaaaagaagaggcgtttttgtgtgtgtgtgtgtkttttgtttttttttttttttgagacataatttctttcttgttgcccaggctgaaagtgcaatggcgtgatcttggctcactgcaacctctgcctcccgggttcaagcgattctccagcctcagcctcccaagtagctgggattataagcacacgccaccacgcctggctaatatttttgttattttagtagagacggggtttcaccatgttggccaggctggtctcaaactcctgacctcaagtgatccacctgccttggcctcccaaagtgtgggattacaggcatgagccaccgcgcc

SEQ ID NO: 90009 - DNA, 601 bp, Human
aaagctatctgaataaaactttgggggctataaactgggtaagatattaaggtgaacagtataactggaggttaaggtttctactgactaataggaactaaagctgaatgaatacaaagaatgggaatagattaaagtgaaggacactgaaagccaagaaaagtaattatgttgaaaagtcatgccttgggaagattaacatagaagggataagcagaaaaaaggggaaaatgaaaatcagagaaaactaattagcaaactttggaaattatggaaagggatatgtccaaacaatactcayagaaaaaaatcaacataagatggagaccaatggaacatgaaagataaaagtaaccaacatgaaagataactgcaaattctcaaattagtaaaacataaaggaccaacaatgccatttaaaaagaaaaacaagaggccaggcacggtggctcgtgactataatcccagcactttgggaggcctaggtgcgtggatcacttgagcccaggagtttgagaccagcctgggtcaccaacatggtgagaccctacctctataaaaaatactaaaattagccaggtgtggtggcatatgcctgtag

SEQ ID NO: 90010 - DNA, 601 bp, Human
ggctgtcaaatataaatcacattgattaatatcaatgattactaagtacacaaaggttaacaaccataacatgaacaactgtgataagccaaaattattaccaaatgtcatgcaggtgcttgactatcaaaccatctgcaaagacaggaattaatcagtgtgaatttacttagtattttgtaaccaaagaggaatacacaagaagtaaagcaggagatccctgccctaaaagaggttacaatttagtcagttaaacaaaattaacaaaaagcaaaactaaaaacaaacaaacaaacaaacaaaaccaataaaactaagtgctattttgcacattatagacaataagtacagagtcaaatgggaaaaaaaccgctgaggtttaaagaattgaagaagagctttgtggagtatacagcacgggagccttcaaggataggaaggatagataagaggacatttcaagtatggtaaagctatctgaataaaactttgggggctataaactgggtaagatattaaggtgaacagtataactggaggttaaggtttctactgactaataggaactaaagctgaatgaatacaaagaatgggaatagat

SEQ ID NO: 90011 - DNA, 601 bp, Human
acccccattgtcaattccacatggatttgtggctgtcaaatataaatcacattgattaatatcaatgattactaagtacacaaaggttaacaaccataacatgaacaactgtgataagccaaaattattaccaaatgtcatgcaggtgcttgactatcaaaccatctgcaaagacaggaattaatcagtgtgaatttacttagtattttgtaaccaaagaggaatacacaagaagtaaagcaggagatccctgccctaaaagaggttacaatttagtcagttaaacaaaattaacaaaaagcaaaactaaaaacaaacaaacaaacaaacaaaaccaataaaactaagtgctattttgcacattatagacaataagtacagagtcaaatgggaaaaaaaccgctgaggtttaaagaattgaagaagagctttgtggagtatacagcacgggagccttcaaggataggaaggatagataagaggacatttcaagtatggtaaagctatctgaataaaactttgggggctataaactgggtaagatattaaggtgaacagtataactggaggttaaggtttctactgactaataggaactaaa

SEQ ID NO: 90012 - DNA, 601 bp, Human
cagaaaagatacaacacgtaacttttttcaaaaatatgttatttaaaacactaaaataatttataaaatagcattcaagtgatgccacagaacaaaacactcctattctataaccatgtgtgaagactgtgaaattaagtgactggtctcccaaagcagtataacctagagagctgattatagagaaaacaaatcatgaagaattccaatagttataaaatttttcattttggataatatcttcttaccatctttgcaggtttttccattctccaggagtttgaccccagtggggcaagcrcactgataaaaaggcttgactggagacatcaaacacaaatgggaacaacccccattgtcaattccacatggatttgtggctgtcaaatataaatcacattgattaatatcaatgattactaagtacacaaaggttaacaaccataacatgaacaactgtgataagccaaaattattaccaaatgtcatgcaggtgcttgactatcaaaccatctgcaaagacaggaattaatcagtgtgaatttacttagtattttgtaaccaaagaggaatacacaagaagtaaagcaggagatccctg

SEQ ID NO: 90013 - DNA, 601 bp, Human
cacaaactttgggaaaatatctaatctcgctaagcctagtttccccatctataccttgtaaggttgttgtaaggattaaaggagataaatctaaaactcaggaaagtactgaacatttaagtactcaagaaatattaactaatacttaacaacagtattaaaaaataaagattttcagatttttatttcactgaattttaaattaggtttatttatgaactgtttaaagcccaagccccaaatacttaaccacataaccaagaatgaagatactgagctcaatctttttttcattttaaattgttcaagtaaaccaccagcaaaaaatcgtctaactataggaagctaataaaagacagtaagcaaattgacaactgaaagaataagaaaagattcccagctaaataaatgagtccaaaacaaaatactggcatataaacttcaagaatcaatctgcaattacaagtcaaaaaactgagaagaggagtgaagcctctcaatatcagccctttcactctagagctaattataaatgaattccaacttgaagaaaatacagcccaaatgccactgcaggaaccaagtaggaataactttgtac

SEQ ID NO: 90014 - DNA, 601 bp, Human
tatgaagaggtgtttaagacatttatcccagcaatatataagattgtgggaaattttcagatcagtgtgttctagagccaatcctgaaaatgcctcccaataatgagattacagttttacttcttttttttttttttttttttaaatattttgtgtgcccttttccatgaactttctctctcttttccttgatggcttgtcatctctctgacacaaaaggcttatcccagcagtattagtcagatggcaaactgaattctcaaaataactatttcttcctgcagtgctaagtgattcttayggctcctggatgtttagatggctctaaggcattggtatatactgaggtgtaatttgtcactatgcttgtcctcagaataaatctcaaagtaacaaaattgttgagtatgtaaaaagttgtacttccctggactatgatcagggtggcatggcaaaacaaaacaaacaacaacaacaaactagaagtaaagctgcatgggctggcaaagttttggaaatcaagtcattcatgtatttagggaaaaaaaagtaagctatattcttactataaagtactgaaaatggaattaaagcttctagg

SEQ ID NO: 90015 - DNA, 601 bp, Human
cttaacaccaatatcagggatataggccactaataaaacactgtgataaaatattaatcactgattattttcaccataatctatttgattgccacaaacttaactctaccacttggtaaatattttttcccaagctttggttaattagtcttgttcccacacagcccataaatcaattttaaaattgtttgcatgtaaccatcataatatttaatatattctaccatctgccccaacaccagttaacagcaataaaagatatagatatagatatagatatagatatagatatagatatagttatagatatacacatacatgtgggctttgttttcctaacttaggacagccagttcttccagtatagatcttacataattttggtttgcagaaattgcccctaggaaattcagaaagtggctttacccaaaatgaggaaaatcacttacataagcttttaagactagaaactgatcagcagccatttctcataccaatacatctctccatcctaggattatgtggaagagaatatattatccctagaatcatgaaggttgagtaaaatttctgtaaaaggtacctttggcaccccagacaa

SEQ ID NO: 90016 - DNA, 601 bp, Human
ctgtagcaaagtctaattcaaagttgttaattttagacttaacaccaatatcagggatataggccactaataaaacactgtgataaaatattaatcactgattattttcaccataatctatttgattgccacaaacttaactctaccacttggtaaatattttttcccaagctttggttaattagtcttgttcccacacagcccataaatcaattttaaaattgtttgcatgtaaccatcataatatttaatatattctaccatctgccccaacaccagttaacagcaataaaagatatakatatagatatagatatagatatagatatagatatagatatagatatacacatacatgtgggctttgttttcctaacttaggacagccagttcttccagtatagatcttacataattttggtttgcagaaattgcccctaggaaattcagaaagtggctttacccaaaatgaggaaaatcacttacataagcttttaagactagaaactgatcagcagccatttctcataccaatacatctctccatcctaggattatgtggaagagaatatattatccctagaatcatgaaggttgagta

SEQ ID NO: 90017 - DNA, 601 bp, Human
tgtacagtgtctctctgaagagccatttaaagccatccttgtatgtgaagtttcccccaaaggaaaattgagacctaactctgttctatctatgtgatccataagacctgtagcaaagtctaattcaaagttgttaattttagacttaacaccaatatcagggatataggccactaataaaacactgtgataaaatattaatcactgattattttcaccataatctatttgattgccacaaacttaactctaccacttggtaaatattttttcccaagctttggttaattagtcttgttcycacacagcccataaatcaattttaaaattgtttgcatgtaaccatcataatatttaatatattctaccatctgccccaacaccagttaacagcaataaaagatatagatatagatatagatatagatatagatatagatatagatatagatatacacatacatgtgggctttgttttcctaacttaggacagccagttcttccagtatagatcttacataattttggtttgcagaaattgcccctaggaaattcagaaagtggctttacccaaaatgaggaaaatcacttacataagctt

SEQ ID NO: 90018 - DNA, 601 bp, Human
atgttatatattgttatataaagtgtattaatttttattcttaaagatggtcactcagaacctccataaattgtaatgtctttatctgaatcccttctgaactatttgttattctgaataaatttctgtatctaaagtattatacctaaagtgaggaaaataagacttgaaatattcccagtaagaaacaaatgattttattttcaggctaatcagtcagttatagcagactaagatgggcaaaaccaaatacggaattttaaaaaccctacatgataataaatttggtgcattcccttaygtaaattttcttgctacagatattcttctaaaacttatgggctttaaactgttttcctaagcatactcgtacctatacactcatgtatagttcataatccacaggtgtgaactagatgggattaggtaggcaatctatattcaagctgaccaaaatgaagctaaaagcctgtctgaaacataaactcataacctttgtctcatcagcaatgcactccaactgttaaaagattcaaacatcaacttggatttgaaaagagtgggaggcagtgaaatactaacagggagaaaatttatggag

SEQ ID NO: 90019 - DNA, 601 bp, Human
aatctactgcactcactgcaaactaggaaaataaatcctatttaatcaatgttatatattgttatataaagtgtattaatttttattcttaaagatggtcactcagaacctccataaattgtaatgtctttatctgaatcccttctgaactatttgttattctgaataaatttctgtatctaaagtattatacctaaagtgaggaaaataagacttgaaatattcccagtaagaaacaaatgattttattttcaggctaatcagtcagttatagcagactaagatgggcaaaaccaaatayggaattttaaaaaccctacatgataataaatttggtgcattcccttacgtaaattttcttgctacagatattcttctaaaacttatgggctttaaactgttttcctaagcatactcgtacctatacactcatgtatagttcataatccacaggtgtgaactagatgggattaggtaggcaatctatattcaagctgaccaaaatgaagctaaaagcctgtctgaaacataaactcataacctttgtctcatcagcaatgcactccaactgttaaaagattcaaacatcaacttggatttg

SEQ ID NO: 90020 - DNA, 601 bp, Human
caaaggctctgatgtcctaatagtgaattaggacatcagaatctccaggggaaattataaagggaggtcttcatgtatacagaagtaaatttaccacaaacatcaatctataaaaaggggacaaaaaacaaacagcagttgtgttccagcaaacctagaaggagaaagatggatctaaaaataagatttatgggtgacagagcctttgcagattaaaagaacgaatgaatgaaggaacaaatgaacgaatgaacgaatgaatgaaaaaaattaaaaacaggtttaaggatgctggtaccayacagggaagaaggaaagaaggggtgacggagccaatgacaccactgtatgtatgtgtctgtatgtatatatatatatatgcatagctcaagaaaacataacaaagaggccagaaaaggaattctaattttaaaatctactgcactcactgcaaactaggaaaataaatcctatttaatcaatgttatatattgttatataaagtgtattaatttttattcttaaagatggtcactcagaacctccataaattgtaatgtctttatctgaatcccttctgaactatttgttattctgaata

SEQ ID NO: 90021 - DNA, 601 bp, Human
acatcattagcaatgccctacgctcaatccctccttcccgaagcttattataaacctgaggttaaatctattcattctttctacaactctgtacaatataaaaacacatctaatacccagaattccccattccttctccctggtttccctaatgtagccagcatctggtcacatcaccacttacaaaagaggaagtgagaagctgatctaaagaatttccactaagcgagcaggtagcataaatgaatgaacacagtgagactttcccatgtgatccactcaagacacataggtttactawgtcttaccttgctatataaataatttaccaaataattatcttttctttccaaatgtactataaacacatatacaacagtgtgagcccaaacttttttttttttttttttttttagacagagtcttgttcttgtcccccaggctggaatgcaatggcatcatctcggctcactgcaacgtctgcctgccgggttcaagtgattctcctgcctcagcctcccgagtagctaggattacaggtgcccgccaccacgcccagctaatttttgtatttttactacagacagggtttcaccatgtt

SEQ ID NO: 90022 - DNA, 601 bp, Human
aaaataaataaataaatagaaaaagaaaaaagaaactgtgagagaaatttagcattgacaatactattgttttcaataaaaccaactattagaaacacactgattttgtcaatcagttaaatgggtatataacaagaaaagcaacctcaagaaaatttaagctaatagtacattcttaattttacaccatggcaaaaatgctttaaacctataaattatcaacgatatatcttggctattagtaagaagtactacaggccctcagtgcaacaaacgttttcagcagtaaaacctgatcctaaaaaaaaaaaaaggaatgctgttaagaaacaaggttgttctgcctactgcagggtcatataaaatagaaataaaggcttttgatctttcctctatcaaaaacatgaaaattattctttctgctaatgctttagtacttattatgggaaggccccacaacaatatagtaaaaatcaggagggggggtggtggcagaagtactgtgcagacaagtaaactaggtttgtccacaaaaggcaatgaagtcatttcagcataatgaagaagagacataaacaagtactagcaggcaccttttaaa

SEQ ID NO: 90023 - DNA, 601 bp, Human
acaaaaaattagccaagcgtggtagcagacgcctgtagtcccagctactcaggaggctgaggcaggaaaattgcgtgaacccaggaggtggagcttgcatgcagtgagccgagatcgcgccactgcactccagcctggacgacagagcgagactccgtctcaaataaaaaataaaataaaataaaataaaataaaataaaataaataaataaatagaaaaagaaaaaagaaactgtgagagaaatttagcattgacaatactattgttttcaataaaaccaactattagaaacacactgaytttgtcaatcagttaaatgggtatataacaagaaaagcaacctcaagaaaatttaagctaatagtacattcttaattttacaccatggcaaaaatgctttaaacctataaattatcaacgatatatcttggctattagtaagaagtactacaggccctcagtgcaacaaacgttttcagcagtaaaacctgatcctaaaaaaaaaaaaaggaatgctgttaagaaacaaggttgttctgcctactgcagggtcatataaaatagaaataaaggcttttgatctttcctctatcaaaaaca

SEQ ID NO: 90024 - DNA, 601 bp, Human
aatgaacattaagtccaaactccaggtgctctgctgagttgaggaatctaatgatggagtttatcaatatcattcttctctgatcatatgttatgaagatttggggagaaatatatatccatactaacatacagtacatgttgtgtggtaaagtagcacaaatgggcaaatatttaggtatttaaattagttattttgaatatttctcaaactgaagtataatcaatctttcttttttttttttaagcagagtcttgctctgttgtccatgctggagtgcagtggcctgatctcggctcastgcaacctccgccacccgggttcaagcaattttcctgcctcagcctcctaaatagctgggattacaggcgcatgccaccacgtttggctaatttttgtatttttagtagagacggggtttcaccatgttggccaggctggtctcgaactcctggcctccagtgatcagcacacctcagactctcaaagtgctggattacaggcgtgagccaccgtgcccagcctcaaactgaaggtataatcaattttaagaaacacaatgttacaaattggcaaagattcaaaaggaagtacttgttga

SEQ ID NO: 90025 - DNA, 601 bp, Human
gcaacctctgcctcccagactcaggtgatcctcccacctcagcctccagggtagctgggactacagttgcacaccacaatgcctagctaatttttgcattttttatagagatggggttttgccatgttgcccaggcttgtctcaaactcctgggctcaagtgatcttcccacttcagcctcccaagtagctgggactccaggagtgcactaccacgcccagctaatttttattttctgtagagccggggatctcactatattacccaggctggtttcaaactcctagcctcaagggatccmgggatcctcccacctcaacccttccaaagtgataggattacaagtgtgagccactgtgcccaataatcaactagcaattttcaaataggaattcacaaatttcattgttatgcgatgtaccccagacacaaaataacacaacaggccagcaccaggtttacaactcaatgaacattaagtccaaactccaggtgctctgctgagttgaggaatctaatgatggagtttatcaatatcattcttctctgatcatatgttatgaagatttggggagaaatatatatccatactaacatacag

SEQ ID NO: 90026 - DNA, 601 bp, Human
ttgagaacagagttccagatgaaggcatcatgatgacgaatgtcaacatcctggtcaattatactcaactgcttcataagacacttctgaaagcctcactgtcctgaggccccaaaaacctaatagggaaaagattaacatgtcaacaagggaaaactgccctctctgctctcattctttttaagcacagctaaaataaattcttttgtttttggggggacagggtcttgctctgttgcccaagctagagttcagtggcatgatctcagctcgctgcaacctctgcctcccagactcaggygatcctcccacctcagcctccagggtagctgggactacagttgcacaccacaatgcctagctaatttttgcattttttatagagatggggttttgccatgttgcccaggcttgtctcaaactcctgggctcaagtgatcttcccacttcagcctcccaagtagctgggactccaggagtgcactaccacgcccagctaatttttattttctgtagagccggggatctcactatattacccaggctggtttcaaactcctagcctcaagggatccagggatcctcccacctcaacccttcc

SEQ ID NO: 90027 - DNA, 601 bp, Human
gaattataaggatcctccgaagagattaagggatcaccagcttaaacaatatctgactgtgagactttgcatctaaacacacagataatgtattttccttcacacaaagtccaatttctgaaatgtttccttccattacttttgtagaggtgacactattagaaaactgacttctccactaagtatttctcttgtaccagccacacaatctttttctaccgggcacaagttaaccatagtgaaataagaacatgttgctctgtcttaaagaaatcactattccatttctcatattcctgtraaagttttggacaggttactaggtctataaatacagtttaagctccttatgtttaaaataacacaaatcctggcaaaagcttgtttgtatattctgaacccagaacaaatgaaccactttaggcaattccaaaagattacacttatgctttaaaaactgtgccaatgttaattaaatctgacaactcttaagggtgtacttcactgtattacctcagagtggtttaattagttaaactgaaattaggcttctgtcacttctaaaatctaactccaaatctgaaccagagtctccagtggt

SEQ ID NO: 90028 - DNA, 601 bp, Human
ttaggctatgtcaaaaaggaagtattaagaccatagatatattattagaaaacccatttctgccatctccttagccctcccgcttaagacacgctgcagtctagatcagccatgtactaacaatggttaaaactaggtagttcatggtcgtctctactctgctttctatactctgacattttccataatttttaaaaaatgaagagaaaaagctaagaagcaagtccaaggacacacaaataataatgatgatgataactgctgttattaataaatgctattattggccgagcgcggtggytcacgcctgtaatcccagcactttgggaggccaaggagggcggatcaccaggtcaggagatcaagaccatcctggctaacatggtgaaactccatctctactaaaaacacacacacaaaaaactagccaggcgtggtggcgggtgcccgtagtcccagctactcaggaggttgaggcaggaggatggcgtgaacccgggaggtggagcttgcagtgcaccgagactgtgccactgcactccagcctgggcgacagagtgaaactcagtctcaaaaaaaaataaaataaataaataaataa

SEQ ID NO: 90029 - DNA, 601 bp, Human
aacacatccaaaattcttttctctcaacctgtaatcaatattaaaattttattaatgacatttatggttttttttttaatactaggtctcttagaatgtgttttacaattaaagtacatcctaattcaacctaggcacattttaagttctgcagagccacatgtaattagtggctacatattgcactgtgctggattagagtcttcagagtggtgactacatacagcctataataaaattaattggttccttttttagtttacatcactgtcccctctatacctgtcaccttcaggcttasctcagatcgatcaggctcactaaagcttcaaacaaatgtcttttatttggtctttctttcttccaagctatatactatttaattctaatatgaagttaaaattacttcacacacacacacacacacacacacacacacacacacacgtcttagatgaaaaaaactactttttttcttcttgtcacatttgcaagtttacatataaaacactagctaagaggttagttagaaggagcaacaaagacctgattctttcatttattttaggctatgtcaaaaaggaagtattaagaccataga

SEQ ID NO: 90030 - DNA, 601 bp, Human
cacaactaatgatttggttgctttactcacttgagcactagtcccttccaaccattccttgttctctcactcgaaaagcaaaaactaaaaggtctttttttggtaatgacgtaaatacaaaagcaagatctatcaattcatgtctatttcaagttaagcaatgtaattaagatttattaaagatttttttaaaaccacgttttgtaagcacactgtttcctttaattcctgatctccttgttctcatctggtgtagtttttacaataggtttggatctaaaacagcactgtccaggagaawtataacacaagccaccaatgtaggccgtatgtgtccatttaaaattttctagtagtcatattaaaaagtacaaaacatgccaggagaatgttttcgctcacacctgtaatcctagcactttgggagtccaaggcgggtggatcacttgaggccaggagttcaagaccagcctggccaacatggtgaagccccctctctactgaaaatacaaaaatgagccaggtgtggagatgcacacctgtaatcccagctagtcggtaggctgaggcagaattgcttgaacctgagaggcagaggttg

SEQ ID NO: 90031 - DNA, 601 bp, Human
ctacttgggttcagggcagcactatttatagccaaacatgttaatatttctgcaataaaacacggccaggcgcagtggttcacacctgtaatcccagcactttgggaggccaaggcaggaggaccatttgaggtcaggagttcgagactagcctgacaaacatggtgaaaccctgtctctactaaaaatagaaaaattagccgggagtggtggctaacgcctgtaatcccagctacttgggagggtgaggcaggaaagttgcttaaacccgggaggcagaggttgcagtgagccaagatcrcaccattgcactccagcctgggcaacaagagcaaactctgcctcaaaatgataataataataataataataataaataaaagtatgcccgcagtgtgggacagactacaaatagtctcacactggttcagatcaagttttccaccaaatcaattaacaaaagcagcatttggttttcagagccctttggatttcagaattgcagataaaggattatagatcagaaatactttgctcatcttcacttcagtcccttgagaaaactggggtttggatcagtgttaatactgctctagataca

SEQ ID NO: 90032 - DNA, 601 bp, Human
gcctaggaaaaaaatctttaaaaagacagaaaataggtaagaatgaaattaaaaatcattgtgagaaaaataataaatgccacaattctaagacctttttagtaaacataattctgcatcttctatttaccagtttcccttcattcttctgttctctaaaaaatttctcatgatcagcaaacagtattgtggcagaaagagatttgtatttcaaatataagctttatcactcagtgggtacctttaagcaagtctcacaaataaaatagggacagcagtccaggcgcggtggctcacgccygtaatcccagcattttgggaggccgagacgggtgggtcacgaggtcaagagatggagacaatcctggccaacatggtgaaaccccgtctctactaaaaatacaaaaaatttgctgggcgtggtggcgcacacctgtagtcccagctactcgggaggctgaggcaggagaatcgcttgaacccaggaggcagaggttgcagtgtgccgagatcgcgccactgcactccaacctggcaacaaagtgagactctgtctcaaaaaaaaaaaaagggacagcgccactgccatcactgaattagt

SEQ ID NO: 90033 - DNA, 601 bp, Human
gatcaacaaaatcttttctctttcagctatatcactttccaacatttttgtttattttgataaataaatagcttaaacaaaagatggatgattaagtatgaattaggaaaatgaggctgggtatggtggctcatgcctataatcccagcactttggaaggccaaggcaggaggagcacttaagccttgggtttcaagaccagcctggacaaaatggcaaggccctgtctctacaaaaataccaaaaaattagtcaagcatggtgtggtaagcctgtagtcctagctactagggaggctaargcaggcagattgcttgagcccaggagtttgaggctgcagtgagctataatcaagccactgtactccagcctaagtaactccagcctaggaaaaaaatctttaaaaagacagaaaataggtaagaatgaaattaaaaatcattgtgagaaaaataataaatgccacaattctaagacctttttagtaaacataattctgcatcttctatttaccagtttcccttcattcttctgttctctaaaaaatttctcatgatcagcaaacagtattgtggcagaaagagatttgtatttcaaatat

SEQ ID NO: 90034 - DNA, 601 bp, Human
ctctgcacttcgtttatgaactctttcaatgctacgcctctgccagtcagtccagtaaacatagtcacccaacaaagtaaatccaaatatgtgaggaattttgtcttccactagtactcgtctcccagtgccatcagtattcataaccttcaggtttaaattcaaaagagaaggggatgaattatgcatttattcttcagctaaaaataacaaatccaactgcctgttgtataaaaatccaagagtcatcttggtattcctattacaatgctttctcaaaattacatgatgattttataaraatgatttcaaattttccatataagcctctatttgaccacttttccccccaatctcatattactcttccttctaaaaattctggcaactttagattatgcaactcttctattaaacaattgtggcaaaattaaaaatacagtatcatcaccttaagtttgcacatttgttttcaaattataatgtaccttcatatacattattttatcatatattttgttttataacatcttttattttatcttgagagctttgcctatggaaactgagattcatgtaaggtcacagagcttgtaaacac

SEQ ID NO: 90035 - DNA, 601 bp, Human
aattcaggggagaaattttaaaactctaatgcaccaaaaatttattctactaacagcagaatgactttacttttaaaatttatcagtaatcaagtggaaaagctgtgaccacaatgctacagatcttaattagtggtcaattttctaaaggtgcttaagattatggcaagtcatcatgcctaccatataaatgaatgtaaccattatactaccattatagcactgagtcccataacacttttaaaaatcataattcaaactaataatagatacatcttatcaagtattatcctaagtacgytttgtccgtagattttgtcacttaatacaacagtcctgcaagtatggcatcacccctattttatgtttttgagacagagtctcactctgtcacccaggctggagtgcagtggcatgatctcggctcactgcaacttctgcctcccaggttcaagtgattctcgtgcctcagtttcccgagtagctgggattacaggtatgcgccaccatgaccagctaatttttgtatttttagtagagacggggttttgtcatgttggccaggctgttctcaaactcgtgacctcaggtgatccatgtg

SEQ ID NO: 90036 - DNA, 601 bp, Human
tgacttcttttataagtggaatttttctttagatttcagatttcttagctgccggctttaaaaaatttgctgactcttgtaaaaaggaacactcgcccttgaaaaacatcatgttgtgaacagtttattctatcttgtaataacaaagctactgccagtttataataatgatcaaaccaaactatccattttgaattaataaatactccaaaataaagctttttaaatgtagttttttcttagctcacaacattgtttcggtgggtttacttcaataggcttggaatctagtataactggraaggagtgcaagcaactacagatggataatacctcttggtatatatacttaacatatcagtatactcatcagtaacatttgattattaacccattcccctctttcttcacctaaagttaattacgacaagagtaaaattagctaataattattcattcaaatcagcaaaatatcaattagtgtttttaaaagttcatctatcatttagttctcagattcctaatacgtattatttaaaacattaagaatatcatctgtaactatgccatgttccccgaaatgtacactgcagttgcaaag

SEQ ID NO: 90037 - DNA, 601 bp, Human
gctccagtccgtccagtagatataatcttggtactgagttaagccaaaaggatgaggcaagtcatctgctataacttcacggttgagccctattttcagaaaggcagtagacaggggagaagcagagtgatgaaatatgtgagaatacaagtgtcttgctggcaaaaagaaaaaaaaaagccctaacatataaaacattacattgtaagcaatttaaaatagaaaaattcatttaaaagcaattctaaaacgagaccaattctctgaaatcaatctatcttctgaccccatgcttcaaacttattcctgctacaaatcactcagtttcctaaaattcttgcaaatggtctactttaaatgtggttttattttctctatataagggtctacagttcactttttcttcttgaactatagaaggaaaagatggaaatatatatattttactggtacaaaagtcatttcaggagtatctagggagttataaatttcattacaagtccaataataatgaaactttcacataataaaaagatgaatccaagtacctggatcactattaataacaaacaggatacaattccagaacagaagaagaatg

SEQ ID NO: 90038 - DNA, 601 bp, Human
ctgtatggcctgttaaacatttaaattttttatgactgtcctactctttgcacttcaaaggacaagtaagttgtgttttgcgattcactgttttactgtttgtaatgttcttcccttcctttacaataaatatgatgcatgaaactatgcaacttttacacttaatatttaatgtccaagggtaaaagacttaatttttcctttttttttgaagaaagaatctctctgtgtcacccaggctggaatgcagtggtgccaccatagctcactgcagcctcaatctcctggggccaagtgatcmtcctacttcaccctcctgagtaggtgggactacaaatgcacaccattactctggctaatttttttattttttgtagaggcaaggtctcgctatattgcctaggctggtcttgaactcctgagctgaagcattcctcccacctcagcttcccaaagtgctgggttacggacataagacaatggaccagcataagacttaatttttctataacatcaaattgctatcatcaaacaagtaataagtaacaaacacttgcattcccctaccctttaaccaaacaaataaccccctctggatttc

SEQ ID NO: 90039 - DNA, 601 bp, Human
agtttgttactttccatcatattgacccaaaccctacacccctcccataatctactctttctgatttaatctacttatttcttaatcgtatctaccaatttgttcttgtctatccaccaagaaatgggccttcatatatatttaagttataagccaggtttcccctagccaacaatgttttgttacacactttgttgttagtgttatgtgtgtacttgccggtatttaaaaatcaggagatgagggagtcacacacacaaaaaaatctagattcaggaccaaatgaaaagatctggtaacwtcagcttcagttaaactgcaactgcctactatgttcattgcatgttctctttagtttctcatcaactgttactttatactgggttacatgttctcatacgcgttttctgtatggcctgttaaacatttaaattttttatgactgtcctactctttgcacttcaaaggacaagtaagttgtgttttgcgattcactgttttactgtttgtaatgttcttcccttcctttacaataaatatgatgcatgaaactatgcaacttttacacttaatatttaatgtccaagggtaaaagacttaa

SEQ ID NO: 90040 - DNA, 601 bp, Human
ttatgaaatgtggggtataggtcatgtaggacccagtaggccattataagaactaggtttttattctgtgtgaaatgagaagccaaacttctcaaaagagatgtctatatatgtcactatcgtttccttttttccattcacgttttaatgtactgcattctgcatttcaccattacttccctgaaattactctcttcagggttaataaccactttacccaaaaatccagtgtatgctattttagacctccccttactcattcaacagagttcatttttgaaacaacctaatctctgtcttygtgcctctattctctcccgcttttcctcttacctctctggttgctacttctcagtgttctctgtgaacttctcttcctcaaccagagttgcatagtttaccaagtgccttcttttctctccatcagagttagcccactgatgggggttatggcccacaagttaaatctggcctgctgcctgtttctgtaataaagttttactggaattcagccacttccatttttaaaatgtattgcctgaggctgctctcacactgccatggcgagagctgggcagagttcagcaggtgtgagacagcc

SEQ ID NO: 90041 - DNA, 601 bp, Human
atagaatggcagcataattttaattttaaatagcatagaccaggtgtcactatgaaggaaacaattaagcaaagacttggacgtgaagggtatccacgcaaatatatgcaataacactccaagcagagtaaacaagcagttcaacagtcatgaagcgggagtacccggcctagctgaaaccagcaacgaggccagtgtggctgtaatgaagaaagcaagagagacaagagtaaaagctgaggttagagaagaaaactgagtggtggggagtgagagtgaagaaggggttatgaaatgtggkgtataggtcatgtaggacccagtaggccattataagaactaggtttttattctgtgtgaaatgagaagccaaacttctcaaaagagatgtctatatatgtcactatcgtttccttttttccattcacgttttaatgtactgcattctgcatttcaccattacttccctgaaattactctcttcagggttaataaccactttacccaaaaatccagtgtatgctattttagacctccccttactcattcaacagagttcatttttgaaacaacctaatctctgtctttgtgcctctattct

SEQ ID NO: 90042 - DNA, 601 bp, Human
tatttaatccacaaaattatctctattttataggcgagtgcactgaggatctgaaaggttaggccaggcgtagtggctcatgcctgtaatcccagcatcttgggaggccaaggctggtggatcacctgaggtcaggagttcaagaccagcctggccaacatggtgaaatcccgtctccactaaaaacacaaaaattagccaggcaccgtgatgcacgcctgtaaacccagctactcaggaggctaagacaggagaatcacttgaacctgggaggcggatgttgcagtgagccaagatcacrccactttactccagcctgggtgacagtgtgagactctgtctcaaacaaacaaacaaacaaacaaaaagtctttcagccagaactgccatcttccagtaatttgccaaaatgatgaacacaaagggaaagaggagaggcacccgatacgtgttctctaggccttttagaaagcatggagttgttcctttggccacctatatgcaaatctgtaagaaaggtgatattgtagacatcaagggaatgggtactgttcaaaaggaatgccccacaagtgttaccactgcaaaactggaagggtct

SEQ ID NO: 90043 - DNA, 601 bp, Human
tcatactaaatgttatttaatccacaaaattatctctattttataggcgagtgcactgaggatctgaaaggttaggccaggcgtagtggctcatgcctgtaatcccagcatcttgggaggccaaggctggtggatcacctgaggtcaggagttcaagaccagcctggccaacatggtgaaatcccgtctccactaaaaacacaaaaattagccaggcaccgtgatgcacgcctgtaaacccagctactcaggaggctaagacaggagaatcacttgaacctgggaggcggatgttgcagtragccaagatcacgccactttactccagcctgggtgacagtgtgagactctgtctcaaacaaacaaacaaacaaacaaaaagtctttcagccagaactgccatcttccagtaatttgccaaaatgatgaacacaaagggaaagaggagaggcacccgatacgtgttctctaggccttttagaaagcatggagttgttcctttggccacctatatgcaaatctgtaagaaaggtgatattgtagacatcaagggaatgggtactgttcaaaaggaatgccccacaagtgttaccactgcaaa

SEQ ID NO: 90044 - DNA, 601 bp, Human
aataaaatttgagacgaggaaaggaaaagaaaaatttatttaggacctccaatatattacatatcatactaaatgttatttaatccacaaaattatctctattttataggcgagtgcactgaggatctgaaaggttaggccaggcgtagtggctcatgcctgtaatcccagcatcttgggaggccaaggctggtggatcacctgaggtcaggagttcaagaccagcctggccaacatggtgaaatcccgtctccactaaaaacacaaaaattagccaggcaccgtgatgcacgcctgtaawcccagctactcaggaggctaagacaggagaatcacttgaacctgggaggcggatgttgcagtgagccaagatcacgccactttactccagcctgggtgacagtgtgagactctgtctcaaacaaacaaacaaacaaacaaaaagtctttcagccagaactgccatcttccagtaatttgccaaaatgatgaacacaaagggaaagaggagaggcacccgatacgtgttctctaggccttttagaaagcatggagttgttcctttggccacctatatgcaaatctgtaagaaaggtgatat

SEQ ID NO: 90045 - DNA, 601 bp, Human
ctttaacaacgacctcatctggttgtcttgagtctcgcattcccacaatggagacatcagagaagctggaggatgagatgtacgtaggagggagcttttcagttctcttctgaaggcatatgtgttcactggtagcttagacaaaggtgttgctcttgtttaagaatagaataaactataaggccaagaccatcatgtatgactgtaccatttgtgctctgtgccaggggcattgagtaggaactgaaatccagtccacacttccttagccacgccatacacctgtagggctaaatctgcycagaggaaacatctttttccaatttgcacaaagatgccacagaggccacttcagtactgaataaaggattacacaatctggcttcccatttcctctctgatctaatttctttattcacttcattccagcaacactagcttcctaggtgttcctctaacatgtcggacatgttcccccaagaccttttgcatttactatccccttttgcttgataggccttctcccagatatccgcatagctcatttcctcacttccttcagttcttgacataaatgtcattttttcagtaagaacttccc

SEQ ID NO: 90046 - DNA, 601 bp, Human
gaaggggttcccacttttgcttctttctcatttgtctcttgccaccgccaggaaagaagtcccttttgcctcccaccacaattctgaggcctccccagccatgtggaactgtaaattaaacctctttttgttcccagtttccaatatgtctttatcaaccgcatgaaaatgaactaatgcagtggtgcgatctcggctcactgcagcctccacctcccaggttcaagcgattctcctgcctcagcctcccaagtagctgggattacaggtgcccaccaccatgcccagctaatttttttawttttagtagagacagggtttcaccatgctggtcaggctggtctcgaactcctgacctcgtgatccacccacctcagcctcccaaagtgctgggtttgcagatgtgagccaccatgcctggccaagaatgacttctgggagactaccaacaacttcaaagtctaaggccattttttaaatcttcattaaaatatctgtatacatttcataattatactctattttcttagtgcttagacatcacctaaatacaggagaattttgtccttctcaggaatataaaacataaatagccaagcca

SEQ ID NO: 90047 - DNA, 601 bp, Human
tttataaattaaagcagaaacttctagactgattttacacttgacagggcaagacccatctaaggaaaaaaaaaaaaaaaagaaggctgatttttagtctcagccttctcatttgatcttaagtcactgagcctctctaggccaaagtttactcagcggtaaaataaaagtcatagtcatcttgtccctctcactgagttgctacaagaattttacaacgtatatgaaaatactttagaaactgtaaggcactatataaatgtaaatttttaatgtttttaataacttaaaaattatttayaaaaaattaatagagatggggtctcgccatgttgcccaagctggtctcgaactcctgggctcaagcaatcctcccaccttggcctcccaaactgctgggaatacaggcagagccactgtgcccacccataaatttaaaataattatttattaccagtagtggcagtaataaacttggtattaacaggcactgaaaccttaatggattgcagatactattttgttgtttatgtgaggacggcatggaaagagagcaggtaaaaattacaaaaataataatagatgctttatgatatggttt

SEQ ID NO: 90048 - DNA, 601 bp, Human
accacagtgcttgagaaaccctgctctagagataacagcaactagtaaaggctacaaatcaagtcatctccttttctgatcctcaagtctacacatgcaatttttttacaataaagtcaagcaaaaagagaggctttgtccatttgtgccatctgaactgtatcttactggtatctctgaagtaacatattccttaatttctatctattagttatcagcccatcagtcctggcctatatggtggaaagtgtgtctggaatacacagctattactataccctaaatgatctctcagcagccytaaatatattacctccttggtctttattttaagatgagacatagtgaaaaacggtactctaacttccctaaattttaatacattcaagatacaacttacgatcactgctatgaggatgacaacaagtaattatttatagtattataatcccagtctgacagggctcggccacagaaagcaagcaaagaagtatcgatagtgatgtgtaaatccataattggcatgtaaatgggtaagatttattgataatatcctcattcccatcccacagtcaccatataattatgaccaaaaaaaccc

SEQ ID NO: 90049 - DNA, 601 bp, Human
ccgagcagccccccacaacaaacaattaatccagcccaaaacgaccacagtgcttgagaaaccctgctctagagataacagcaactagtaaaggctacaaatcaagtcatctccttttctgatcctcaagtctacacatgcaatttttttacaataaagtcaagcaaaaagagaggctttgtccatttgtgccatctgaactgtatcttactggtatctctgaagtaacatattccttaatttctatctattagttatcagcccatcagtcctggcctatatggtggaaagtgtgtctggratacacagctattactataccctaaatgatctctcagcagccctaaatatattacctccttggtctttattttaagatgagacatagtgaaaaacggtactctaacttccctaaattttaatacattcaagatacaacttacgatcactgctatgaggatgacaacaagtaattatttatagtattataatcccagtctgacagggctcggccacagaaagcaagcaaagaagtatcgatagtgatgtgtaaatccataattggcatgtaaatgggtaagatttattgataatatcctca

SEQ ID NO: 90050 - DNA, 601 bp, Human
aaggtcaggagatcgagaccatcctggctaacacggtgaaaccctgtctctactaaaaatagaaaaaattagctgggcgcagtggcaggtgcctgtagtcccagatactcaggaggctgaggcaggagaatggcgtgaacccgggaactgcattccagcctgggcgataaagcaagactccgtctcaaaaaaaaagaaatatattatttacagaaccaagatcaagaaaactggcaggtagttaagtaacagaggagtaatcatgttgacagttgaagaaaaagctcttcaccaaccaacytgatgctgactacatttaatgaataaaactgccaagaaatgtgccaaaaacaatacgatgcaagaaaaacacaatagatgaatcatcttaaaaactcaaattaaaataaggaaacatatttcttgggtacctgagagatcactgctttcaattcgccggagatctgaatcagcccaaaagagcttgcccagcctgctatcaagggctaaagcaattggtttacttaagccactgaaaaagaggacctcccgttctgtcccatccaaagcagcccgttcaattttaggagacctttcctga

SEQ ID NO: 90051 - DNA, 601 bp, Human
taaattttgattattactggcaaattgtcctctaaaaaggctctatcaatttccacttccaccaaagcacatgagggcatgtaattttctaccatactggccaatgctaggcaataatcaacgttaacatatttttgccatgctgacagacacaaatagtatattttaatttcatttacctgatcactagggaggccaacacagactatatggacatcagaaattggggacagaggaggtaattataattacagacataagattgcagagaaatgtgaaagtaaaagtatatcttaagacsaacaaataatttaatttggttaaaataccagaaaggtaaacgccacgatgaggttgtgaaaggtgaatactaacttataccaacttaagagtacaactagacttttttcctacaggttatgaaactaccctgaagattttttaagtaaagcagtgacattaaaaccatgcttcagaaaatttaggagccatgtgtaaactttcatggagaaaaactggcagggagatcaaccagaggctaggatttggccacagatgacaagaacataaactagagcagaagagttaggaaaggatgcat

SEQ ID NO: 90052 - DNA, 601 bp, Human
gataagttcatgtcctttgcagagacatggatgaagctggaaaccatcattctcagcaaactatcacaaggacagaaaaccaaacaccacatgttctcactcacaggtgggaattaaacaatgagatcacttggacacagggtggggaacatcacacactggggcctgtcggggggtggggggctaggggagggatagcattaggagaaatacctaatgtaaattactagttaatgggtgcagcaaaccaacagggcacatgtatacctatgtatcaaacctgcacattgtgcacatgtaycctaaaacttataattaaaaaaaaaactgcaattacttttgcaccaacctaatacattcagattgcaacagaaggtgaattttggaaaaaacaattattcaaaagacataaatgcattaggtacccagaaaaaaaaattagaggtgatataagagacagaggagatcagatgagggaaagaatatactataccaggcgtgtaactatacatgcgtaagtgtgtgcctaactgtctggaatcagagaatacataatggaagggaggcatttgaacctgaagacattaaaaaaaatgtgaaa

SEQ ID NO: 90053 - DNA, 601 bp, Human
ggagtttgagactagcctcagcaacacagcaagacccccatctctacaaaaataaaattagccgggtgtggtggtgtgtgcccatagtcctagctactcaggaagctgaggcaggaggactgtttgagctagggagtttgaggctgcagcaagctataatcacaccactgtactctagcctgggtgacagggcaaaaccctttctcaaacaaaaataaaaacaaaagatagtttaaaatattgacataagtaactaatgtacaaatgagaggtgatatccatggaatactatgcaaccataaaaaaggataagttcatgtcctttgcagagacatggatgaagctggaaaccatcattctcagcaaactatcacaaggacagaaaaccaaacaccacatgttctcactcacaggtgggaattaaacaatgagatcacttggacacagggtggggaacatcacacactggggcctgtcggggggtggggggctaggggagggatagcattaggagaaatacctaatgtaaattactagttaatgggtgcagcaaaccaacagggcacatgtatacctatgtatcaaacctgcacattgtgca

SEQ ID NO: 90054 - DNA, 601 bp, Human
caattccagatggattacagatcccaataagaaaagttaaatgaagaaatttcagggaaaaaactaaagtatctttttgtacctttgcagaagacaaacatttctttcttttttcttattgctatacatttatgtggtacaagtttttttaacatggatatatactatgtatctatgatgtgtacaagtgtgaagtgtgagcttttagtgtaaaaccatagtgtacgttgtacgcattaagtaatttctcatccctcaactcccatgaagatttcttaaacaacataaaagatgttaaccrtaaaaagaaaattaataaactgtactacattaaaattaggacctttcttttcatctaaagatactactgggagaataaaaaaggtaaatcacaaactgggagatttatgcagtatatatcttgacaaaggattcatatctagaatgtacaaagaattcctatacaacaataaactttcaagttaccagttttgggttattttttgagacagggtctcggctttattggccaggctggagtgcagtggtgcaatcatgatcatggctcattgcagcagtgggacaaaattaattgtaatga

SEQ ID NO: 90055 - DNA, 601 bp, Human
gaagtcaatagtgtcactgcaggcccccagatatggtaaggacctgatctactttgatgctggtgaaaaataagtaagctactggaaccaacaaggaaaagatatgcttatttattcaacaaactaagcatgcactggatgcaattcgctataaaaggctatgtgggtggctacaaatacgaaatagaaaaaggtcccaggatgaaagcataattatctgtgaatacgtaagaaaaaaaaaatcaacttgacagtaacctttttcagagaatagaaaaagaacaaacatttctttttatgkggccaacaaagccttgatggcaaaacaccaacaaatacctgacaagaaaagaaaattataaggtaatccttctcatgagcgtagattaaaaaaaatctcaaaacattagcaaatcaaatccagcaataaaaaaaagaataatatatcatgctagattttatttatcccagtaaactggggaaagtaagtaaattccttaatttgacaaaggttatctacagaaaaaccttagcaaagaatacttaatcacaaaagtactgaatgcttctccaagacctagaaaacaacaacaacaaaaaa

SEQ ID NO: 90056 - DNA, 601 bp, Human
atctgcccgcctcagcctccaaaagtgctgggattacaggcgtgagccactgcacctggccaattaaaaaaataaatcttaaaacaaaacattagcatatcaaatccagcaataaataaaaagaatgtaccatgctaaattttatttattccagcaaactgagaaaagaagttaaattccttaatttgacaaaggttatctacagaaaaaccttagcaaagaatacttaatcacaaagtattgaatgcttcccccaagctcaaggggaaaaggactagaaaggaagaagaagggaaagaargggaaggagaaggggaaaagaagggaatgatgagaaaggggaagaggaaagggctgggggagggagagtggagagaaagaaaaaaggaaagaagggaggaatcaaacaaaggcacagtatcaaattctaggacattgaggggaaagaacatgttaaaagcttctggaggaaaaaggaaaaggacagcatacaaagactgaaatcacagtcacatcaaacttcccaatgacacaagatgctcaaagacaatggagttctattttcgaaattctgagagaaaacagctataaaacatgaaag

SEQ ID NO: 90057 - DNA, 601 bp, Human
cagctacagtcaagaaggttcagcataaaaataaaaagctccaaaataggaaaatgaaaaataaattatcaaagaaacaacacaagaaaacattccagaatttaaggtgtagacttctagacagaaaggatcaacctagtaaccagttcaatgagaaggaagggaaggggaagggaaagcacgagcatagattttaaaaatcttttttttttttttttgagacggagttttgctctttcgcccaggctagagtgcagtggctcaatctcgcctcactgcaaccttcaccttccggtttcaygtgattctcctgcctcagactcctgagtagctgggattactcgcacccgtcaccatgccaggctaatttttgtatttttagtagatatggggtttcaccatggtggccaggctggccttgaactcctgacctcatgatctgcccgcctcagcctccaaaagtgctgggattacaggcgtgagccactgcacctggccaattaaaaaaataaatcttaaaacaaaacattagcatatcaaatccagcaataaataaaaagaatgtaccatgctaaattttatttattccagcaaactgaga

SEQ ID NO: 90058 - DNA, 601 bp, Human
gtttaaaaatccacaaaagtacatattaatttattataacacatgattcctccaattagctttatcccattaacacttactgtattcttgaaggttcagctcctttactgcatgaatgtcactaagctgggcaattcgagcttggactttggttctaccctctcgacctgtcatgtcaattttttcaatcatttgctgctgtttatcaatccaatagagccagttttcaaacacagtaagtcccacaggctgcaagatattggagtcttctaatactatccggttagcaccttggaaaagsagaaaattcaacagaaatgactcatgtgggtcaagttatacttttggtaattatttactgactaccagttagattctacaggtagagaaaagaaaaaaaaaacaagatctctaccacaaaacttaaaaatcatggtaagacatacactagaaaacagctaataaactagatattaatatgcaatcaagagcaagtaagtgcccaatgtgcagtaaatattctagttcatagaaatgtagaaaagaacttagaacagtagtttgaaaaaccctaacttatatatacaacagataaaaatgg

SEQ ID NO: 90059 - DNA, 601 bp, Human
atgtagcagtgtttctcaacctttaattccatgacatttttgataaaaatcccattctctttaatattagaaatttgaaaaaatgatttacctaatatacaatcatatttaaatagttattaaataaaacctctcccttgaaattctgaaaatcttgagattttctgtaataaaatattcatgtatcgactaaataaataacttaggtatgatatcattatcatatttctattaaatgttcagcctgagctacaagtcataccataaaatgacaacaatttttaactttctaattctcaawtacttgtaactttacttctaaattcatgaactgtaccaacataatgaacacttgtacagggctactcctgtttcttcattctcctttcatgcttaaattcaatttaaaagcactgagctgagaagttacagaatttcaataattgtctctctcatactcaatttaacattggcatccccggtaccatcatgtatgatcaacagtagtgactgctaggaaggcactttttaaaaaacgttttgcatatataaactcatttattcctctctatgattagggtaattttgatgacagatatga

SEQ ID NO: 90060 - DNA, 601 bp, Human
cgcctgtaatcctagcactttgggaggctgcggcaggtggattgcctgaactcaggagttcaagaccagcctgggcaacacagtgaaatcccgtctctactaaaatacaaaagaaattagctgggtgtggtggcatgcacctgtaatcccagctactcgggaggctgaggcataagaattgcttgaacctgggaggcggaggttacagtgagccaagatagtgccactgcactccagcctgggcggcagagcaagactccatctctacaaaaaacaacaacaaaaaattgctagggagaaygctgaaacttgagtattattctatttaaaatataagaattctcctatattaagatttttaactcagaaaatccgtatatctgaaagacaacttcagtcaaaaagtgtatcttaatgaggaatccattgagaattaaagagttattagaagaaaaaaacttaaaaggcacatgtaacagaacaattcagaaacaaaattatttggtcaactgcaaaaggtaacttgtaatactataaatgtctaacttcctcatacatgggctaagtaaagaaaccactaggcaacttttcaaagtctgtt

SEQ ID NO: 90061 - DNA, 601 bp, Human
tagataatagtatgatgtagtctttttccttcagttgaattaacttagaattatccccaaaaggaggatatctgaattaagggtatgaatactattgtggtgcctgataccatcatactataatttaacaatggaatgtatctatttgttaaacctgctaagtgattaaaccaattttactacaacagtatcactatactcagtgatatcttttaaaaaatcattttttactagataaagaagcaacaggaatttgctgatggatttgaacaaaagaatattctttccatcagacacattyccaacaatgacacataaacttagagaatctacaatttagtggagagagattacaggaggtagaattaattcatttttttaccttttgggagaggggggaggctactttaatattaggaagcatactcattcacaggctgaaaagtgtggtaatatatacgcagtgaaatactattcagtcaaaaaaagtaggaaatcctgtcatttgcaacaacacagatgaacctggaagacatcctgttaagtgaaataagctaggcatagaaacacaaatactacatgatctcacacgtggagtgta

SEQ ID NO: 90062 - DNA, 601 bp, Human
gctgtatgctatctcaaagatcttcaaatcccctacggtccaagcacagtgcccatagctgctactgaatacatgcattatttattttttaaaaaacttatagttcgacgaataaaatttacttgtaatcccacccacccgatcaacaatttttatatgttgaatacatattctctttcaatatttgtttacagaaatatatattttatgtacttgtcattttggcaacatttttacatcaacttcatgattataacatttaatagctgtataaactcagttattttacttaataattttcacaccattagaaattcatttaaaaatttctgccactgtagataatagtatgatgtagtctttttccttcagttgaattaacttagaattatccccaaaaggaggatatctgaattaagggtatgaatactattgtggtgcctgataccatcatactataatttaacaatggaatgtatctatttgttaaacctgctaagtgattaaaccaattttactacaacagtatcactatactcagtgatatcttttaaaaaatcattttttactagataaagaagcaacaggaatttgctgatgg

SEQ ID NO: 90063 - DNA, 601 bp, Human
caagtaccagagcttaactctttgtacatatctgatttccctgactacgctgtatgctatctcaaagatcttcaaatcccctacggtccaagcacagtgcccatagctgctactgaatacatgcattatttattttttaaaaaacttatagttcgacgaataaaatttacttgtaatcccacccacccgatcaacaatttttatatgttgaatacatattctctttcaatatttgtttacagaaatatatattttatgtacttgtcattttggcaacatttttacatcaacttcatgattrtaacatttaatagctgtataaactcagttattttacttaataattttcacaccattagaaattcatttaaaaatttctgccactgtagataatagtatgatgtagtctttttccttcagttgaattaacttagaattatccccaaaaggaggatatctgaattaagggtatgaatactattgtggtgcctgataccatcatactataatttaacaatggaatgtatctatttgttaaacctgctaagtgattaaaccaattttactacaacagtatcactatactcagtgatatctttta

SEQ ID NO: 90064 - DNA, 601 bp, Human
tttaaagtgcatagctcaatgacattaagtacattcacattattgtgcaatccctatttttaaaaatttcaagtaccagagcttaactctttgtacatatctgatttccctgactacgctgtatgctatctcaaagatcttcaaatcccctacggtccaagcacagtgcccatagctgctactgaatacatgcattatttattttttaaaaaacttatagttcgacgaataaaatttacttgtaatcccacccacccgatcaacaatttttatatgttgaatacatattctctttcaatayttgtttacagaaatatatattttatgtacttgtcattttggcaacatttttacatcaacttcatgattataacatttaatagctgtataaactcagttattttacttaataattttcacaccattagaaattcatttaaaaatttctgccactgtagataatagtatgatgtagtctttttccttcagttgaattaacttagaattatccccaaaaggaggatatctgaattaagggtatgaatactattgtggtgcctgataccatcatactataatttaacaatggaatgtatctatt

SEQ ID NO: 90065 - DNA, 601 bp, Human
aaatttttctaggatttgcctcaaagtaacactccagcaccctgatagggaaacacatgctatttttttgggggggggggggggagggtaaagtaaccataaaattgaccaatttaaccactttaaagtgcatagctcaatgacattaagtacattcacattattgtgcaatccctatttttaaaaatttcaagtaccagagcttaactctttgtacatatctgatttccctgactacgctgtatgctatctcaaagatcttcaaatcccctacggtccaagcacagtgcccatagctgcwactgaatacatgcattatttattttttaaaaaacttatagttcgacgaataaaatttacttgtaatcccacccacccgatcaacaatttttatatgttgaatacatattctctttcaatatttgtttacagaaatatatattttatgtacttgtcattttggcaacatttttacatcaacttcatgattataacatttaatagctgtataaactcagttattttacttaataattttcacaccattagaaattcatttaaaaatttctgccactgtagataatagtatgatgtagtcttt

SEQ ID NO: 90066 - DNA, 601 bp, Human
ccaattaaactttttctttataagttacccagcctcaggtatttctttatagcaatgcaagaatggcctaatacacagttgtatacatctgtcaaaactcgttttaatacatacattaaaaataattgctaaatgtgcaagcaagaaaaaaggccctttaaaagatattttcaaactggaagatgagatccttgactcagttttatccatgttatcattaacataaagagaaatttttctaggatttgcctcaaagtaacactccagcaccctgatagggaaacacatgctatttttttgkgggggggggggggagggtaaagtaaccataaaattgaccaatttaaccactttaaagtgcatagctcaatgacattaagtacattcacattattgtgcaatccctatttttaaaaatttcaagtaccagagcttaactctttgtacatatctgatttccctgactacgctgtatgctatctcaaagatcttcaaatcccctacggtccaagcacagtgcccatagctgctactgaatacatgcattatttattttttaaaaaacttatagttcgacgaataaaatttacttgtaatccca

SEQ ID NO: 90067 - DNA, 601 bp, Human
gccaattaaactttttctttataagttacccagcctcaggtatttctttatagcaatgcaagaatggcctaatacacagttgtatacatctgtcaaaactcgttttaatacatacattaaaaataattgctaaatgtgcaagcaagaaaaaaggccctttaaaagatattttcaaactggaagatgagatccttgactcagttttatccatgttatcattaacataaagagaaatttttctaggatttgcctcaaagtaacactccagcaccctgatagggaaacacatgctatttttttkggggggggggggggagggtaaagtaaccataaaattgaccaatttaaccactttaaagtgcatagctcaatgacattaagtacattcacattattgtgcaatccctatttttaaaaatttcaagtaccagagcttaactctttgtacatatctgatttccctgactacgctgtatgctatctcaaagatcttcaaatcccctacggtccaagcacagtgcccatagctgctactgaatacatgcattatttattttttaaaaaacttatagttcgacgaataaaatttacttgtaatccc

SEQ ID NO: 90068 - DNA, 601 bp, Human
acatggcactatgatcagaagtgatacagtcatatgtacttgaaaaaccccaactgacactaagccaagtaatactgaagtttaaacaactgaatgggaaaaaaggattgcatgctgaggcactgaagaattctggataccttcacagttcttctcatctgatttgtcctggcagtttgcatctccattgcatcggagggcaccatcaatacactgcccactggcacactggaactgggactctgagcatacaggacaattgagttcatcactgtggtcttcacattcagtaaacccatcrcaccgccaagccacagggatacagtcaatttcccccgtgaaacaagtaaactgctgaggagaacatgttggaggttcttcaaatgaacaaggagaaggggagtgacaaaaacacaatcatggtcacacagaagtacaaacacatacctgagtgaagctcatttaataattaacatacacaaaatactttataataaatatgatttataactatctcatctattcaaagaagaaataaaggttttcacattacttcctttacattcactataaacttttgcccgcaaaactataaggcaaa

SEQ ID NO: 90069 - DNA, 601 bp, Human
cctcggcctcccaaagtgctgggattacaggcgtgagccaccacgcccggcttattctttacattaaattccctctttcactaaagaattctagagaacttggctgggttgtttttaccatgggaaaagttagtaagggaaagtgaagaatataaaatatgttagagcgtaattaataaatccactaattcagagctcattggaaacagggactatttttatatactgaaggcctaatatattttagtttcatttctcaattttcaaagcttattaatttgtataaatcttatgcatatgragtgaattaaaacaataatatggaacatggcactatgatcagaagtgatacagtcatatgtacttgaaaaaccccaactgacactaagccaagtaatactgaagtttaaacaactgaatgggaaaaaaggattgcatgctgaggcactgaagaattctggataccttcacagttcttctcatctgatttgtcctggcagtttgcatctccattgcatcggagggcaccatcaatacactgcccactggcacactggaactgggactctgagcatacaggacaattgagttcatcactgtg

SEQ ID NO: 90070 - DNA, 601 bp, Human
gaaggccagttccctagagcaacacggcctacccaagcttaaaacttctggctactcagctatgcctaaactagccctttgtcccttattagcacatgaagtcaggagaaaacttaagacatattctcccttctatcatccagctatttacaaatctttgttggctgaagggaatcttatataatttttggcctccttttattcatgggctccatagtactagagttccctggtggtgaacttaacctgtggtttacaactctttcactaaatgactggctgattcaccttccgtagcatrcatccagaattgcagtcagagaggcttagagcttgcatatgtatttgctttatatgctttgacaatttctaccaaaccatatctaaggccttctgtgtaaagagaaggtgctaatagtaaaaaagaacgtttgtccttataattgtttaaactcagagtaatatggtttcagacagactctaggtagtattcttttccacaatggaaactggcagtcttgcaggaccaaagacttgattctcaatggatccatcctgactcacctggaagagatcctgacaaagaacttgggtgtggcac

SEQ ID NO: 90071 - DNA, 601 bp, Human
aaactgaagatgagtatgatatataaaaatgtatcaagcaatttcattcaacagtaggattacaaatatcaacagtgaagtagtctgattttaaaataacttacactcttttcctataattgaaaacatttaatggagaaaggaaatgaacgttttctagaagtcaatgcttccattgaaagagctggcctagaacaaggccaagaatagctcccaccttctccctcccctggtagaagcagagctatttaaaataagggcttttcaacctcttggaggatttgaaaggattgtaaagggkagaggttgtgaggcagggcatattaaataccagacttgctcaaaagaaaacaaaaaaacatttttagggcacaaacaacatatgaaagaatattttttcatctaatgaatataaatgttgctagaatcaaaactaccagtgctaaagaaaaaattctattttttccaagaagcttcccaaattccactaactgaaaataggtatggcaacaaagcaacactaccattaacagtttaaaaaccatgtttgtctacttaagagttacacccatagtaagttcctattttcagagggtttttg

SEQ ID NO: 90072 - DNA, 601 bp, Human
aaatgagttaaaaaatctaagatcttatgtatgtcgcattcaaaggaaaacagactacttactgcagggaagtaagtgcctttggtgcttgaagaactacttgatgatgctcctgtaacatgggctcggtcataggggggtccactgcttccccccatgatactgagggagctgatcattgatttacctcgagacattcctaaaataaaaggaggttaaaaactgaagatgagtatgatatataaaaatgtatcaagcaatttcattcaacagtaggattacaaatatcaacagtgaagtwgtctgattttaaaataacttacactcttttcctataattgaaaacatttaatggagaaaggaaatgaacgttttctagaagtcaatgcttccattgaaagagctggcctagaacaaggccaagaatagctcccaccttctccctcccctggtagaagcagagctatttaaaataagggcttttcaacctcttggaggatttgaaaggattgtaaagggtagaggttgtgaggcagggcatattaaataccagacttgctcaaaagaaaacaaaaaaacatttttagggcacaaacaacat

SEQ ID NO: 90073 - DNA, 601 bp, Human
taaatgagttaaaaaatctaagatcttatgtatgtcgcattcaaaggaaaacagactacttactgcagggaagtaagtgcctttggtgcttgaagaactacttgatgatgctcctgtaacatgggctcggtcataggggggtccactgcttccccccatgatactgagggagctgatcattgatttacctcgagacattcctaaaataaaaggaggttaaaaactgaagatgagtatgatatataaaaatgtatcaagcaatttcattcaacagtaggattacaaatatcaacagtgaagyagtctgattttaaaataacttacactcttttcctataattgaaaacatttaatggagaaaggaaatgaacgttttctagaagtcaatgcttccattgaaagagctggcctagaacaaggccaagaatagctcccaccttctccctcccctggtagaagcagagctatttaaaataagggcttttcaacctcttggaggatttgaaaggattgtaaagggtagaggttgtgaggcagggcatattaaataccagacttgctcaaaagaaaacaaaaaaacatttttagggcacaaacaaca

SEQ ID NO: 90074 - DNA, 601 bp, Human
ctgatcacccacatttaaatgagttaaaaaatctaagatcttatgtatgtcgcattcaaaggaaaacagactacttactgcagggaagtaagtgcctttggtgcttgaagaactacttgatgatgctcctgtaacatgggctcggtcataggggggtccactgcttccccccatgatactgagggagctgatcattgatttacctcgagacattcctaaaataaaaggaggttaaaaactgaagatgagtatgatatataaaaatgtatcaagcaatttcattcaacagtaggattacaartatcaacagtgaagtagtctgattttaaaataacttacactcttttcctataattgaaaacatttaatggagaaaggaaatgaacgttttctagaagtcaatgcttccattgaaagagctggcctagaacaaggccaagaatagctcccaccttctccctcccctggtagaagcagagctatttaaaataagggcttttcaacctcttggaggatttgaaaggattgtaaagggtagaggttgtgaggcagggcatattaaataccagacttgctcaaaagaaaacaaaaaaacattttt

SEQ ID NO: 90075 - DNA, 601 bp, Human
tatttcaatctttctttattccatgcaactacatgagaaatctttcactccaaattgtaatagcatatgcaagcaatggctgaacttacatttctctcaacttttctaaaattctgtgctctgagtatgttgctgttttaaactctcaattctatgaaccaatcttatcccaatatttcattcttagaatatcaaactattttgaaaccagtcactttggtgggtaattcctccttagaatactgccaaagcctgaggctgtattttattattataaaagccagcatttgtgactctcttaaaaaaaaaaaaaagtataggccaggtgtggtggctcacacctgtaatcccagcactttgggaggccaaggcaggcggatcacctgagatcaggagttcgagaccagcctggccaacatggtgaaaccacgtttctactaaaaatacaaaattagctgggcgtggtagcgcaggtctgtaatcccagctatttgagaggctgaggcaggagaatcgcttgaacctgggaggcggaggttgcagtgagctgagatcatgccattacactccagcctgggcaacaagagcgaaatccatctca

SEQ ID NO: 90076 - DNA, 601 bp, Human
agttaaactgtatcacagaataaaaaatgactattcaaatttgttctgcagtttcatagcccatgggaagaatgggtttttacatattttacactactcaaacatgtcagcattccctcaacattctttactccaaaattaacctgatgaataattaatttaatgacatctgaagtcttcatttctttcttctgtacaattctgtacaatttctgtacagtccaggctggattttggtagacagcctcaggggcataactattccattgttgttatcttagcaaagggaaattgctgtgaytgggggaaacggttttcattccctgtgtataggtaagtacctctcataagagcagctttaaacatcaaaatgataaaatttaaatgcccataaagggtcagtgaattttctaatgtatatttcagaggcctagtttatttcttacacttgtttatctttacaagtgacatacagttgttaggtttgtagcactgctaactaaagaaaaaggcattggaaagagagaaacatactagtgaaaataagatctgacctaagttctggcttttctgtcattcctacttctatttttaacttctt

SEQ ID NO: 90077 - DNA, 601 bp, Human
gactcctacttcgtgaccatcttctagatcgagacctggatctgcttccagagtaagatcgcctatggcttgtgcgtggcttatcttcaataagcctaatatttctgccatttatttctgtgccatccagtttgtccaaagcacgcttcatgtcagagtaggagcgaaactcaattacaccctcatttgttccttccttgtgggcatccgcacaggttacttaacctgcttgtcgcataaaatcctttaaatctctccaactgcacagactagaaagattttctacaataagcctgtattstgtacgaacaggtggtccgtatttgtctctgccagatgtctccgactgctgtatccacctccaccacggcggcttccgtagctgtagctgtcgcgattgcgacgcgggccccgggcgtgctctacgatcacgcgctcgccgcagagctcctcgctgttcagctcgtaaagggcgtcgtcggtgtcgcgggagtcctcgaactccacgaagccgtagccatttttgaggtctacttcgaggaggcggccatagccactgaaaaagcgctggatggccttctcctggacgttgtagcttagg

SEQ ID NO: 90078 - DNA, 601 bp, Human; identical to SEQ ID NO: 33192

SEQ ID NO: 90079 - DNA, 601 bp, Human; identical to SEQ ID NO: 33193

SEQ ID NO: 90080 - DNA, 601 bp, Human; identical to SEQ ID NO: 33194

SEQ ID NO: 90081 - DNA, 601 bp, Human; identical to SEQ ID NO: 33195

SEQ ID NO: 90082 - DNA, 601 bp, Human; identical to SEQ ID NO: 33196

SEQ ID NO: 90083 - DNA, 601 bp, Human; identical to SEQ ID NO: 33197

SEQ ID NO: 90084 - DNA, 601 bp, Human
taggacaaagggccctgggtgccgacctcctggggagggccctgacccgctacttcggctcggagtccccgtgcggggctgcacctgcgccccgggtcttcccgggtggagcgcactccccagccccccagcccaggcaagtacccccgaccggccgggtgcctaacctgaaatgccgacggctcctctcggagaccaccctccacccccagcacacacagcactctggggcctgggccgtccgacgtcacaaaacctcctgcgggtcacctcgcctgggggacctcgtgctccctccctrgcagcggccccagggacactggcgcggggtgcgaagacccctgcaggcctcccctaggccagcctccctgtgtgcccagaggcagggaatgtacagatttctccaggggctgcaggagcagctgggctgtgggggacaggtgtcccggggcgctgtggggacgaggacggcagcgctggggacggatcctaacatgtcctgacaccgcctgtgctcttcgtcttgtgcctctgaaatgggtaattcttgtatcggacgctttatccgtttcctttgtcctctgtctttgaacttaacccc

SEQ ID NO: 90085 - DNA, 601 bp, Human
tacagatttctccaggggctgcaggagcagctgggctgtgggggacaggtgtcccggggcgctgtggggacgaggacggcagcgctggggacggatcctaacatgtcctgacaccgcctgtgctcttcgtcttgtgcctctgaaatgggtaattcttgtatcggacgctttatccgtttcctttgtcctctgtctttgaacttaaccccgaatgggcagcttgacagagaggtttcgagttctcggtgctcttgcatccggacacgcgctgctttatggagcagccctgagtgggtcagartatcccaactgaacgtgggcgctggatttaaacagttgtcatcggcccgcctgtgccacttagggactccgtatggctaagtggggtgttggctgtcaagaaaataaatgggagagtagagggggctgtcctgggtgtgttggtgaggcgtcggctctcaggccctctaactcctgtttgtcctcattttggaaaggaggaagctgggctgggaagcccaagggctcgaggccatagcttatgacttaggaagaccagcgggcatagccagtggggcctttagaaccgctgaggaagagg

SEQ ID NO: 90086 - DNA, 601 bp, Human
gcaaccttttatccaagcccgtttctttattgttggttaaagagcaatctgagtgtgattcacctaaaataatacattttataaaatcctaagccttttagatccttcacgattgtgtctctaagccacaatctacagcagctttggactgttttccaaggcgtgatggagaatagtgaggggtgagcttgagtctcagtctggagttgaaacccagtctgggtgggtgtgacctctcttcatcctaaactgtcactacaggaacataagtttgcttttaagtgctctttcgccctcattscgaattctctcaggccccaaacaagcacccgcaggagtactgaactttttggggggtgggcagaggggatctgtatgcagattgccagctgagcaatcctattttctatgacttaaagccaatcacaggctgggcgtggtggctcatacctgtagtcccagcactttgggaggccgaggcaggcggatcacttgtgctcaggagttccagaccagcctggccaacatggtgaaaccctgtctctactgagaaaatacaaaaattagccgggcgtggtggcgggcgcctgtaatcccagct

SEQ ID NO: 90087 - DNA, 601 bp, Human
ggttaaagagcaatctgagtgtgattcacctaaaataatacattttataaaatcctaagccttttagatccttcacgattgtgtctctaagccacaatctacagcagctttggactgttttccaaggcgtgatggagaatagtgaggggtgagcttgagtctcagtctggagttgaaacccagtctgggtgggtgtgacctctcttcatcctaaactgtcactacaggaacataagtttgcttttaagtgctctttcgccctcattccgaattctctcaggccccaaacaagcacccgcargagtactgaactttttggggggtgggcagaggggatctgtatgcagattgccagctgagcaatcctattttctatgacttaaagccaatcacaggctgggcgtggtggctcatacctgtagtcccagcactttgggaggccgaggcaggcggatcacttgtgctcaggagttccagaccagcctggccaacatggtgaaaccctgtctctactgagaaaatacaaaaattagccgggcgtggtggcgggcgcctgtaatcccagcttctcaggaggctgaggcagaggaattgcttgcac

SEQ ID NO: 90088 - DNA, 601 bp, Human
aaagccaatcacaggctgggcgtggtggctcatacctgtagtcccagcactttgggaggccgaggcaggcggatcacttgtgctcaggagttccagaccagcctggccaacatggtgaaaccctgtctctactgagaaaatacaaaaattagccgggcgtggtggcgggcgcctgtaatcccagcttctcaggaggctgaggcagaggaattgcttgcacccaggaggcagaggttgcagtaagccaagatcacaccactgcgctccagcctgggcgacagagagaaaaagaaacttgtcrgcgttctagattgaccagttttcctcaaggtcaggtagttaggaagaaagagtgcagtttgcagttgtgaaaagtctgataatggattctttttttcttttttatgcgtgaagggattctggagtacgtctggtctaaaggccgatttcgttttaggaactttggatcagaacagtcatactagtcctcagagaaaaaatggttttcaatctggttcttcaaatttcttgttcatataaccaagccatgcttgttcctatgatggagaacaattgtgctttaaaaaaagaaatttcaggg

SEQ ID NO: 90089 - DNA, 601 bp, Human
tcctttctctatatatcagataaaaaatacttgggttttttcccagaagtgtccttatggaatcatttggcatctacaacccagtgcttgcttgtcatgggtaccccaagtgttaacctgtcaggaaggaggtaattcaacaggtaaaccagtggccaggccttgggtccacatttcattttccttttctcagcctagttctgcatttactcatctacagagggaaataatgacggaacctgtcctacacgatgacgatgaggaagactccaaagttcctagacccctattaaaaatatayattttttgaaatacagactcacaggggatttcaaaaacagtacctggagtctcatggacccttcagccaacttccccatggtgacgtcttcatatccgtgggacaatatcagaaccatgtcatcgatgttggtatatccttattaaagagaacacatacctcgttcagcttttttttttttttttttttgagacagggtctcactctgttgcccagtctggagtgcagtggtgcgatctcggctcactccagccttgaactcctgggctcaagcaatcctcctgccttggcctcccaaag

SEQ ID NO: 90090 - DNA, 601 bp, Human
tcagcctagttctgcatttactcatctacagagggaaataatgacggaacctgtcctacacgatgacgatgaggaagactccaaagttcctagacccctattaaaaatatatattttttgaaatacagactcacaggggatttcaaaaacagtacctggagtctcatggacccttcagccaacttccccatggtgacgtcttcatatccgtgggacaatatcagaaccatgtcatcgatgttggtatatccttattaaagagaacacatacctcgttcagcttttttttttttttttttttgagacagggtctcactctgttgcccagtctggagtgcagtggtgcgatctcggctcactccagccttgaactcctgggctcaagcaatcctcctgccttggcctcccaaagtgctgggactatatacaggcatgagccatcgtgcccggcttgttcaggctttattagttttcaaaaggtgctcatttgtgtttgcgagtgtgtgtgtagagttctgtgcagttttacccagtgtgtggatttggcagctaccaccctccaaaccatggtgcaggatgaattccctcaccacagaacacc

SEQ ID NO: 90091 - DNA, 601 bp, Human
catccaaagaacagacccggcacttagtgtgtgcccaagaccatccaccgcatgaatagagaaatcaaccctcctcatgtgcctggggtttcctgaggtgggaaaccttcagtgctagctgggagagtcgcaggcagagacagggacaagctggtcactctgtgtgtgaataaataaatgaatggatgatggcattatcggcagttgttctttatgacactcactgatgccaagtactggacgggtacaatatgtacattagtttctctatgggcagaagctccaccatgacaacattagygttattttctttttgcttttttgtttagagacagggtcttactctgtcgcccaggctggggtgccgtggtgcaatcaacagctcactgcagcctcgacctcccaggctcaagcaatcttcccacctcagtctcccaagtagctgggactgcagacgtgcaccaccacactcagctaatttatgtatttatttttgtagagatgggcattgctatgttgcccaggctggtctcgagctcctgggctcaagtgatcctcccgcctcagcctcccacgtagctgggactacaggtgcatccac

SEQ ID NO: 90092 - DNA, 601 bp, Human
cgcatgaatagagaaatcaaccctcctcatgtgcctggggtttcctgaggtgggaaaccttcagtgctagctgggagagtcgcaggcagagacagggacaagctggtcactctgtgtgtgaataaataaatgaatggatgatggcattatcggcagttgttctttatgacactcactgatgccaagtactggacgggtacaatatgtacattagtttctctatgggcagaagctccaccatgacaacattagtgttattttctttttgcttttttgtttagagacagggtcttactctgtygcccaggctggggtgccgtggtgcaatcaacagctcactgcagcctcgacctcccaggctcaagcaatcttcccacctcagtctcccaagtagctgggactgcagacgtgcaccaccacactcagctaatttatgtatttatttttgtagagatgggcattgctatgttgcccaggctggtctcgagctcctgggctcaagtgatcctcccgcctcagcctcccacgtagctgggactacaggtgcatccaccatgcttgtagccttattttcttaatgggaaagagggtctgagagaag

SEQ ID NO: 90093 - DNA, 601 bp, Human
tgctatgttgcccaggctggtctcgagctcctgggctcaagtgatcctcccgcctcagcctcccacgtagctgggactacaggtgcatccaccatgcttgtagccttattttcttaatgggaaagagggtctgagagaagggatgctgtgtgcccaatgggtttcgcctgcagcacgctgcctcctccccgggaaagcagggcgtgcacattgggattggacgacaaaagcagagtcatctacagttcatgggcacgctgcaaagaagggagacgttaaactctcgaaagcagcagacacsccccaccaggaagagacatacttgtaaaaatcaaaggagggcgaaggcatgagaatcgcttgagcccaggaggttgaggttgcagtgggctgagatcgtgctactgcattccagcctgggtgacagagaccttgtctcaaaaaataaaaattcaagggaggccaggtgtggaggctcacgcctgtacccagcactttgggactctgaggtgggaggatcacttgagcccaagagctcaagatctgtctggacaatatagcactaccccatcgctacaaaaaaaaatttttttaagtagct

SEQ ID NO: 90094 - DNA, 601 bp, Human
ttggtttgggtgggatttggccagcttctttaccgcaacctgttttatcagcaagctccttatgaccggcatcttgtgctgacctcctatctcatcccgtgacttagaatgccttaaccatctgggcatgcagcccaacaggcttcagcttcattttacccagctcctcttcaagatggagttgctctggttcagatgccgctgacagaactagcttatggttggagacaatgtcatagggaattattcttcaaagatcgcaaaatccagcttggatgagattccaaaaatcaaaaggtgytgagaaagcaacttgtctagaatttcctcttcatgggctggttgattttgtttacaatgacaccttcagaaaaagtaggcgacacacagtggctcacgcctataatcctagtgctttgggaggtcaaggagggagaatcatttgaggctagcagttctagactagcctggacaacatagtgagaccttgtctttacaaaaaataaaatcagccgtgtgtggtggcgcatacctataatcccagctgttcaggaggctgaggcaggaggatcatttgagcccaggagttggaggctgcagt

SEQ ID NO: 90095 - DNA, 601 bp, Human
aggaaaactgttaggaaactccatcccttttgaccttcaaaggtcaccgcctaattttggtgttttgtagtctgatgtgttcatagcttgtgactattaggctctgattgagctctgcttttttttaagtttctcttactcagctggtgctgttttagctccagcttcctcctctgtgtaatcaacactcccagtctcctcttcacccaaaaagccacagaaataagtgcagaaaacaaggcagccgccacctgctacagaggcatgtccttaaatacgatgcatttcaggacagctgtgygagttccgggagcttgtcttccttcaaagggaaaagtaaaaataaacaggaaggttgcactgaaagcattctcaattgaaattgtgccatttggctgtagtgtttctgatgctcatttagaactttggaagttgtgggatggtgggcaagtgtgtgacctgggatggagattctctacctctttaagagtgaaaccctggctgggcgccgtggctcactcctgtcatcccagcactttgggaggccaaggcgggtggatcacctgaggtcaggagtttgagaccatcctggccataatgg

SEQ ID NO: 90096 - DNA, 601 bp, Human
tttctgcatctcccagctcctgggggctccaggcatccctgggcttgtggctgtatcactccagtctgcctccgtctccatgtggccttctcctctgtgtctgtgtctcctcatctggctctttatttttttaaattatttatttatttatttattttttattttttttggtgacggagtttcgctcttttgcccaggctggagtgcagtggcatcatctcggctcactgtaacctctgcctcccgggttcaaatgattctcctgcctcagcctcctcagtagctgggattataggcaccygacaccacgcctggcttattttttatgtttttagtggagacgggatttcaccatgttggccaggctggtctcgaactcctgtcctcaggtgatccgcccgccttggcctcccaaagtgctgggattacaggtgtgagccaccatgctcactggccattttttattattactcttttttcctcttctgtctcttagaaggacacccgttgttggatttaggtcccaccctaaatccaggatggccttatctggagattgtttacttaatagaaactacaaagaccctattttcttttcttt

SEQ ID NO: 90097 - DNA, 601 bp, Human
tctctactagaaatacaaaaaattagccaggcgtggtggtgggtgcctgtagtcccagctactcaggaggctgaggcaggagaatggcgtgaacctgggagacggagcttgcagtgagctgagatcgcgccactgcactccagcctgggtgacagagcgagactccgtctcaaaaaaaaaaaaaaaaaagttcagttgcttactctccatagcctcaattcaaatcctcagtagccacttgtgagcttgtggctaccattttggacagtgcagatagagaacattcctatcattgcaggcratactacgggcagtgcttgctccaaaacagggggtctcaactgggggccggccttcccccacagggcacttgacagtgtctggggacagttgtggttgtcactactgggggtggatgctgatggcgtgtggtgagtggagcccagggacgccgctctgcaggtttgcagtgcacaggatggccctacagagaatcatccagcctcaaatgtcggcagtgctaggctgagagaacctgctttagcgtgagagtcagtctctctctttctgtctctctctctctctccccctctctcccctc

SEQ ID NO: 90098 - DNA, 601 bp, Human
aaattagccaggcgtggtggtgggtgcctgtagtcccagctactcaggaggctgaggcaggagaatggcgtgaacctgggagacggagcttgcagtgagctgagatcgcgccactgcactccagcctgggtgacagagcgagactccgtctcaaaaaaaaaaaaaaaaaagttcagttgcttactctccatagcctcaattcaaatcctcagtagccacttgtgagcttgtggctaccattttggacagtgcagatagagaacattcctatcattgcaggcgatactacgggcagtgcttkctccaaaacagggggtctcaactgggggccggccttcccccacagggcacttgacagtgtctggggacagttgtggttgtcactactgggggtggatgctgatggcgtgtggtgagtggagcccagggacgccgctctgcaggtttgcagtgcacaggatggccctacagagaatcatccagcctcaaatgtcggcagtgctaggctgagagaacctgctttagcgtgagagtcagtctctctctttctgtctctctctctctctccccctctctcccctccccactctcgctctccctc

SEQ ID NO: 90099 - DNA, 601 bp, Human
acctgtgcagaatttgccctctccttccacccaggtgcccatattaatgtgtcttgtatatttctccaaagtcctttctcaatatagaagcaaattatcacttatggagaagagcctcactttttttttttttttttaaacagatgggggtcccgctcttttgcccaggctggaatgcagtggtactatcataattcactgcagcctccaactcccgggctcaagcaattctcccatctctgcctcatgagtagctgggactactggagcataccaccacacccggctcattaaaaaaaawtttttttttttatagatggtgtctggctatgttgcccaggctagtctcgatctcctgggctcaagtgatccttctgcttcagccttctaaagtgctgggattacaggcatgagccactgctcctggcctccacccatctataggtgtggaacaagagcatgttccctcccaagctaatgtggcaggtaactggcctcccaggctgtagacaagatggatgggggctgtgcccacttcttgagttaaccttttttttttctttggagacagagtctcgctctgtcgcccaggctggaatgc

SEQ ID NO: 90100 - DNA, 601 bp, Human
cctgtgcagaatttgccctctccttccacccaggtgcccatattaatgtgtcttgtatatttctccaaagtcctttctcaatatagaagcaaattatcacttatggagaagagcctcactttttttttttttttttaaacagatgggggtcccgctcttttgcccaggctggaatgcagtggtactatcataattcactgcagcctccaactcccgggctcaagcaattctcccatctctgcctcatgagtagctgggactactggagcataccaccacacccggctcattaaaaaaaatwttttttttttatagatggtgtctggctatgttgcccaggctagtctcgatctcctgggctcaagtgatccttctgcttcagccttctaaagtgctgggattacaggcatgagccactgctcctggcctccacccatctataggtgtggaacaagagcatgttccctcccaagctaatgtggcaggtaactggcctcccaggctgtagacaagatggatgggggctgtgcccacttcttgagttaaccttttttttttctttggagacagagtctcgctctgtcgcccaggctggaatgca

SEQ ID NO: 90101 - DNA, 601 bp, Human
gtgcagaatttgccctctccttccacccaggtgcccatattaatgtgtcttgtatatttctccaaagtcctttctcaatatagaagcaaattatcacttatggagaagagcctcactttttttttttttttttaaacagatgggggtcccgctcttttgcccaggctggaatgcagtggtactatcataattcactgcagcctccaactcccgggctcaagcaattctcccatctctgcctcatgagtagctgggactactggagcataccaccacacccggctcattaaaaaaaattttytttttttatagatggtgtctggctatgttgcccaggctagtctcgatctcctgggctcaagtgatccttctgcttcagccttctaaagtgctgggattacaggcatgagccactgctcctggcctccacccatctataggtgtggaacaagagcatgttccctcccaagctaatgtggcaggtaactggcctcccaggctgtagacaagatggatgggggctgtgcccacttcttgagttaaccttttttttttctttggagacagagtctcgctctgtcgcccaggctggaatgcagtg

SEQ ID NO: 90102 - DNA, 601 bp, Human
gactggcatttacagtttattaaggcacttacctcttaggtgtataatcctcaaaacatctaaaaaattagtgatttttgttatccaagttactttgacatcagccatttgctgtctcacccacatgatttctcattatgttaccttattattggctaagttaatctgcttactgaggacctgcatgtgacttttcccattaaaagtaagttaagtctgggcgcagtggctcatgcctgtaattctagcactttgggaggctgaggtgggaggatcccttgactttgagaccagcctgggygaaaaagtgagatctcaaaaacaaaattagccagacatggtggcgcatgcctgtagtaccagctacttgggaggctgaggtgggctgatggcttgagcccaggagtttatgctgcagtgagccgagattgcatcactgcactctagcctgtggcacagagtgagacctgtctcttaaaaaaaattaattaattaattaaaaataaataaaagtaagtccaagtggagatggttggtggtgttggttggataacattgtgaatgtatttaacaccgttaatctgtacacttcaaaatggtt

SEQ ID NO: 90103 - DNA, 601 bp, Human
ttgagagggggtcttgctctgtctcccaggctggagtgcagtggtgcagtcatggcactcattgcagcctctacctcctgggctcaagagatcctccctgctcagcctcctgcgtaactgggaccacagatgtgcgccaccatgcccagctaatttttaaattttttgtagagacagggtttcaccatgttgcctgggctggtcttggacgcctgggctccagtgatccacctgccttggccttccaaagtgctgggattacagacatgcgccaccgagcctggttttgcttactttttctttttttttttaaattcctcttagcctatcttgggggaggcgggtcagtgttattccggtgtacatacaacaaaatcacccatttgaagtgcacactgggaggagtccttgccaaatggatagggctgggtaaccactgccacatgggacatttgggaagccgatgtttgaatgttttcacgcttacagatgcattcatttactacgtttattattctgtgtgatgtgctttctgtgtgttatttcacttaaacccagtgggggtaaagattatgatccctatttggtagatgaattttag

SEQ ID NO: 90104 - DNA, 601 bp, Human
ttcaagacattctcatgcctttggagtagctgggattacaggtacccgccaccatgcctggctaatttttttgtatttttagtagaggctggggtctcactgtgttgtccaggctgatctcaaactcctgggctcaagcgatcctcccatgttggcctcccaaagcactgggattacaggtgtgagctactgtgcccggcctatttcttttctaaatagaggcagggtctcactatgttgccctggctggtctcaacctcctgggctcaagcaatcctcctgcttcggcctcttgagcagytgggactccaggtgcacacaaccatgcctggctaatttttgtattttttcgtagagatagggatctcaccatgttgcccaggctggtcgggaattcctgggctcaagcagtcctctgacctcagccttccagtgtgctgggattacaggtgtgcaccactgtgcctggccttatttattttttatttatttatttttggagacagggtttcattctgttgcccagactgcagtgcggtggcaaccatagctcactgcagcctccacctcctgggctcaagtgatcctcccacttcagcct

SEQ ID NO: 90105 - DNA, 601 bp, Human
ccagacagaaagctgggatgtggccaggtgcagtggctcatgcctgtactcctagcactttgggaggccgaggtgggtggatcacttgaggtcaggagtttgagaccagcctggccaacatggtgaaaccctgtcactactaaaaatacaaaaattagccaggcggggtggcgggcaccggtaatcccagctactttggaggctgaggcaggagaatcgcttgaacccaggaggcagaggttgcagtgaactgagattgcgccattgcactccagcctgggcgacagagtgagactctgtaacaacaacaacaacaacaacaacaacaacaacaggccaggatgtgtttgtgtgtgagttggacccaagggcttgggaaggatggatagggtaggggaggagggatagatggatgagggaatgcagagagagtggccacactgtcagaggctttcaaaaagcaggaggttctccagtgggagagaggagacctgagtccaccccgcattaatgtttacagatcagaattgcacacatagaatggctcataaatctgatccaccttcctcgtctggcacttggctggagaaacaactctttg

SEQ ID NO: 90106 - DNA, 601 bp, Human
agtggccatagtcaaacacctaaactgtatcagttcacagtcctcaaagcccttctcccacttcctgtctttgacctgattccacctaattttgtccacaccatgttgtactgtaataaaacctattttatttccaaattaactaagagaatatactttaaaaatgtgttactatttcattatttgtttactttttttaaagaaatatttaacacctgtcagctattgacattgtttccttcttacactttttctttatcttgtagttcactttctatttctgccataataaaatattcaktatcggaaacttcacttaaaaagcaaaggttacttctcctcctcccttcccagtctgccctataagctagtaaattcatcattcattagcttagatattttacaacatggggattttagtttacagcaaatactctaagtaaaattggtagcttaagtacaactttttcttttcacgttaccatgtgcaatcaatggcattccagactcttggaaggaaatccattgtatggttgtggtctttttttttccttctcaaaccagtcaaaaatacccagtcacaatttaaaaaattatccgc

SEQ ID NO: 90107 - DNA, 601 bp, Human
tttctttatcttgtagttcactttctatttctgccataataaaatattcagtatcggaaacttcacttaaaaagcaaaggttacttctcctcctcccttcccagtctgccctataagctagtaaattcatcattcattagcttagatattttacaacatggggattttagtttacagcaaatactctaagtaaaattggtagcttaagtacaactttttcttttcacgttaccatgtgcaatcaatggcattccagactcttggaaggaaatccattgtatggttgtggtctttttttttycttctcaaaccagtcaaaaatacccagtcacaatttaaaaaattatccgcccttggtggtgcacgcctgtagtcccaactatttgggctgaggtgggagggtcacttgagcctggcaggtcaaggctgcagtgagctattgattgtgccattgcacttcagcctgggcaacagagagagaccctgtctcaaaaaaaaaaaaaaaaaaagacaaaacaatataatgtgatctaccctctaagcaaattttcatatatacaattttactattgtatatgtgagctatttatatataaaattt

SEQ ID NO: 90108 - DNA, 601 bp, Human
aaagacaaaacaatataatgtgatctaccctctaagcaaattttcatatatacaattttactattgtatatgtgagctatttatatataaaatttcatttatcagttcagtattgttaactatatgaactaggtgtatggtagatctccatggtttatcttgttcaactaaaactttgtatcctttgaccaatatatttccccttccccctcaagccctaccctctgataactacctctctactctctgcttctatgagtttgactattgtagattctgcattagtccattctcatgctgytaatgaagacatacctgagactggttaatttataaaggaaagaggtttaatggactcacagttccacatggctgcggaggttccgacagtcatggcagaaggtaaaaggaggagcaaagtcacgtcttacatgacagcaggcaagaagagagcccgagcagggaaactcccatttattaaaacatctgatctcgtgagacttattcactatcaggaggacagcatgggaaaacccacccccatgattcagttacctcccacctggtctctcccacaacacgtggggattatgggagccac

SEQ ID NO: 90109 - DNA, 601 bp, Human
ttagtccattctcatgctgttaatgaagacatacctgagactggttaatttataaaggaaagaggtttaatggactcacagttccacatggctgcggaggttccgacagtcatggcagaaggtaaaaggaggagcaaagtcacgtcttacatgacagcaggcaagaagagagcccgagcagggaaactcccatttattaaaacatctgatctcgtgagacttattcactatcaggaggacagcatgggaaaacccacccccatgattcagttacctcccacctggtctctcccacaacacrtggggattatgggagccacacttcaagattagacttgggtggggacacagccaagccatgtcagattccttgtataagtgagatcatgcaatatttaatatttgtttttctgtgcctatcttatttcactgaacataatggcctccagttccatccatgttgctgcaaatgccagagtttccttcttttttagggctgaatggtattccatcgtgtatatgtaccatgttttctttatccatttgcccttggacggacactgaggttgtttccacgccttggctgttgtgaatagtgctg

SEQ ID NO: 90110 - DNA, 601 bp, Human
tctcccaggccacccttctttgacaggcctccttctttgctctcatcattgtccttcacttcccccatctaagaaacacctacctgttttccctcattcacctgctgtccccgggacacagggtgcctcccatcatgttcttgaagcacctcgtgtgtactggaacaagtgcacctgccttctcctctagacccaatgctgcctaagctccgaacaaaatcatatgcagaggatgggcgcggtggctcccttcctcccttcctttcttcctttctgcatttctctttctttcttgacaggktctcactccttcttgcccaggctggaattcagtggcacaatcatggcccactgcagcctctgccgcctcccaactagttgagactacaggtatatgccaccatgcctgaccaacttttaaaagtttttgtaggatgaagtcttgctgtgttgcccaggctggtctcaaactcctggcctgaagcagtcctccagcctcagcctcccaaagtgctgggattgcaggtgtcagcccctgcacctggactgagaatgcatgtctgttgtctgccgcgtccctccaccccaacccccagtttgt

SEQ ID NO: 90111 - DNA, 601 bp, Human
agaacagagctttagttaggtagttctcctttcttcaaggcaggatagctcaagactgttttccttggcagataaggtgcattcctgcagggacgtggattctgattttgatattccctgctttcaattaaggaacaaagtcgtttatatttcttaagtcttatataaagccctagagactttagaaattctattcaaagttacctatgttggtttatttttatcttttatataaaaaagtatatatatagatttacatttagagacgggttttgctctgtggcccatcttggagtgcaayggtgcaatcacagctcactgcggccccaacctcccgggcttaagccatcctccttcctcagcctccagagtagccgggactacaggcacccatcactacaccctgctaatgtttttatttatttttaatttttaaaaaacatatgtatatatttttcacaacctctttggtgaagataatgtttttgttttttctctatgaacagggtcttgctatgttgcccaggctggtcttgaactttaggctgcaagcaatccacttgccttggcctcctgacatgctgggattacaggtgtgcac

SEQ ID NO: 90112 - DNA, 601 bp, Human
acttggaaggcaagaggtctctccactccgggccacatccttctagttcctggatgaccgctcgtttctccatggagaggagttcatgccagaacctcttcttcggggagagtggatgcatctcttggaaacatctttttttaaagtctgcagacttgagtgtggtccccattgtcattggtacttgttgggggtaggagtaaaatcattcctttgttttactgagagttcaggaagaaagaacaccatgttctctccttttatttatttatttattttgctctctatttgaattttaaargcaaaaatctagaaatagcgcttcttgctctgtcatcactgcctgcaaagcacagagaccagagtgaaggcaggcagctcctgggtcttctcttcctcttctttgtccaaaaaatgatacattgcatgtttagtatttggggcaaagcagacgcttcaaaaagggaggcttattttattatctatatttttcttttttattattttttaccttgattccctttttctatgtatgaaaagggaggtttaagttcttgcaagagaatgcaactgtagtgtcttctgaatggagttttccatt

SEQ ID NO: 90113 - DNA, 601 bp, Human
tcctcagctacttgggaggctgaggcaggagaacggcatgaacctgggaggcagagtttgcagtgagccaagatcgcaccactgcactccagcctgagtaacagagcgagactctgtctcaaaaaaaaaaaaaaaaaaaatgtacagttcactactcgggaggctgaggcaggaggatcacttcaacccaggaggcggagattgcagtgagctgagattgtgtcgctgcactctatcctgggcaacagagtaagactctgtctcaaaaaaaaaaaacagaaaacaaaaaaaacaaaacacwgtttagtggcatggagcacattcatgtttctgtgcaaccgccaccccatccccatccccatccccatccatctccagaactccttttcatcttccccaactgaaactctgtcctcatgaaacacgccttattgcccctccctccagccctgccctggcaacctccctcgtactctctgctctatgaatttggtgattctaggagccttatataggcagaatcatacggcatttgtccttttgcgactggcttctttcagttactgtaatgtccttcagattcccccgtcctgtagaaagg

SEQ ID NO: 90114 - DNA, 601 bp, Human
aaaaaaaaaaaacagaaaacaaaaaaaacaaaacactgtttagtggcatggagcacattcatgtttctgtgcaaccgccaccccatccccatccccatccccatccatctccagaactccttttcatcttccccaactgaaactctgtcctcatgaaacacgccttattgcccctccctccagccctgccctggcaacctccctcgtactctctgctctatgaatttggtgattctaggagccttatataggcagaatcatacggcatttgtccttttgcgactggcttctttcagttacygtaatgtccttcagattcccccgtcctgtagaaaggaatttccctcctttctaagcctgagtactattccatcgtatagaggatacagcatgttgtgtttacccattcattcatccttggacactggggtgccttccacctcttggctgtagtgaataatgctgctatgaacaaggtttggcaaatatctgtccagtgcctgatttcagctgcttgaatacattgttttaatttattattattattttttagagatggagtctcgctctgtcaccccagctggagtgcagtgttgtgatc

SEQ ID NO: 90115 - DNA, 601 bp, Human
tttgcacttccccatttcataggtggtccttccagctcttggggctcacccaggaaccattttttattccttttctttgactctgcattcactgtaatcctgagtcctgcccttttaacttttttttttttttttttttttaagagatgtggtcttgccgtctcatccaggctggagtgcagtggtgcaatcatggctcactgcatccttgacctcctgggctcaagagatcctcccacctcagcctcccaagtagctgggaccacaagtgcacaccactatgtccagctaattgaatttktgtgtgtgtgtgtgtgtgtgtgtgtgtgtgtgtgtgtgtgtgtgtagggacaagatctcactgtgttgctcaggctggtctcaaactcataatttcaagcatttcccctgcctcagcctcctaagtagctaggattataggtgcacaccgccatgccttgcccctttccaattctcaaacacatctccagagcccatccacatcaatgatgtcttcacagaagctgccatagcttatctaaattccctccccttctctccactgatctctgatctctgctgaactcaccccttcctgctg

SEQ ID NO: 90116 - DNA, 601 bp, Human
cactgtaatcctgagtcctgcccttttaacttttttttttttttttttttttaagagatgtggtcttgccgtctcatccaggctggagtgcagtggtgcaatcatggctcactgcatccttgacctcctgggctcaagagatcctcccacctcagcctcccaagtagctgggaccacaagtgcacaccactatgtccagctaattgaatttttgtgtgtgtgtgtgtgtgtgtgtgtgtgtgtgtgtgtgtgtgtgtagggacaagatctcactgtgttgctcaggctggtctcaaactcrtaatttcaagcatttcccctgcctcagcctcctaagtagctaggattataggtgcacaccgccatgccttgcccctttccaattctcaaacacatctccagagcccatccacatcaatgatgtcttcacagaagctgccatagcttatctaaattccctccccttctctccactgatctctgatctctgctgaactcaccccttcctgctgtatcagcccaaacgtttctgatgtgaaaataggcagggcgtagtggctcatgcctataatctcagcactgtcagaggctgaggtgagag

SEQ ID NO: 90117 - DNA, 601 bp, Human
aatttttaatttttttttttttttttttttgagatggagtctcactctgtcccccaggctggagtgcagtggtgtgatcttggttcactgcaagctccgcctcccaggttcacgccattctcctgcctcagcctcccaagtagctgggactacaggcgcccgccaccacatccagctaatactttgtatttttagtagagatggggtttcaccatgttagccaggatggtctcgatctcctgacctcgtgatccacctaccttggcctcccaaagtgctgggattacaggcatgagccacygcgcctggccctaatttttaattttttgtagagacgtgatcttgctttgttgcctaggctggttttgagctcctgggctcaagcgatctgccaccttggccccgcaaagtgccggaattacagacgtgagccaccgcacctggcctccagctcttttgtgtccctccccaatcttcctttggccttcagctgtggggacagagatgccccctgcctccctgtccccaccttctacctggtcttacaggaccccctccagccatccttccaagtttactatgtaatgtctgttccacatca

SEQ ID NO: 90118 - DNA, 601 bp, Human
caccacatccagctaatactttgtatttttagtagagatggggtttcaccatgttagccaggatggtctcgatctcctgacctcgtgatccacctaccttggcctcccaaagtgctgggattacaggcatgagccactgcgcctggccctaatttttaattttttgtagagacgtgatcttgctttgttgcctaggctggttttgagctcctgggctcaagcgatctgccaccttggccccgcaaagtgccggaattacagacgtgagccaccgcacctggcctccagctcttttgtgtcyctccccaatcttcctttggccttcagctgtggggacagagatgccccctgcctccctgtccccaccttctacctggtcttacaggaccccctccagccatccttccaagtttactatgtaatgtctgttccacatcaagcctgcaaagctcatgacagtcacaagatctgccgttcctgatactatgtaccgagaacattacttggcacataaggggcccttgtccaaaacatttggaaaccaataaagaatgtggctggtgagttactgattaatgtgttgatgaattcattgattgct

SEQ ID NO: 90119 - DNA, 601 bp, Human
gatgcattggtttctaattttctaagctcagatttgaaatcacctgtggtcactaaactcgtcctatcccacagcccctgcacatgatgacttaagttttgtgaatgttttttggagatagtaaagtcagtatctctttcaacattttgttccttatctttagtgatacccagctctgtacaaattctgtccacgtaagcaaagtctttttttttttttccagatagggtctggctctgtcactgaggctggagtgcagaggttcagtcatagcttcaactcctgggctcaggctgtcctsctgcctcagcctcttaagtacctgggactacaggcctgcacaaccacacctagctaatctttttattttttgcagagacagagtctccctattttgcccaggctagtctcaaactcttggtctcaagtgatcctcctgcctcagtttcccaaagtgctgggattacaggtgtgagccaccacactcgcctgcaaagtcttactgataaaagatttgaaggaaggatgtgtcagagaacttcttttttcttataatatttacttaatcttattggtttggggaagggcaagagaatcccag

SEQ ID NO: 90120 - DNA, 601 bp, Human
cacctgctcacacacacgtgcacttatttttttctgttatctatatttctattatgtatatatatatttccactatatatgtatattaaatagaaatatatataatactatattattgtatataacatatagtatattttatgtacatatgatatagtattatatatgtatagtatatattatactatatattatatagtatacaatgactatgatatagtatcatataggtatactatatattataatatataatatatattatatagcatacctatatcatactatatcatacatatcmctatactctatatagtatatattatacgtattatatattacacatactacatatatatattatatagtatattatactatataatatatataatatatatattacatagtatataatatatatagtatatatcacatagtatataatatatataatatatatatcacatagtatataatatatattatatatatcacatagtatataatatatattatatatatcacatagtatataatatatataatatatatatcacatagtatataatatataatatatatatcacatagtatataa

SEQ ID NO: 90121 - DNA, 601 bp, Human
ttcccatatagtcacattctgaagttctgggggttaggactgcagcatataaggtttaagggatacatttcagcctggaacaagtatatatagatatgtttccgtacacacacatactccattgaggagaaaacagttatccttttttgtttgtttttttgtttttttttgggacgaagtctcgctctgtcgtccaggctggagtgcagtggcacaatctcggctcactgcaacctccgcctcccagattcaagtgattctcctgcctcagcctcccaagtagctgggattacaggtgccygccaccaggcctagctaacttttttttttttttttgagatggagtctggctctgtcgcccaggctggagtatagtggcatgatctcagctcactgcaagctctgcctcccgagttcacgccattctcctgcctcagccccccaagtagctgggactacgggcgcccgccaccacgcccggctaattttttgtatttttagtagagacgggatttcactgtgttagccaggatggtctcaatctcctgaccttgtgatgcgcccaccttggcatcccaaagtgctaggattacaggtgtga

SEQ ID NO: 90122 - DNA, 601 bp, Human
ttccatacttagctctaacctgcagatagagagtaagtcccttccacatgcttccatgggaggagaactcaatttctctccttgtcttctttcctggtttcctgatttatatctgctacatcctgcagtaattttttttttttttttttttttttgagacagtgtcttgctctgttgctcaggctggagtacagtgacactatcatgctccctgcagtgttgacctcctgggctcaagtgatccttccatctcagcctcccgactagctgagactacaagtgcacttcagcacacctggctttttttttttttttttttttgtaaaggagtggtcttgctgtgttgtccaagctggtctgaaactcctagcctaaagcaatcctcctgcctcaacctcccaaagtactaggattacaggtgtgaactaccatgcctgaccttgtggtacttttatttcatggatggccgacagaatttgaaatttggatggcagccagtttgttgttatcccaagggcttacagattagtgtggaaaagtctgttgtctggaaagagatggggtatggaggtgtggtggggaagggaaggaaagataacag

SEQ ID NO: 90123 - DNA, 601 bp, Human
cttccacatgcttccatgggaggagaactcaatttctctccttgtcttctttcctggtttcctgatttatatctgctacatcctgcagtaattttttttttttttttttttttttgagacagtgtcttgctctgttgctcaggctggagtacagtgacactatcatgctccctgcagtgttgacctcctgggctcaagtgatccttccatctcagcctcccgactagctgagactacaagtgcacttcagcacacctggctttttttttttttttttttttgtaaaggagtggtcttgctrtgttgtccaagctggtctgaaactcctagcctaaagcaatcctcctgcctcaacctcccaaagtactaggattacaggtgtgaactaccatgcctgaccttgtggtacttttatttcatggatggccgacagaatttgaaatttggatggcagccagtttgttgttatcccaagggcttacagattagtgtggaaaagtctgttgtctggaaagagatggggtatggaggtgtggtggggaagggaaggaaagataacagtaacaacattttgggtgggttcctgcaagcaggaagctga

SEQ ID NO: 90124 - DNA, 601 bp, Human
acctccctacctatccatctatcaatcatctatctacctattcatctatctgcttttctatatatctatgtatttatcaatcatctacttacctacctatccctctatctctacctttctgtctatctagctatcaataatctacctacctaccggcctgttggtcttttgaattttccattactctttgctgagacatgcctacaagtcatatagaaccaaacttctcaatatgcaccctagcccattatgtcctaggcaaacccaaaaggttaaaaataacttaggcatattgatcagygtccacccaaggaaaagcaccacattttccttcggtgataacactgaccacacgagggcagcattgcctgaggatcgttgtatcctgtagtctaatggttttaaatagagtgaggttcgtgtgccccaaattttattgattctaggatagagtagactattattagaatacaatatactattaggacataatattgttagaatacaacatagaattattagactataattaaaacagaatattagtctcagggtacgctgaagttaaaaatacataaaaatacatttaaaaagaatagaa

SEQ ID NO: 90125 - DNA, 601 bp, Human
ggtgtcttgagagttaccagcttcgccgaccccaactctcccaggcattcctgtgctcttccccagctccagccggcctgagctcgcctggaccaccccaagccttctcagtctcctgcatcccctcctgcctgcagtacattttcctggaagcagctgcaggcatcctgtccacgtacccatcagctgtgtccctattccctgggagcccgcttgttgcttcccggatgactggagcagaatcggaggctcgttatcatatgaggttctgagacggtctgcctgtgggttgtccaccccycttagacaacagcctggcccctccttgtcttcccactgctttttaaacgtgccaggaagcctgacctgtccccctgcccaaaggctggcttccttcctccttcttttctttttccctttcctttccttccctttcctttcctccctccctccctctctccttccttcctctctccctccctctctctctctctctccttcctcccttccctttcccttcccttcttcctttccttttcctttcccgtctccctcttcctttcccctttcccttttcccctttcccctttttcctttcctt

SEQ ID NO: 90126 - DNA, 601 bp, Human
aggctcgttatcatatgaggttctgagacggtctgcctgtgggttgtccacccctcttagacaacagcctggcccctccttgtcttcccactgctttttaaacgtgccaggaagcctgacctgtccccctgcccaaaggctggcttccttcctccttcttttctttttccctttcctttccttccctttcctttcctccctccctccctctctccttccttcctctctccctccctctctctctctctctccttcctcccttccctttcccttcccttcttcctttccttttcctttcccstctccctcttcctttcccctttcccttttcccctttcccctttttcctttcctttcctttcatttcctttccttcttcctttcctttctgttccgcctcgctctgtcacccaggctggagtgcagtggcacaatcttggctcactgtaacctctgctttcttgtctcgctctgtcacccaggctggactgcagtggcgcaaatcttggttcactgcaacctctgcttcccaggttcaagcaattctccttcctcagcctcctgagtagctgggattacaggtgtgcgccaccacgcccag

SEQ ID NO: 90127 - DNA, 601 bp, Human
ggcacaatcttggctcactgtaacctctgctttcttgtctcgctctgtcacccaggctggactgcagtggcgcaaatcttggttcactgcaacctctgcttcccaggttcaagcaattctccttcctcagcctcctgagtagctgggattacaggtgtgcgccaccacgcccagctaatttttgtatttttagtagagagggggtttcaccatattggccaggctggcctcaaactcctgacctcaagtgatccacctgcttcggcctcccaaagtgctggggttacaggcgtgagccacyacacccagccagggctggccctttctcttccactgcacatgctgcaggctcacctgtcacctgctcccacagccctctggggcctcccctgttctcctgggccatgccctgtccgaccagcccatctgttttctttatactgattagcagctctgaaaccatctaaattttgtatgtgttgactgcctctgagagcaatgctcccaagctgctctcctcacctccttgaacccagaaacttctggtggctggagggagggcactgctgcacatacaagtggagccggcctgcagtcagag

SEQ ID NO: 90128 - DNA, 601 bp, Human
gcacaatcttggctcactgtaacctctgctttcttgtctcgctctgtcacccaggctggactgcagtggcgcaaatcttggttcactgcaacctctgcttcccaggttcaagcaattctccttcctcagcctcctgagtagctgggattacaggtgtgcgccaccacgcccagctaatttttgtatttttagtagagagggggtttcaccatattggccaggctggcctcaaactcctgacctcaagtgatccacctgcttcggcctcccaaagtgctggggttacaggcgtgagccaccrcacccagccagggctggccctttctcttccactgcacatgctgcaggctcacctgtcacctgctcccacagccctctggggcctcccctgttctcctgggccatgccctgtccgaccagcccatctgttttctttatactgattagcagctctgaaaccatctaaattttgtatgtgttgactgcctctgagagcaatgctcccaagctgctctcctcacctccttgaacccagaaacttctggtggctggagggagggcactgctgcacatacaagtggagccggcctgcagtcagagt

SEQ ID NO: 90129 - DNA, 601 bp, Human
gacagggtgcagaagatcctagagaaggtggaatttggctgcagtggagcctcttccacggggagcattaggcattgcgcagtggttctcaaacatgttggcctcgggaacccttcaacacacagctcaaagttattaacaacccacagaactttcatttctgtgtgttacagctgtccgcgctgactacatttgaaattaaagtagagactgaaatataaaccaacagaatacataaataatatatatgagaagttaaataatcagaggagaacataaatagcatttttaaatgaaaaaratgtgtaaccacactttctagaattaaaaccattcaggctggacatggtggctcacgcctgtaatcctagcacttcaggaggctgaggtgggaggatcacttgagcccaggagttggaggccagcctgggcaacatagtgagaccccatttctacaaaaaataaaatgaaataaataaaccaattagctgagcatgatggtacacgcccagggtcccagtactttgggaggctgaggtgggaggatcactgaggctgggaggtcaacgctgcggtgagctgtggtctcgtcactacactc

SEQ ID NO: 90130 - DNA, 601 bp, Human
gggagcattaggcattgcgcagtggttctcaaacatgttggcctcgggaacccttcaacacacagctcaaagttattaacaacccacagaactttcatttctgtgtgttacagctgtccgcgctgactacatttgaaattaaagtagagactgaaatataaaccaacagaatacataaataatatatatgagaagttaaataatcagaggagaacataaatagcatttttaaatgaaaaaaatgtgtaaccacactttctagaattaaaaccattcaggctggacatggtggctcacgccygtaatcctagcacttcaggaggctgaggtgggaggatcacttgagcccaggagttggaggccagcctgggcaacatagtgagaccccatttctacaaaaaataaaatgaaataaataaaccaattagctgagcatgatggtacacgcccagggtcccagtactttgggaggctgaggtgggaggatcactgaggctgggaggtcaacgctgcggtgagctgtggtctcgtcactacactccagcctgggtgacagagagaccctgtctctaaaaagagagaaaacatttgtgaggaggtt

SEQ ID NO: 90131 - DNA, 601 bp, Human
tttcaaggctgtatttgcatgtatttctgtctttttcctggtctccaggggtcaagaaatggttttcttggggcaaagagcttcggtcagctttgcagactacccagtctcagttacaagtacagactctgctcctgcaccttaaaaagtagtcacatagtgagaccgcatccctatagaaagtcaaaaaattagccagacatggtggcacacacctgtggtccccgctacatgggagcctgaggtgggaggatggcctcctgggggaggtcaaggctacagtgagctatgattgcaccastgcactccagcctgggtgacagagtcaaaccctgtctcaaaacaaaagaaaaatatgatatctcaggctctttcatttggcctgtacacatttattgagcacctgttgtgtgccacatactgttccatgaatgaggaatataaagaaattcagtaatgggtgtggtggctcacatctgtagtcccattactttggaaggctgaagtgggaggatcacttgagcccaagcgtttgagaccagcctgggcaacatagtgagaccttgtctctaccaaaaattaaaaaaaaaaaaaaaacaaa

SEQ ID NO: 90132 - DNA, 601 bp, Human; identical to SEQ ID NO: 31773

SEQ ID NO: 90133 - DNA, 601 bp, Human; identical to SEQ ID NO: 31772

SEQ ID NO: 90134 - DNA, 601 bp, Human; identical to SEQ ID NO: 31771

SEQ ID NO: 90135 - DNA, 601 bp, Human
cctacacacatgcacacataacacctacacacatgcatacagaacccacacatacatgcatccataggcacacagaaacacacctacacactgtgcacacctacatatgcacacacaaacccacatgaacatgcactgacacatatgcacacaaaaaacacactacacacacagaaacccacaaaatacacctccacacttacacaaaacacgcctacacatatgcacatacacaaacccacacatacatgcacctgcctatatgcacccacaacacatacacatatgcacacacagaacycacctacacaccccatacatgcacacaaaacccacaaatacatacatgtgcactgcaaatgcccaaatatacatgcacactcacacacacatacccctgtgacatatgcatgcacgcttcatttatacatgcaggagcatagcctggtcgtttgcacctgttgtggaactggacacacttccggtgttcacagggctcctgcgggttgttcttggacccctcgccacccaccgccaggtgcttcctgacggttgagagatgttgtatgcctttggtgctgaggagtggggacgctggatg

SEQ ID NO: 90136 - DNA, 601 bp, Human; identical to SEQ ID NO: 24972

SEQ ID NO: 90137 - DNA, 601 bp, Human
atcttattttcacagatgcacgtactttttttttttttatagaaagagcttccatgtgcgtgttcctcagtgtttagggagaagaaagcaacccttaaaatagaggaaaatgaagctgcttggattaccctgttgaagttcatctctgcctgtgccatgcatgaaaaaatactggcaaagtcttcacttacatgagtgttagactccatgttcccagtgggtctcggggttcagaactgagtgctctcatccaagcaataggagcgtcgacctcaggaaagcccaagtgttttgtgtgtaytttgaggagtgggttatctgttgcactgagcctctctgtgtattttcttcttcttttcagcagaacaaggggaggtggacatggagagccaccggaatgccaacgcagagccagctggtaagaaggacggggaacgatggcttgcacacgtggccagtgttcccattttatcttctccatcctctcccatcttgctgtcctgctcacattctcaaatttggttgcatggctttgaatgtcttcctttatgtctcgttgctttggagggatactttcaaaagacaatgaatgtgtaaactt

SEQ ID NO: 90138 - DNA, 601 bp, Human; identical to SEQ ID NO: 24973

SEQ ID NO: 90139 - DNA, 601 bp, Human
ccttccacacccataccttccacacctttgttccagctgttcccgccctcctccctgcctggggtgctcctccatccccggctctgcattccttagggccttccattgtgtgcacttagaccctgggatgagtcctctaaccgccgctaccggaccgtccatctatcccttgctgaatggcactggggtcatttctctgtctccagctcctggcccagtgccatgcacaaagccagccctcaggagcgactccgatgctgtgtccctgtcctcggtaaggctctccccacccgagagagcrgagactgtgggaagtaggctgagagggagccttcagttacatcacccctcaaaaggcacaggcctcacctgtatggcctcacctctctcaggcaggatggggatgggggcagctgtggagcgggtgtgcatggcagtgctgggaatggtggaaatgatggtctgggaggttgtggggggtggtgatgtggctgtgcgtctcccaccgtctgtcttcagtgacggtgttgtcattcctggacacgtgaaaagacaaggcggggtgtttcttacagtaacaaaacaggagagtcaaagagat

SEQ ID NO: 90140 - DNA, 601 bp, Human
cataccttccacacccataccttccacacccataccttccacacctttgttccagctgttcccgccctcctccctgcctggggtgctcctccatccccggctctgcattccttagggccttccattgtgtgcacttagaccctgggatgagtcctctaaccgccgctaccggaccgtccatctatcccttgctgaatggcactggggtcatttctctgtctccagctcctggcccagtgccatgcacaaagccagccctcaggagcgactccgatgctgtgtccctgtcctcggtaaggcyctccccacccgagagagcagagactgtgggaagtaggctgagagggagccttcagttacatcacccctcaaaaggcacaggcctcacctgtatggcctcacctctctcaggcaggatggggatgggggcagctgtggagcgggtgtgcatggcagtgctgggaatggtggaaatgatggtctgggaggttgtggggggtggtgatgtggctgtgcgtctcccaccgtctgtcttcagtgacggtgttgtcattcctggacacgtgaaaagacaaggcggggtgtttcttacagtaacaaa

SEQ ID NO: 90141 - DNA, 465 bp, Human
cataccttccgcacccataccttccgcacccataccttccgcacccataccttccgcacccataccttccacacccataccttccacagtcataccttccacacccataccttccacagtcataccttccacacccataccttccacacccataccttccacacycataccttccacggccataccttccacacccataccttccacacccataccttccacacctttgttccagctgttcccgccctcctccctgcctggggtgctcctccatccccggctctgcattccttagggccttccattgtgtgcacttagaccctgggatgagtcctctaaccgccgctaccggaccgtccatctatcccttgctgaatggcactggggtcatttctctgtctccagctcctggcccagtgccatgcacaaagccagccctcaggagcgactccgatgctgtgtccc

SEQ ID NO: 90142 - DNA, 464 bp, Human
cataccttccgcacccataccttccgcacccataccttccgcacccataccttccgcacccataccttccacacccataccttccacagtcataccttccacacccataccttccacagtcataccttccacacccataccttccacacccataccttccacasccataccttccacggccataccttccacacccataccttccacacccataccttccacacctttgttccagctgttcccgccctcctccctgcctggggtgctcctccatccccggctctgcattccttagggccttccattgtgtgcacttagaccctgggatgagtcctctaaccgccgctaccggaccgtccatctatcccttgctgaatggcactggggtcatttctctgtctccagctcctggcccagtgccatgcacaaagccagccctcaggagcgactccgatgctgtgtcc

SEQ ID NO: 90143 - DNA, 601 bp, Human
aggctgcgcgggccgcagcccggactcacgtagagggaatcacggagagaggagccaagggggaagccagtcgccggcttgaagagtggggaggtgaagtccacggtcctcctgacgaactccaggtccccggcgtctgccccataggggaagagggaaactcctgggccaggacagagaagagcaggaagtccaagtgggcctgggccttctttagggctgaaagggatcccagagcgctccccgcaggctgcccacacctgtcctgtgttccccgagggccccagaggcagccatctarggtgcttctcgctccctctccacccacattaaatgcatgtggtcattttactccctaaactgcgcctctcatccttccccagcttggagaaaaacaggtcctgctgtcagaataccagcaaacgattctcaatctcttagtctcaatccttttcagggttaaaagacaaaagtctatgctgggtgcggtggctcacgcctgtaatcccagcactttgggaggctgaggcgggaggatcacgaggtcaggagttcgagaccagcctgaccaacatggagaagccctgtctctacttaaaat

SEQ ID NO: 90144 - DNA, 601 bp, Human; identical to SEQ ID NO: 30429

SEQ ID NO: 90145 - DNA, 601 bp, Human; identical to SEQ ID NO: 30430

SEQ ID NO: 90146 - DNA, 601 bp, Human; identical to SEQ ID NO: 30431

SEQ ID NO: 90147 - DNA, 601 bp, Human; identical to SEQ ID NO: 30432

SEQ ID NO: 90148 - DNA, 601 bp, Human; identical to SEQ ID NO: 30433

SEQ ID NO: 90149 - DNA, 601 bp, Human; identical to SEQ ID NO: 30434

SEQ ID NO: 90150 - DNA, 601 bp, Human; identical to SEQ ID NO: 30435

SEQ ID NO: 90151 - DNA, 601 bp, Human; identical to SEQ ID NO: 30436

SEQ ID NO: 90152 - DNA, 601 bp, Human; identical to SEQ ID NO: 30437

SEQ ID NO: 90153 - DNA, 601 bp, Human; identical to SEQ ID NO: 30438

SEQ ID NO: 90154 - DNA, 601 bp, Human; identical to SEQ ID NO: 30439

SEQ ID NO: 90155 - DNA, 601 bp, Human; identical to SEQ ID NO: 30440

SEQ ID NO: 90156 - DNA, 601 bp, Human; identical to SEQ ID NO: 30441

SEQ ID NO: 90157 - DNA, 601 bp, Human; identical to SEQ ID NO: 30442

SEQ ID NO: 90158 - DNA, 601 bp, Human; identical to SEQ ID NO: 30443

SEQ ID NO: 90159 - DNA, 601 bp, Human; identical to SEQ ID NO: 30444

SEQ ID NO: 90160 - DNA, 601 bp, Human; identical to SEQ ID NO: 30445

SEQ ID NO: 90161 - DNA, 601 bp, Human; identical to SEQ ID NO: 30446

SEQ ID NO: 90162 - DNA, 601 bp, Human; identical to SEQ ID NO: 30447

SEQ ID NO: 90163 - DNA, 601 bp, Human; identical to SEQ ID NO: 30448

SEQ ID NO: 90164 - DNA, 601 bp, Human
ctaattcctggaccccttgcagtgtcttgcccagcttgggttccccagcactgtcctccacctcctggccacagccctatgcacctgcagcggggcccactgggcaggtgctggcactggcctccatggtcacagtagcccctactgcacggggacacgcaggtgaagccgctctgggggctgtagaccaggtcgtagcccttgtagccatcgcatctgaagtaagccttcagcgtgctcacgttcactgtcgggaaggacacagattaacacagaaagcaaccgatgaacactaaatcartaccttttcagccacgaattccttttcgggtgtttatcctgagaaataattggagaagtgcacagatacatatgcccctggacgttcagatcagcgtggtggataatagtaacgtttcagaagtagggtctggttaaataaactactgcacatccttaccaagggatggtgcttcctatggaaaaagtttcctagggaaaaaggttcctgtggaaaaaggttcctatggaaaatgctttcctgaagagcacatgctttgaaggtggccagacttgggtggaaactgaaactctgctagtg

SEQ ID NO: 90165 - DNA, 601 bp, Human; identical to SEQ ID NO: 90139

SEQ ID NO: 90166 - DNA, 601 bp, Human; identical to SEQ ID NO: 90140

SEQ ID NO: 90167 - DNA, 465 bp, Human; identical to SEQ ID NO: 90141

SEQ ID NO: 90168 - DNA, 464 bp, Human; identical to SEQ ID NO: 90142

SEQ ID NO: 90169 - DNA, 601 bp, Human; identical to SEQ ID NO: 90143

SEQ ID NO: 90170 - DNA, 601 bp, Human; identical to SEQ ID NO: 30429

SEQ ID NO: 90171 - DNA, 601 bp, Human; identical to SEQ ID NO: 30430

SEQ ID NO: 90172 - DNA, 601 bp, Human; identical to SEQ ID NO: 30431

SEQ ID NO: 90173 - DNA, 601 bp, Human; identical to SEQ ID NO: 30432

SEQ ID NO: 90174 - DNA, 601 bp, Human; identical to SEQ ID NO: 30433

SEQ ID NO: 90175 - DNA, 601 bp, Human; identical to SEQ ID NO: 30434

SEQ ID NO: 90176 - DNA, 601 bp, Human; identical to SEQ ID NO: 30435

SEQ ID NO: 90177 - DNA, 601 bp, Human; identical to SEQ ID NO: 30436

SEQ ID NO: 90178 - DNA, 601 bp, Human; identical to SEQ ID NO: 30437

SEQ ID NO: 90179 - DNA, 601 bp, Human; identical to SEQ ID NO: 30438

SEQ ID NO: 90180 - DNA, 601 bp, Human; identical to SEQ ID NO: 30439

SEQ ID NO: 90181 - DNA, 601 bp, Human; identical to SEQ ID NO: 30440

SEQ ID NO: 90182 - DNA, 601 bp, Human; identical to SEQ ID NO: 30441

SEQ ID NO: 90183 - DNA, 601 bp, Human; identical to SEQ ID NO: 30442

SEQ ID NO: 90184 - DNA, 601 bp, Human; identical to SEQ ID NO: 30443

SEQ ID NO: 90185 - DNA, 601 bp, Human; identical to SEQ ID NO: 30444

SEQ ID NO: 90186 - DNA, 601 bp, Human; identical to SEQ ID NO: 30445

SEQ ID NO: 90187 - DNA, 601 bp, Human; identical to SEQ ID NO: 30446

SEQ ID NO: 90188 - DNA, 601 bp, Human; identical to SEQ ID NO: 30447

SEQ ID NO: 90189 - DNA, 601 bp, Human; identical to SEQ ID NO: 30448

SEQ ID NO: 90190 - DNA, 601 bp, Human; identical to SEQ ID NO: 90164

SEQ ID NO: 90191 - DNA, 601 bp, Human
tggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagccccctygccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtct

SEQ ID NO: 90192 - DNA, 601 bp, Human
catactcagcccgtgtggtcctggcccccagacacctgccccgggaggacctgttcactatcaactccaagggccgcctggggaaccagatgggcgagtacgccacgctgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggagtaccgccacatcccggggcgctgtgtccrcctcacgggctacccctgctcctggaccttctaccaccacctccgccaggagatcctccaggagttcaccctgcacgaccacgtgcgcgaggaggcccagaagttcctgcggggcctgcaggccaagtgggcagggcaggcgaccttcgtgggggtccacgtgcgccggggggactatgtccgtgtcatgccgcgcgtatggaagggggtgctggccgaccggctacctgcagcgggccctggactggttccgggcctgctgccgcctcccggtctttgtggtcaccagcgatgacatgg

SEQ ID NO: 90193 - DNA, 601 bp, Human
agtctcccagtagacagaaaacacccgaagctggccaggtgtggtggctcacgcctataatcccagcacttgggggcccgaggtgggcggatcacctgaggtcaggagttcaagaccagcctggccaacgtggcgaaaccctgtctctaataaaaatacaaaaattaggccgggcacggtggctcatgcctgtaatcgagcactttgggaagccgagcctggcggatcacgaattcaggagatcgagaccatcctggctaacaaggtgaaaccccgtctctactaaaaaaaagaaaaaatmcaaaaaaattagccgggcgtggtggcgggcgggctcctgtagtcccagctactcgggaggctgaggcaggagaatggcgtgaacccgggaggcagagcttgcagtgagcagagatcgcgccagtgcactccagcctgggcgacagagtgagactccgtctcaaaaaaaaaaaaaattagccggtgtggtgatgcgcgcctgtaatcccagctatttgggaggctgaggcaggagaatcgcttgaacctgggaggtggaggttgcagcgagctgagatcgcgccattgcactccagcctgg

SEQ ID NO: 90194 - DNA, 601 bp, Human
ataccccagcacctcagacagtatccagtgcacagcacatgttccttatggtttgacttgtgacgagtccccggccaagtttccttgtttcatttttttgagacagagactctctctgtcacccaggctagagagcagtggtgcgatctcagcccactgcaacctccgcctcccaggttcaagtgattctcttgcctcagcttcctgagtagcttggactacaggcacctgccaccactccctgctaatttttgtatttttagtagagatggggtctcaccatgttggccaggctggtctygaactcctgaccataggttatcctcctgcctcagcctcccaaagtgctgggattacaggcgtgagtcactgcacccagcctcccttggccaagttcatatattaaagtcctagccccaagtaggacctcagtccgtcacccaggctggagtgcagtggcacaatctcggttcactgcaacctccgcctcccaggttcaagtgattctcctgcctcagcctcctgagtagctgagataacaggagcacaccaccatgcctggctaattttttgtatgttcagtagagatggggtttcacca

SEQ ID NO: 90195 - DNA, 601 bp, Human
ggcacctgccaccactccctgctaatttttgtatttttagtagagatggggtctcaccatgttggccaggctggtcttgaactcctgaccataggttatcctcctgcctcagcctcccaaagtgctgggattacaggcgtgagtcactgcacccagcctcccttggccaagttcatatattaaagtcctagccccaagtaggacctcagtccgtcacccaggctggagtgcagtggcacaatctcggttcactgcaacctccgcctcccaggttcaagtgattctcctgcctcagcctccygagtagctgagataacaggagcacaccaccatgcctggctaattttttgtatgttcagtagagatggggtttcaccatgttgtccaggctggtctggaactcctgacctcaagtgatccgcccacctcggcctcccaaattgcggggattacaggcatgagccaccgtgcccagccctggtcagtcttgaggtctgtgttgatgttaaacactggtcagctgagcctgaattacaatggcaggagggtataatgaggcatgtccagccacccagtcccatcctgggctgaactagtgttt

SEQ ID NO: 90196 - DNA, 601 bp, Human
ggccagcctgcctaacatggcgaaaccccatctctactaaaaacacaaaaattagccgggcgtgatggtgtatgcctgtaaccgcagctgcttgggaggctgaggtgggagaattgcttaaacaggaggcggaggctgcagtgagccaagatcactccaacctgggagacagagtgagaccctgtctcaaaaaaaaaaaaaaaaaaagaaaaaagaaaaactaaaggagaatgattttcttttgctttgagggacccagttgtgtgttaccttcttagagcaaccggggaaacacatagarcgtctaatgcatattaattgaatggattgtacaaacagagcgaaaagagaaccccatggcttagcaggaaagcagcttagagatgaaaggtttcagtgtccttggcacagggctagtagtcctggagatgatttcatggacactgtcccaggaagtaaaattctggaaatactttcattcattcaacaatatggtcatgggtcacttaacaatagggatgtgttctgagaaatgtattattaggcaatttcatgttgtatgaacatcatagagtatatttacacaaacccagatggggtg

SEQ ID NO: 90197 - DNA, 601 bp, Human
tgcttaaacaggaggcggaggctgcagtgagccaagatcactccaacctgggagacagagtgagaccctgtctcaaaaaaaaaaaaaaaaaaagaaaaaagaaaaactaaaggagaatgattttcttttgctttgagggacccagttgtgtgttaccttcttagagcaaccggggaaacacatagaacgtctaatgcatattaattgaatggattgtacaaacagagcgaaaagagaaccccatggcttagcaggaaagcagcttagagatgaaaggtttcagtgtccttggcacagggcyagtagtcctggagatgatttcatggacactgtcccaggaagtaaaattctggaaatactttcattcattcaacaatatggtcatgggtcacttaacaatagggatgtgttctgagaaatgtattattaggcaatttcatgttgtatgaacatcatagagtatatttacacaaacccagatggggtgtgtgtgtgtatatatatattaaattcattttttttaatatggaaaacgaaatctccgagcaccattattgaatatcagtcatctcctgtacttcatctgcaatgccaatacaaa

SEQ ID NO: 90198 - DNA, 601 bp, Human
gtacaaacagagcgaaaagagaaccccatggcttagcaggaaagcagcttagagatgaaaggtttcagtgtccttggcacagggctagtagtcctggagatgatttcatggacactgtcccaggaagtaaaattctggaaatactttcattcattcaacaatatggtcatgggtcacttaacaatagggatgtgttctgagaaatgtattattaggcaatttcatgttgtatgaacatcatagagtatatttacacaaacccagatggggtgtgtgtgtgtatatatatattaaattcatattttttaatatggaaaacgaaatctccgagcaccattattgaatatcagtcatctcctgtacttcatctgcaatgccaatacaaagtgccagagatgaggtttctatatatgctctattataatattttattcgtttatttttgagacacagtctcgctctgtcacccaggttggtgtgcagtggtgcaaacacaactcactgcaacctctgcctcccgggctcaagtgctcctcctgcctcagcctcccgagtagctgggaccacaggcactcactgccacacttggctaatttttgta

SEQ ID NO: 90199 - DNA, 601 bp, Human
agaaccccatggcttagcaggaaagcagcttagagatgaaaggtttcagtgtccttggcacagggctagtagtcctggagatgatttcatggacactgtcccaggaagtaaaattctggaaatactttcattcattcaacaatatggtcatgggtcacttaacaatagggatgtgttctgagaaatgtattattaggcaatttcatgttgtatgaacatcatagagtatatttacacaaacccagatggggtgtgtgtgtgtatatatatattaaattcattttttttaatatggaaaacsaaatctccgagcaccattattgaatatcagtcatctcctgtacttcatctgcaatgccaatacaaagtgccagagatgaggtttctatatatgctctattataatattttattcgtttatttttgagacacagtctcgctctgtcacccaggttggtgtgcagtggtgcaaacacaactcactgcaacctctgcctcccgggctcaagtgctcctcctgcctcagcctcccgagtagctgggaccacaggcactcactgccacacttggctaatttttgtatattttttttaaagatggg

SEQ ID NO: 90200 - DNA, 601 bp, Human
tctcactatgttgcccaggctggtcttgaactcctgggtttaagggatcctcttgcctcagcctcccaaagtgctgagttataggcgtgagccaccgcacccagcctatttatttatttttgagacagagtcttgctctgtcacccaagctggactgcagtggctcgatctcagctcaccgcaacctctgcctcctgggctcaagagattcttgtgcctcagccatctgagtagctgggatttacaggcgtgctccaccatgcctggctaatttttgtatttttagtagagatggggttcrccatgtttcccaggctagtctcaaattcctggcctcaagtgatccaccctcctctgcctcccaaagcgctgggatgacaggcgtaagccaccgggcccagccaaattttaaagaaaacaggatatcaatttatatctcaaggcaaagagaaagaatgtaagttcttttgttgtttttgagattggttctccctctgttgcccagtctgatctcaaacacctgacctcaagagatcctcccacctccagcccccaaagtgttgcgattgtaggcgtgctggcctactttctgttctggttt

SEQ ID NO: 90201 - DNA, 601 bp, Human
aaggcttggcgtggtggctcatgcctgtaatcccagcactttgggaggccaggacaggtggatcacctgagatcagcctgaccaacttggtgaaacccccgtctctactaaaaatgcaaaaattagccgggcgtggtggcgcacgcctgtaatcccagctactcgggaggctgaggcaggagaatcgctagaacctgggtggcagaggttgcagtgagccgagattgtgccattgtactccagcctgggcaacaagagggaaactctgtcttggaataaataaataaataaaaataaatamaataataataaataaaattttggcagagatggctcttgctgtgttgtccagggtgctcttgaactcctggcctcaagcgatccttcagcctcagcctcccacagtgctgggattacaggcatgagtcaccacactcggcccatcaatttattttataagcaaactggttcacatacgttttttcccgttaatccagttttggaaagggaaaaaaaccaagacttttaccacctttactggaccgggtcccacaggcagagatccaaggagctggtaagaaatctcacctttttctgccag

SEQ ID NO: 90202 - DNA, 601 bp, Human
cgtctctactaaaaatgcaaaaattagccgggcgtggtggcgcacgcctgtaatcccagctactcgggaggctgaggcaggagaatcgctagaacctgggtggcagaggttgcagtgagccgagattgtgccattgtactccagcctgggcaacaagagggaaactctgtcttggaataaataaataaataaaaataaataaaataataataaataaaattttggcagagatggctcttgctgtgttgtccagggtgctcttgaactcctggcctcaagcgatccttcagcctcagcctcycacagtgctgggattacaggcatgagtcaccacactcggcccatcaatttattttataagcaaactggttcacatacgttttttcccgttaatccagttttggaaagggaaaaaaaccaagacttttaccacctttactggaccgggtcccacaggcagagatccaaggagctggtaagaaatctcacctttttctgccagctatttatcatttgtcccagaaaaccatctgtaggctccgaaacaagagtgatttgatttgcatcctgctcacagtgccagaactgcggggaagttaaa

SEQ ID NO: 90203 - DNA, 601 bp, Human
cagctactcgggaggctgaggcaggagaatcgctagaacctgggtggcagaggttgcagtgagccgagattgtgccattgtactccagcctgggcaacaagagggaaactctgtcttggaataaataaataaataaaaataaataaaataataataaataaaattttggcagagatggctcttgctgtgttgtccagggtgctcttgaactcctggcctcaagcgatccttcagcctcagcctcccacagtgctgggattacaggcatgagtcaccacactcggcccatcaatttattttrtaagcaaactggttcacatacgttttttcccgttaatccagttttggaaagggaaaaaaaccaagacttttaccacctttactggaccgggtcccacaggcagagatccaaggagctggtaagaaatctcacctttttctgccagctatttatcatttgtcccagaaaaccatctgtaggctccgaaacaagagtgatttgatttgcatcctgctcacagtgccagaactgcggggaagttaaaatgtttcccctggaggttaaaacatttgagtctatataaatcaaactaataatagc

SEQ ID NO: 90204 - DNA, 601 bp, Human
gcaaactggttcacatacgttttttcccgttaatccagttttggaaagggaaaaaaaccaagacttttaccacctttactggaccgggtcccacaggcagagatccaaggagctggtaagaaatctcacctttttctgccagctatttatcatttgtcccagaaaaccatctgtaggctccgaaacaagagtgatttgatttgcatcctgctcacagtgccagaactgcggggaagttaaaatgtttcccctggaggttaaaacatttgagtctatataaatcaaactaataatagccagrtagcaggagaaaggaatacacattttatcatgtgcacacaggactcacagaaaatacgcaaactcagagaaagggccagatagctgaagttgttttttgagacagagtttcactcttgttccccaggctggagtgcaatggtgcgatctcggctcaccacaacccctgcctcccgggttcaagcgattctccctcctcagcctcctgaatagctgagattacaggcatgcgccaccatgcccggctaattttgtatttttagtagagatgggatttctccatgttggtcaggctggtttc

SEQ ID NO: 90205 - DNA, 601 bp, Human
ggattacaggcatgagccaccgtgccaggcctttaaaaacattttttttgagaccgagtcttgccctgtcacccaggctggagtgcagtggtgcgatctcagctcactgcaacctctgcctcctgggctcaagtgattctcattcctcagccttctgaatagatgggattacagatgtgcaccaccatgcccagctaatttttgcattttttgtaggcacagggttttactatgttgcccaggctgctctcgaacttcagccctcacatgattcacctgcctcggcctcccaaagtgctgkgattataggcgtgagccacctcaccccgcccgtccagaaagagtaaatttctttcttttttctttttcttttttttttttttttttttgagacaagtctcgctctgtagcccaggctggagtgcaagtggctcgatcttggctcactgcaagctctacctcccgggttcacaccattcttctgcctaagcctcctgagtaggtgggactacaggcgcccaccaccacgcctggctactttttgtagttttagtagagacggggtttcaccatgttagccaggatggtctcgatctcctga

SEQ ID NO: 90206 - DNA, 601 bp, Human
ctgttctcaaactcctgacctcatgatcagcccgccaccctctcaaagtgctgggattacaggtgtgagccactgcacctaatctaatcttttataactgtcaatctaatcttataactgtatgttagcctttgtatgcaaaatgctgtcattctgctcacgatctccattttttgttgttgttgttgttggttttttgtttgttttgtttgtttgtttgttttagacagagtcttgctcttttgcccaggctggagtgcagtggtgcgatctcggaacactgaaacctccaccccacccygcctctgcctcccaggttcaagcaattcttctgcctcagcctcccaggtagctgagattacaggtgctcaccaccacacagccagctaatttttgtatttttttttttttagtagagacagggcttcactatgttgaccaggctggtctcaaactcgtgacctcaaacgatctacctgccttggcctcccaaagtgctgggattacaggcattagccactgcgtttgacctctccatttttacctgtataaatgagttccacttttccccatactggaagcactgatcaccattcttcgg

SEQ ID NO: 90207 - DNA, 601 bp, Human
tgtttgtttgtttgaagggagctccgtagctggtaggtagcctcctgctgcttagctgaagctggggagtggctgctggtttctctttcctcctgttaggactgctgggagctctggtggtgcctgcctcttctctcagtaaaattcctcatccatcttttttttttttgagacagagttttgctcttgtttcccaggctggagtgcaatggtgtaatctcagtttactgcaacctccgcctcccaagttcaagcgattctcctgcctcagcctcccaagtagctgggattacaggtgcaygccaccacgccccactgatttttgcatttttagtagagacagggtttcaccatgttggccagactggtctcaaactcctgacctcaggtgatccacctgcctcggcctcccaaagtgctgggattacaggcatgagccactgtgctgggccatggctaatttctgtattcttataaggacggggtttcaccttgttggccaggctggtctctgactcctgacctcagttgatccgcctgcctcggcctcccaaagtgctagaattacaggtgtgagtcaccacaccgggcccatttgtat

SEQ ID NO: 90208 - DNA, 601 bp, Human
gcccacgcagccctaagggaggtgtggtttgttgttgttgttgtatctttttgagatggatttttgctcttgttgcccaggctggcatgcaatggtacaatctcggctcactgcaacctccgcctcccaggttcaagcgattctccttcctcagcctcccaagtagctgagattacagtcatgagccaccatgcctggctaattttttgtatttagtagaaatggggtttcaccatattagtcaggctggtctcgaactcctgacctcaggtgatccacccgcctcagcctaccaaagtgytgggattacaggcatgagccactgcactggctcttttttttttttttttttttttttgagacggagtctcactgtgttgtgcaggctggagtgcaatggtgtgatctcagctcactgaaacctctggggaggtgttgtttttatccctccccacaaccccctgttgatggacagacaaggacaatgaaacacagagaggtaaaagccctgggttaaagtcacacagcacataaaaggttcctgatcatgccgtgcagggcatctcgccaaacctcaaaaattcacaatctcatagcgcag

SEQ ID NO: 90209 - DNA, 601 bp, Human
tacatacttacacatatacccttacatgtacacgatatatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcasacacacacccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacg

SEQ ID NO: 90210 - DNA, 601 bp, Human
tatctctacccatacactaccatgtacacatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatgsccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcg

SEQ ID NO: 90211 - DNA, 601 bp, Human
acatgtccatttgtacacagctgtatatgtacacacacaattttgcacacacctgtatatgtatacaatgtatggatccccatatccacattacacacaatgtgtacgcatctacctgtgtacacacacccacctatgaacacaatgtagacacatctgtataaacacacttgagatacatgcctgtgcacataggcaagtatgtgccaagtatttacacacctgaagtagaagcacacacacacccacactatgcctgcacaccaccgcatggccacgttcaccagcgccccgggcctcyatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggcca

SEQ ID NO: 90212 - DNA, 601 bp, Human
ccacactatgcctgcacaccaccgcatggccacgttcaccagcgccccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcrataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttc

SEQ ID NO: 90213 - DNA, 601 bp, Human
cccgggcctccatctcccagctaacgtgtcccgttttcctcccctgacagccatgctggtcgttcagatgcctttctcctttcccatggcccacttcatcctctttgtctttacggtttccactatatttcacgttcagcagcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtaygccctggccaagatgaacgggcggcccgccttcatcccggcccagatgcacagcaccctggcccccatcttcagaatcaccctgccggtgctgcacagcgccacggccagcaggatcccctggcagaactaccacctgaacgactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcgg

SEQ ID NO: 90214 - DNA, 601 bp, Human
gcggctagcgaagattcaagccatgtgggagttaccggtgcagataccagtgctagcctcaacatcaaaggcactgggacccagccagctcagggggatgtggacgatcaatgcaataggccgcctggggaaccagatgggcgagtacgccacactgtacgccctggccaagatgaacgggcggcccgccttcatcccggcccagatgcacagcaccctggcccccatcttcagaatcaccctgccggtgctgcacagcgccacggccagcaggatcccctggcagaactaccacctgaaygactggatggaggaggaataccgccacatcccgggggagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactatgtccatgtcatgccaaaagtgtggaagggggtggtggccgaccggcgatacctacagcaggccctggactggttc

SEQ ID NO: 90215 - DNA, 601 bp, Human
ttgtcttatcacagaaccctgttgccacaccaatcagaccttccacaggctgccagctcatcgccatgaatcaggcgaggtacttccaaccacactgcgacccagacaccctgaatccaagggagaagcagcctcatggacacgggataaatatataatgcaaacaaatgaacaattactctaaatgcacgtacgcccagctcgttagggccaataaatccaggcttaaaggtcttgtttcccctgtaaccaccattgctctcctccttcccctccctccctccctccctgactccctccycaccttccctcctccctttgccccctactgtccctctgctgttggttttcctaaggtacagtggcatttctcaaacaaatcatcaggaattaggaagaagctttctaatactgtttcaacaaactgtactctctgagccctttccacaacagacccatcctaacctctctccacggtaacctaaagccaccaagccttttccctccaagctcaacgtgaaagtgtaaaggcctctgcttaggtctccccgtctgtgggcagaagtggccttggcaatgcgacctggaaaagagactctca

SEQ ID NO: 90216 - DNA, 601 bp, Human
ccacacagcaccaactaacttctgacaaaactctgaccatccacaccgatctgtcagggagagaagccgatggcttcaaggtaaatagcacccatcgttgtcttatcacagaaccctgttgccacaccaatcagaccttccacaggctgccagctcatcgccatgaatcaggcgaggtacttccaaccacactgcgacccagacaccctgaatccaagggagaagcagcctcatggacacgggataaatatataatgcaaacaaatgaacaattactctaaatgcacgtacgcccagctcrttagggccaataaatccaggcttaaaggtcttgtttcccctgtaaccaccattgctctcctccttcccctccctccctccctccctgactccctccccaccttccctcctccctttgccccctactgtccctctgctgttggttttcctaaggtacagtggcatttctcaaacaaatcatcaggaattaggaagaagctttctaatactgtttcaacaaactgtactctctgagccctttccacaacagacccatcctaacctctctccacggtaacctaaagccaccaagccttttccc

SEQ ID NO: 90217 - DNA, 601 bp, Human
acccagcatcctttaaggtggttcctgggactccagcagggcttccatgggctgagagctctgtggccgtaactccaagacttttcttgagaaatgggttaaacacctggtgtcctaaaacagactccagtccccaaacctccctcttggcatcgtccaacgacatggagccatttctcgcactcggtgacctacatgactacagggctgccccgtctccccgtggacgtggctgtgcttcttcttgggtgtgaagtggctgacctctttagacggggtttgggcactacttaaaaagcartgatccgggaggaggaaaggagctacagaaagaggatgtaagagaatgtacacaaattcctaggaaagcaaaagcaatcttcactcaaaagtaatcaaggggacactgtcgcctcttcgtatccagggcagagccacggaccagccgctctctaaacctggctctctaaacctgcacagggcaccgtggttcgtccagccacccatgtctgttgctacttgatggtgagagacttaacacctcacaagagaaaaattaaacccagagctctgtgggggactgcctatctctaattagaac

SEQ ID NO: 90218 - DNA, 601 bp, Human
tgctctcaaagaccagaggtgcagtaactcaccatacctgactcaggagaagtttccggcagccactctgccaacaaaagaaggacgcagccacctcctaattcttgctctggcggcagtcacgtgcgctcatgggagggctgtactcccagtgcactgtgggtcaagtgcctcctggctggactccttcccgcggctcccgtgtctcactaccccaaacccacttttgtgccacgaaggccactactgccgttacctcccccacacccatagcctatggcacaagtaaagactgttgctyctttttccatcacacactgactcctccaaaatgttaacacaggactccaacccacccctggctgaacagtgcttcctaagtgtcctgaggtttggtggctgtagctgaatgttaacagtttccttaaaaaccggggactgttgtgtgctagaaagaacgctgaggtccgggataaggtttgggaccgtaccagcctggaaggctgcctggtgctcaggcggtagagctgggtcccttcttttcttgttaagagtcctttttccctgtcctgagaataggggtcttctgtcatgagttacc

SEQ ID NO: 90219 - DNA, 601 bp, Human
ctccctcgtgtctcctcacccctgcacgggatgtttctcctgacatctccacacctaactctctggctcagtggttatctaggttaatttccacatgtgtcaatttcctagtttccgtttttgatttccaattttatctccttgtggttggagcacatactccatattttgatcctttaaaatttgagatgtgtttggtgacctaacaaatggccccccatggagaattttccatgtgcacttgagaaggctgtgtaccccactgtttgggtggggtgacctatatgtctgttaggtctgsttggtttttgtgttgctgaagtcctgtttccttactgatcttgtctagatgttctatccattactcaaagtgtggtaccgaagcctccaactcttacggttgactcgactatttctcccttcagttctgtccgtttttgctttgcgtattttgggggctcttttgacgatacccatgcctctcagggatcatggatgccatggatgctctccccagagcagcatgtccaggtcaagagtgtggctccggggctcccaacagtctcttggggtctactcgtggctctagaagcagccccgg

SEQ ID NO: 90220 - DNA, 601 bp, Human
cctggactttctcctcccgtgtgagctgacaacatgggtttgtgtgggaaaagcaagcctgggcttcttgcttgaggcccgtgttctgagggggctttggaaatgctcccaagggactgtacgagtgagggctgattatcactatccccacgagatgacatcatcaaagtgtgtgggaaacacaaaatccttgtaacacaacagtgggttctattagtcactggggcaattgtgaaaataccactgagtccaaaacgcaatgccatcaagcagccaggccctagagtcagtaccaactccrgccaggccaaaagcacgaggggtgcagaggctgcctggtccctgctgcctcttgaaggccggaagaactcagtgtattccggctctgccattttctacgggtgaaaccttaccttgcccagccttcggtctcctcacctggaaaacagggatgcgtgaggtgacaggcagggcaggtaaggtgctcagcccagtgccctgcacgctgggagcagatgattataatgctcgtgacccacacctgatgagatcaaactcccaaccgatgtaaaatctggaggctacgctgggggcagggctt

SEQ ID NO: 90221 - DNA, 601 bp, Human
ccagcctgaaggacacatctcatctcaaaacacaaacaaactcaaaacttaacatgaggagtgtttatcctctcccccaacacaatccctcatttatgtcctgtctcagaatttagcagcccaaagcgcaccgatgagtgagggccgctcctcctggcgcgctccctgcaagagcaagcagaaaagccaattttcttattttctaaaatgctcctcagaggtcaagtttagccaaatgaggcccgcctgcctcgacgagctgctggggcttaggggaggtgatgcatgtgaaagtgctttkcaaactgcagagtggcctgggaaagcaaactgcaataaataaaactgaggagcacaggagccaaggcagacccccctcaagtcagggcgatgcattttcccataaagggccagactgtcggtactgctggctttgtgggccacatttggtctctgtcatatattcttgtttttgcttttataatcctttaaaaatgtaaacatcatcttagcttacaggcccaggcctggagcttgtggcagtgagagcccagagaaggtaggaagttgacttgaagtcacatagctcgttcacgacggt

SEQ ID NO: 90222 - DNA, 601 bp, Human
catccgcagcacccagatcagtttcttgtttctccacaggttacgctaactggcctgccacccctaaactcaaacacagccgaacctcatctggcccccgttcattctgccaagagctgaaaagcgaccctctccacccttgagggcagcggacttgtgtaaaatggtcacatcacaccggataggagcgatttcccttccttgccctggaacattctaccatgcacatccttgtctcagggtcggctgttattcccagagcaagcaagagcttggatgttttggaccaaagcccacttgygaagtgtttagaacagaaccatcaaagacaaagcccagtcacaggctgagggaaggctcctgaagaattccctattccacaaactttagctttagagtgtgaacaaccagcaaccaagacttaaaatgggctcatgaccagcctgaccaacatggtgaaaccctgtctccactaaaaatacaaaaaaaagtagctgggcgtggtggtgcacgcctgtaatctcagctacaggctgaggcacaagaatcgcttgagcccggtaggcggagcttgcagtgagccgagatcacaccactgcac

SEQ ID NO: 90223 - DNA, 601 bp, Human
atccccccgatgaacctctgcacccagcttcacaaacacatgccaaggaatcctctcagtggctgggaaagcatccgcagcacccagatcagtttcttgtttctccacaggttacgctaactggcctgccacccctaaactcaaacacagccgaacctcatctggcccccgttcattctgccaagagctgaaaagcgaccctctccacccttgagggcagcggacttgtgtaaaatggtcacatcacaccggataggagcgatttcccttccttgccctggaacattctaccatgcacatscttgtctcagggtcggctgttattcccagagcaagcaagagcttggatgttttggaccaaagcccacttgcgaagtgtttagaacagaaccatcaaagacaaagcccagtcacaggctgagggaaggctcctgaagaattccctattccacaaactttagctttagagtgtgaacaaccagcaaccaagacttaaaatgggctcatgaccagcctgaccaacatggtgaaaccctgtctccactaaaaatacaaaaaaaagtagctgggcgtggtggtgcacgcctgtaatctcagctac

SEQ ID NO: 90224 - DNA, 601 bp, Human
cccaacatgcaccacgggcagctagttcccagagcccagcacccgaatgagagccaggattttagcctaaagctcaaacatccccccgatgaacctctgcacccagcttcacaaacacatgccaaggaatcctctcagtggctgggaaagcatccgcagcacccagatcagtttcttgtttctccacaggttacgctaactggcctgccacccctaaactcaaacacagccgaacctcatctggcccccgttcattctgccaagagctgaaaagcgaccctctccacccttgagggcagcrgacttgtgtaaaatggtcacatcacaccggataggagcgatttcccttccttgccctggaacattctaccatgcacatccttgtctcagggtcggctgttattcccagagcaagcaagagcttggatgttttggaccaaagcccacttgcgaagtgtttagaacagaaccatcaaagacaaagcccagtcacaggctgagggaaggctcctgaagaattccctattccacaaactttagctttagagtgtgaacaaccagcaaccaagacttaaaatgggctcatgaccagcctgaccaa

SEQ ID NO: 90225 - DNA, 601 bp, Human
ggtgttagagagctccttaccttctccgccttcaggactggagccgccagctgacctctgaaacaaggagcacacagccggggtcagagggcatcaggctcacggcagccgagcaactctcggggccgtaacaaatatcccaacatgcaccacgggcagctagttcccagagcccagcacccgaatgagagccaggattttagcctaaagctcaaacatccccccgatgaacctctgcacccagcttcacaaacacatgccaaggaatcctctcagtggctgggaaagcatccgcagcacmcagatcagtttcttgtttctccacaggttacgctaactggcctgccacccctaaactcaaacacagccgaacctcatctggcccccgttcattctgccaagagctgaaaagcgaccctctccacccttgagggcagcggacttgtgtaaaatggtcacatcacaccggataggagcgatttcccttccttgccctggaacattctaccatgcacatccttgtctcagggtcggctgttattcccagagcaagcaagagcttggatgttttggaccaaagcccacttgcgaagtgtttaga

SEQ ID NO: 90226 - DNA, 601 bp, Human
acaaatgaagtggaattcgtaggggaagaactcactctacgcagaatggaaccaaagacaacactgttcaaattattggtgcccctcacgcctccagttaccctggagagctgagtgtctcttgggggctgctgcgctggacgggaggtgatttgaagagggccggggagaagaatggtggtccctcgcctctttagcctacattcacagcccaaacacctcctcttctctatgctggttttcgatacagcaagcatggttcagcagtgggcagtgagggggaaggaataaaatcaacgarcaggaagtggagctccctcattccacagaacacctatccacaggtgcaaagatccttaaattaaaaggatgccaactgcagcctggactgcaagccatctggacagttccgcaatatccagtcagcagatgacagtgtaatagcactggaaaacctaatgcagctgtgcaaaaagacgcggccatgtccaaaaccaacgtgatgggaaaagggcatgaaaacaagggtgtggaggggtgacttgggaaggaccctggcttcctacgctgtgtgttcctgtaacgcatgcgtgacttctgt

SEQ ID NO: 90227 - DNA, 601 bp, Human
tcaccaccaggacatactggacaggccccaactgagacacttctacccaacagctgacctgtaatcctcaaggtcatgaaagtcaagggaagcctgaagacctgttcccgataaaagtggaggtatgtgtggtaggaccagggtctcagtccttttttctaatggactcatggagctgactggagaaagctaaatggggtcttcagacaaaagggacagagaaattcttctgtaagtgttaaagcttttcaaaattaaagctaaaaaacagaaggcaggcagacaaggatgtgaagttggstttgcagaactgatgtgtggctgatatgactgccttttcatgcgtgagggcactggggctttaaaccatgccgcgtcggggcctgcgaaacagctgccctgctccagaggctggaggggaaaggtctgtggggagagagacaggagggaggccgttgctcacagacctcagaagcgatcatgagatttgtaacagagctcagcagcacaaatgggtccagacacacggctttagtaactgatcacctaaagcagaacctgcctcaccgtggcaggctctgtgcccccatccagaccacca

SEQ ID NO: 90228 - DNA, 601 bp, Human
gatggctcgagagcccagcctcgcccagccacctgtccacatggaccccttcatctgtgtgtcttggcaactgtgcccatacggggagtggggatggtggtctaatctgatccacaacaggaaggattgtcataaaaggcctgtgactcaggcaggcaagcctgttcctgggcaaggcacagagactgtggcattatggctcctggaggtagccctgcgtttgtgctaagcttcacccccttgtcaagctacaggacacaagatcaatatacaaaaatcgattgtgtttctaacactagcmgtgaatgacccaaaagcaaaattaagaaaataattccatttacaataacaccaaaaggaataaaatacttgggaatacatttcacaagataaaactataaaacaatgttagggccgggtgcagtggctcatgcctgtaatcccagtgctttgggaggctgaggcaggaggactgcatgagcccaagagtttgagatcagcctgggcaacactgcaagaccctaactctacaaaaaattaaaaacttagccaggcatggtggtacatgcctgtagtcccagctactcaggaggcagaggtg

SEQ ID NO: 90229 - DNA, 601 bp, Human; identical to SEQ ID NO: 63711

SEQ ID NO: 90230 - DNA, 601 bp, Human; identical to SEQ ID NO: 63712

SEQ ID NO: 90231 - DNA, 601 bp, Human; identical to SEQ ID NO: 63713

SEQ ID NO: 90232 - DNA, 601 bp, Human; identical to SEQ ID NO: 63714

SEQ ID NO: 90233 - DNA, 601 bp, Human; identical to SEQ ID NO: 63715

SEQ ID NO: 90234 - DNA, 601 bp, Human; identical to SEQ ID NO: 63716

SEQ ID NO: 90235 - DNA, 601 bp, Human
cctgctcctgctccacgcggctgcgcagggccaggatgcggtggtgcagggctgcatacaactgacctgtgtccttggagctggcctgggaagggaggagggtatgagacccccggaccccagtcctaccccctcctgccttctgcagaacacaagtgccaagtcccaaggttcagaggtgacactgccacaaggccttgtggggaggccattggccctgggcctgccggcctctccccgaaaggatgccaccactcccaggtggctgggaatatcccagaggtcagggttggtggactcractgtgacaccatgacataggagagaggtgaccgccccacagggctgttagccctgaacacatcacaacccctcagccaaaccccagcggcttctctgggttgagaagaggacaaggaccatgatctctattcctgaaggctgggactggcgggtcccatagtgcttcttgtgtcccaggaagcaactgaagcccctcccccctcccctccccaccgtcctgcctgatctgtgtgcccaggaacccccacagggctggcaggatgaggggtcccagatgcacccgcgtggctggctcacc

SEQ ID NO: 90236 - DNA, 601 bp, Human; identical to SEQ ID NO: 90215

SEQ ID NO: 90237 - DNA, 601 bp, Human; identical to SEQ ID NO: 90216

SEQ ID NO: 90238 - DNA, 601 bp, Human; identical to SEQ ID NO: 90217

SEQ ID NO: 90239 - DNA, 601 bp, Human; identical to SEQ ID NO: 90218

SEQ ID NO: 90240 - DNA, 601 bp, Human; identical to SEQ ID NO: 90219

SEQ ID NO: 90241 - DNA, 601 bp, Human; identical to SEQ ID NO: 90220

SEQ ID NO: 90242 - DNA, 601 bp, Human; identical to SEQ ID NO: 90221

SEQ ID NO: 90243 - DNA, 601 bp, Human; identical to SEQ ID NO: 90222

SEQ ID NO: 90244 - DNA, 601 bp, Human; identical to SEQ ID NO: 90223

SEQ ID NO: 90245 - DNA, 601 bp, Human; identical to SEQ ID NO: 90224

SEQ ID NO: 90246 - DNA, 601 bp, Human; identical to SEQ ID NO: 90225

SEQ ID NO: 90247 - DNA, 601 bp, Human; identical to SEQ ID NO: 90226

SEQ ID NO: 90248 - DNA, 601 bp, Human; identical to SEQ ID NO: 90227

SEQ ID NO: 90249 - DNA, 601 bp, Human; identical to SEQ ID NO: 90228

SEQ ID NO: 90250 - DNA, 601 bp, Human; identical to SEQ ID NO: 63711

SEQ ID NO: 90251 - DNA, 601 bp, Human; identical to SEQ ID NO: 63712

SEQ ID NO: 90252 - DNA, 601 bp, Human; identical to SEQ ID NO: 63713

SEQ ID NO: 90253 - DNA, 601 bp, Human; identical to SEQ ID NO: 63714

SEQ ID NO: 90254 - DNA, 601 bp, Human; identical to SEQ ID NO: 63715

SEQ ID NO: 90255 - DNA, 601 bp, Human; identical to SEQ ID NO: 63716

SEQ ID NO: 90256 - DNA, 601 bp, Human; identical to SEQ ID NO: 90235

SEQ ID NO: 90257 - DNA, 601 bp, Human; identical to SEQ ID NO: 90215

SEQ ID NO: 90258 - DNA, 601 bp, Human; identical to SEQ ID NO: 90216

SEQ ID NO: 90259 - DNA, 601 bp, Human; identical to SEQ ID NO: 90217

SEQ ID NO: 90260 - DNA, 601 bp, Human; identical to SEQ ID NO: 90218

SEQ ID NO: 90261 - DNA, 601 bp, Human; identical to SEQ ID NO: 90219

SEQ ID NO: 90262 - DNA, 601 bp, Human; identical to SEQ ID NO: 90220

SEQ ID NO: 90263 - DNA, 601 bp, Human; identical to SEQ ID NO: 90221

SEQ ID NO: 90264 - DNA, 601 bp, Human; identical to SEQ ID NO: 90222

SEQ ID NO: 90265 - DNA, 601 bp, Human; identical to SEQ ID NO: 90223

SEQ ID NO: 90266 - DNA, 601 bp, Human; identical to SEQ ID NO: 90224

SEQ ID NO: 90267 - DNA, 601 bp, Human; identical to SEQ ID NO: 90225

SEQ ID NO: 90268 - DNA, 601 bp, Human; identical to SEQ ID NO: 90226

SEQ ID NO: 90269 - DNA, 601 bp, Human; identical to SEQ ID NO: 90227

SEQ ID NO: 90270 - DNA, 601 bp, Human; identical to SEQ ID NO: 90228

SEQ ID NO: 90271 - DNA, 601 bp, Human; identical to SEQ ID NO: 63711

SEQ ID NO: 90272 - DNA, 601 bp, Human; identical to SEQ ID NO: 63712

SEQ ID NO: 90273 - DNA, 601 bp, Human; identical to SEQ ID NO: 63713

SEQ ID NO: 90274 - DNA, 601 bp, Human; identical to SEQ ID NO: 63714

SEQ ID NO: 90275 - DNA, 601 bp, Human; identical to SEQ ID NO: 63715

SEQ ID NO: 90276 - DNA, 601 bp, Human; identical to SEQ ID NO: 63716

SEQ ID NO: 90277 - DNA, 601 bp, Human; identical to SEQ ID NO: 90235

SEQ ID NO: 90278 - DNA, 601 bp, Human; identical to SEQ ID NO: 90215

SEQ ID NO: 90279 - DNA, 601 bp, Human; identical to SEQ ID NO: 90216

SEQ ID NO: 90280 - DNA, 601 bp, Human; identical to SEQ ID NO: 90217

SEQ ID NO: 90281 - DNA, 601 bp, Human; identical to SEQ ID NO: 90218

SEQ ID NO: 90282 - DNA, 601 bp, Human; identical to SEQ ID NO: 90219

SEQ ID NO: 90283 - DNA, 601 bp, Human; identical to SEQ ID NO: 90220

SEQ ID NO: 90284 - DNA, 601 bp, Human; identical to SEQ ID NO: 90221

SEQ ID NO: 90285 - DNA, 601 bp, Human; identical to SEQ ID NO: 90222

SEQ ID NO: 90286 - DNA, 601 bp, Human; identical to SEQ ID NO: 90223

SEQ ID NO: 90287 - DNA, 601 bp, Human; identical to SEQ ID NO: 90224

SEQ ID NO: 90288 - DNA, 601 bp, Human; identical to SEQ ID NO: 90225

SEQ ID NO: 90289 - DNA, 601 bp, Human; identical to SEQ ID NO: 90226

SEQ ID NO: 90290 - DNA, 601 bp, Human; identical to SEQ ID NO: 90227

SEQ ID NO: 90291 - DNA, 601 bp, Human; identical to SEQ ID NO: 90228

SEQ ID NO: 90292 - DNA, 601 bp, Human; identical to SEQ ID NO: 63711

SEQ ID NO: 90293 - DNA, 601 bp, Human; identical to SEQ ID NO: 63712

SEQ ID NO: 90294 - DNA, 601 bp, Human; identical to SEQ ID NO: 63713

SEQ ID NO: 90295 - DNA, 601 bp, Human; identical to SEQ ID NO: 63714

SEQ ID NO: 90296 - DNA, 601 bp, Human; identical to SEQ ID NO: 63715

SEQ ID NO: 90297 - DNA, 601 bp, Human; identical to SEQ ID NO: 63716

SEQ ID NO: 90298 - DNA, 601 bp, Human; identical to SEQ ID NO: 90235

SEQ ID NO: 90299 - DNA, 601 bp, Human
acgagctggctgggaagaaccgagaggagctagacaaatactggcctcagcagtttgaggagaacaccacagtggtcaccacagtccgccgaggttggagctgctgagatgacgctcacagagctgagacgtacagtccagtccttggagatcgacctggactccatgagaaatctgaaggccagcttggagaacaacccgagggaggtggaggcccgctactccctacagatggtgcagctcatcgggatcctgctgcacctggagtcagagctggcacagacccgggcagagagacagygccaggcccaggagtaatgaggccctgctgaacatcaaggtcaagctggaggctgagatcgccacctaccgccgcctgctggaagatggcgaggacttcactcttggtgatgccttggacagcaggaactccatgcaaaccatccaaaagaccaccacccgccggaaagtggatggcaaagtggtgtctgagaccaacaacaccaaagttctgaggcattaagccagcagaagcagggtaccctttggggagcaggaggccaataaaaagtacagagttaaaaaaaaaaagatttaaaca

SEQ ID NO: 90300 - DNA, 601 bp, Human
gaacaccacagtggtcaccacagtccgccgaggttggagctgctgagatgacgctcacagagctgagacgtacagtccagtccttggagatcgacctggactccatgagaaatctgaaggccagcttggagaacaacccgagggaggtggaggcccgctactccctacagatggtgcagctcatcgggatcctgctgcacctggagtcagagctggcacagacccgggcagagagacagtgccaggcccaggagtaatgaggccctgctgaacatcaaggtcaagctggaggctgagatcrccacctaccgccgcctgctggaagatggcgaggacttcactcttggtgatgccttggacagcaggaactccatgcaaaccatccaaaagaccaccacccgccggaaagtggatggcaaagtggtgtctgagaccaacaacaccaaagttctgaggcattaagccagcagaagcagggtaccctttggggagcaggaggccaataaaaagtacagagttaaaaaaaaaaagatttaaacaatgaaaactataaaacattgatgaaagaaattgaggcagatacaaaaaaattgaaagacat

SEQ ID NO: 90301 - DNA, 601 bp, Human
tgctgagatgacgctcacagagctgagacgtacagtccagtccttggagatcgacctggactccatgagaaatctgaaggccagcttggagaacaacccgagggaggtggaggcccgctactccctacagatggtgcagctcatcgggatcctgctgcacctggagtcagagctggcacagacccgggcagagagacagtgccaggcccaggagtaatgaggccctgctgaacatcaaggtcaagctggaggctgagatcgccacctaccgccgcctgctggaagatggcgaggacttcaytcttggtgatgccttggacagcaggaactccatgcaaaccatccaaaagaccaccacccgccggaaagtggatggcaaagtggtgtctgagaccaacaacaccaaagttctgaggcattaagccagcagaagcagggtaccctttggggagcaggaggccaataaaaagtacagagttaaaaaaaaaaagatttaaacaatgaaaactataaaacattgatgaaagaaattgaggcagatacaaaaaaattgaaagacatttcatattcatagattggaaaaatctatattgttacaaag

SEQ ID NO: 90302 - DNA, 601 bp, Human
agacgtacagtccagtccttggagatcgacctggactccatgagaaatctgaaggccagcttggagaacaacccgagggaggtggaggcccgctactccctacagatggtgcagctcatcgggatcctgctgcacctggagtcagagctggcacagacccgggcagagagacagtgccaggcccaggagtaatgaggccctgctgaacatcaaggtcaagctggaggctgagatcgccacctaccgccgcctgctggaagatggcgaggacttcactcttggtgatgccttggacagcagsaactccatgcaaaccatccaaaagaccaccacccgccggaaagtggatggcaaagtggtgtctgagaccaacaacaccaaagttctgaggcattaagccagcagaagcagggtaccctttggggagcaggaggccaataaaaagtacagagttaaaaaaaaaaagatttaaacaatgaaaactataaaacattgatgaaagaaattgaggcagatacaaaaaaattgaaagacatttcatattcatagattggaaaaatctatattgttacaaagtccatactacccaaagccatctaca

SEQ ID NO: 90303 - DNA, 601 bp, Human
gagaaatctgaaggccagcttggagaacaacccgagggaggtggaggcccgctactccctacagatggtgcagctcatcgggatcctgctgcacctggagtcagagctggcacagacccgggcagagagacagtgccaggcccaggagtaatgaggccctgctgaacatcaaggtcaagctggaggctgagatcgccacctaccgccgcctgctggaagatggcgaggacttcactcttggtgatgccttggacagcaggaactccatgcaaaccatccaaaagaccaccacccgccggaragtggatggcaaagtggtgtctgagaccaacaacaccaaagttctgaggcattaagccagcagaagcagggtaccctttggggagcaggaggccaataaaaagtacagagttaaaaaaaaaaagatttaaacaatgaaaactataaaacattgatgaaagaaattgaggcagatacaaaaaaattgaaagacatttcatattcatagattggaaaaatctatattgttacaaagtccatactacccaaagccatctacaattcctatcaaaacaccgatgacattcttcagagaaatgga

SEQ ID NO: 90304 - DNA, 601 bp, Human; identical to SEQ ID NO: 20649

SEQ ID NO: 90305 - DNA, 601 bp, Human; identical to SEQ ID NO: 20650

SEQ ID NO: 90306 - DNA, 601 bp, Human; identical to SEQ ID NO: 20651

SEQ ID NO: 90307 - DNA, 601 bp, Human; identical to SEQ ID NO: 20652

SEQ ID NO: 90308 - DNA, 601 bp, Human; identical to SEQ ID NO: 20653

SEQ ID NO: 90309 - DNA, 601 bp, Human; identical to SEQ ID NO: 20654

SEQ ID NO: 90310 - DNA, 601 bp, Human; identical to SEQ ID NO: 20655

SEQ ID NO: 90311 - DNA, 601 bp, Human; identical to SEQ ID NO: 20656

SEQ ID NO: 90312 - DNA, 601 bp, Human; identical to SEQ ID NO: 20657

SEQ ID NO: 90313 - DNA, 601 bp, Human; identical to SEQ ID NO: 20658

SEQ ID NO: 90314 - DNA, 601 bp, Human; identical to SEQ ID NO: 20659

SEQ ID NO: 90315 - DNA, 601 bp, Human; identical to SEQ ID NO: 20660

SEQ ID NO: 90316 - DNA, 601 bp, Human; identical to SEQ ID NO: 20661

SEQ ID NO: 90317 - DNA, 601 bp, Human; identical to SEQ ID NO: 20662

SEQ ID NO: 90318 - DNA, 601 bp, Human; identical to SEQ ID NO: 20663

SEQ ID NO: 90319 - DNA, 601 bp, Human; identical to SEQ ID NO: 20664

SEQ ID NO: 90320 - DNA, 601 bp, Human; identical to SEQ ID NO: 20665

SEQ ID NO: 90321 - DNA, 601 bp, Human; identical to SEQ ID NO: 20666

SEQ ID NO: 90322 - DNA, 601 bp, Human; identical to SEQ ID NO: 20667

SEQ ID NO: 90323 - DNA, 601 bp, Human; identical to SEQ ID NO: 40198

SEQ ID NO: 90324 - DNA, 601 bp, Human; identical to SEQ ID NO: 40197

SEQ ID NO: 90325 - DNA, 601 bp, Human; identical to SEQ ID NO: 40196

SEQ ID NO: 90326 - DNA, 601 bp, Human; identical to SEQ ID NO: 40195

SEQ ID NO: 90327 - DNA, 601 bp, Human; identical to SEQ ID NO: 40194

SEQ ID NO: 90328 - DNA, 601 bp, Human; identical to SEQ ID NO: 40193

SEQ ID NO: 90329 - DNA, 601 bp, Human; identical to SEQ ID NO: 40192

SEQ ID NO: 90330 - DNA, 601 bp, Human; identical to SEQ ID NO: 40191

SEQ ID NO: 90331 - DNA, 601 bp, Human; identical to SEQ ID NO: 40190

SEQ ID NO: 90332 - DNA, 601 bp, Human; identical to SEQ ID NO: 40189

SEQ ID NO: 90333 - DNA, 601 bp, Human; identical to SEQ ID NO: 40188

SEQ ID NO: 90334 - DNA, 601 bp, Human; identical to SEQ ID NO: 40187

SEQ ID NO: 90335 - DNA, 601 bp, Human; identical to SEQ ID NO: 40186

SEQ ID NO: 90336 - DNA, 601 bp, Human; identical to SEQ ID NO: 40185

SEQ ID NO: 90337 - DNA, 601 bp, Human
tattttatattagtcttcatctccaaatttaattgtaatgtattcatttatttttgaataatatgagaagtagtttaaatatatctacttgtcggtaggttattacattagagcctgttgtcctttgattgacaaaatagcaagtctgtaaaataagctacttataataaataaataaatgctgccaaggtgttatgtataacttcattggaattacaaattatcaagcactacttccaagaaaaatttcaagtgacaattttagacacaaattcagaatattaccgtattgttaattttkttttttttttttttttttttttgcctagaaatgaggaacctgttggtatcatgaatacaaataaagctgttgaataaactcaaaattgtattttgctgaatttggtcaactgattattaacacttagacaacgagctacaaactttgacaacagtgattaatatgttctgctatagccaagacatttttatgtttaagttactaattttgaaactccaaagcaatcctcacaaactgaacaataatttacagggtttaacttttatttgctacatcagtgttaaagtaactcaggtttca

SEQ ID NO: 90338 - DNA, 601 bp, Human
tgtattttatattagtcttcatctccaaatttaattgtaatgtattcatttatttttgaataatatgagaagtagtttaaatatatctacttgtcggtaggttattacattagagcctgttgtcctttgattgacaaaatagcaagtctgtaaaataagctacttataataaataaataaatgctgccaaggtgttatgtataacttcattggaattacaaattatcaagcactacttccaagaaaaatttcaagtgacaattttagacacaaattcagaatattaccgtattgttaattwttttttttttttttttttttttttgcctagaaatgaggaacctgttggtatcatgaatacaaataaagctgttgaataaactcaaaattgtattttgctgaatttggtcaactgattattaacacttagacaacgagctacaaactttgacaacagtgattaatatgttctgctatagccaagacatttttatgtttaagttactaattttgaaactccaaagcaatcctcacaaactgaacaataatttacagggtttaacttttatttgctacatcagtgttaaagtaactcaggttt

SEQ ID NO: 90339 - DNA, 601 bp, Human
atgtttgttttatgtattttatattagtcttcatctccaaatttaattgtaatgtattcatttatttttgaataatatgagaagtagtttaaatatatctacttgtcggtaggttattacattagagcctgttgtcctttgattgacaaaatagcaagtctgtaaaataagctacttataataaataaataaatgctgccaaggtgttatgtataacttcattggaattacaaattatcaagcactacttccaagaaaaatttcaagtgacaattttagacacaaattcagaatattaccrtattgttaatttttttttttttttttttttttttttgcctagaaatgaggaacctgttggtatcatgaatacaaataaagctgttgaataaactcaaaattgtattttgctgaatttggtcaactgattattaacacttagacaacgagctacaaactttgacaacagtgattaatatgttctgctatagccaagacatttttatgtttaagttactaattttgaaactccaaagcaatcctcacaaactgaacaataatttacagggtttaacttttatttgctacatcagtgttaaag

SEQ ID NO: 90340 - DNA, 601 bp, Human
agtttacgtatgtaagaaacctgcacgtgtactcctgaacttaaaataaacgttaaaaataaaagttaaattaatttaatttaaaaaataaaaatattctaaaaaaagtataaaaacttataaggagtcattgtaattccagtgtaaaaaaacagtaactatttagtaatgacctatatgtttgttttatgtattttatattagtcttcatctccaaatttaattgtaatgtattcatttatttttgaataatatgagaagtagtttaaatatatctacttgtcggtaggttattacattrgagcctgttgtcctttgattgacaaaatagcaagtctgtaaaataagctacttataataaataaataaatgctgccaaggtgttatgtataacttcattggaattacaaattatcaagcactacttccaagaaaaatttcaagtgacaattttagacacaaattcagaatattaccgtattgttaatttttttttttttttttttttttttttgcctagaaatgaggaacctgttggtatcatgaatacaaataaagctgttgaataaactcaaaattgtattttgctgaatttggtcaa

SEQ ID NO: 90341 - DNA, 601 bp, Human
gaacaagtactttggaaaagagtttagcagttcttcagaaacatacagttctcacatgaggcagcaattccacttatagcatcaacccaaaagaaagtaaaacatgtttatgcaaaaacatgtatagcaatattcctagtagccacaattggaaacaatcaaaaggccaatgcactgacaaatgaacaactaaattatgacatatccatactataaaatattatagaagtgaaaaggaaatgaagtattaaaacacacaaccatatgaattaaaataaaaaccataaaacaacacaaaaakttaggctaagtgaaatgtcatttacacagcacccaagactgtataattccatttatatgaaatatctagagagaataacctatatagaaagaaaacaaattggtgttagactaggactaagcagtcatgagaattgattttggtgtcattgaagtttcttctgtgttgataaaaatgttctaaaattatataatgatgatagtttcatgactctgtaaacatagtaaaaatatttggattttatggcataaataggtggattttaagctatcgaaattaaatctcattttcaagtctgtt

SEQ ID NO: 90342 - DNA, 601 bp, Human
aaacctgcccagaataactttctgtttctgaaccatttagtgactacttttgtcctccaactaaggacacaactaaggattagcctgacttcgaataacaacattagttttgcttgtttgtgtaattgaattatataatatgtactcattagtgtctttttctttactgtagcagttcttgggtaattccattgctatgtagtattctgttgactgataaaccacagattacgtctttattttatgatgaatagatatttgggttgctaacaatttttggacactgttgataattctgtcrtgaacactcttctatacagcattagatttatatatttatgtatatctgttgggtatataattgagagcagaattgctgtgataaaagtgcatgaatacttatgatttacttcttgactttaaacttttttgaagtgtattttgttaatttccaaaatttaaagatattttagtaatagtatttttaacctcctttatttccactatggctggattatatagtcttcataatattgaatctttttatacttcctaagtcttgatttattgcccaccacatatcacttcaagtaaagattaa

SEQ ID NO: 90343 - DNA, 601 bp, Human
acatacactaagtgaatagttcaaaaatggaagatcatcttgaacattatcttggggtgaagataccaatttaactactgttcaggtcacggtataggctatcaaaacctgcccagaataactttctgtttctgaaccatttagtgactacttttgtcctccaactaaggacacaactaaggattagcctgacttcgaataacaacattagttttgcttgtttgtgtaattgaattatataatatgtactcattagtgtctttttctttactgtagcagttcttgggtaattccattgctwtgtagtattctgttgactgataaaccacagattacgtctttattttatgatgaatagatatttgggttgctaacaatttttggacactgttgataattctgtcatgaacactcttctatacagcattagatttatatatttatgtatatctgttgggtatataattgagagcagaattgctgtgataaaagtgcatgaatacttatgatttacttcttgactttaaacttttttgaagtgtattttgttaatttccaaaatttaaagatattttagtaatagtatttttaacctccttta

SEQ ID NO: 90344 - DNA, 601 bp, Human
tatgatggagcctctaggattttctctattttctgtgcttattttctatctgattcctagaattttgtaaatgatttatatatctcataaaatatacatttaaatataaaacacaaaagataaatatacatacactaagtgaatagttcaaaaatggaagatcatcttgaacattatcttggggtgaagataccaatttaactactgttcaggtcacggtataggctatcaaaacctgcccagaataactttctgtttctgaaccatttagtgactacttttgtcctccaactaaggacamaactaaggattagcctgacttcgaataacaacattagttttgcttgtttgtgtaattgaattatataatatgtactcattagtgtctttttctttactgtagcagttcttgggtaattccattgctatgtagtattctgttgactgataaaccacagattacgtctttattttatgatgaatagatatttgggttgctaacaatttttggacactgttgataattctgtcatgaacactcttctatacagcattagatttatatatttatgtatatctgttgggtatataattgagagca

SEQ ID NO: 90345 - DNA, 601 bp, Human; identical to SEQ ID NO: 90337

SEQ ID NO: 90346 - DNA, 601 bp, Human; identical to SEQ ID NO: 90338

SEQ ID NO: 90347 - DNA, 601 bp, Human; identical to SEQ ID NO: 90339

SEQ ID NO: 90348 - DNA, 601 bp, Human; identical to SEQ ID NO: 90340

SEQ ID NO: 90349 - DNA, 601 bp, Human; identical to SEQ ID NO: 90341

SEQ ID NO: 90350 - DNA, 601 bp, Human; identical to SEQ ID NO: 90342

SEQ ID NO: 90351 - DNA, 601 bp, Human; identical to SEQ ID NO: 90343

SEQ ID NO: 90352 - DNA, 601 bp, Human; identical to SEQ ID NO: 90344

SEQ ID NO: 90353 - DNA, 601 bp, Human
gcatccatgggagaccatgcaggcactctgaggcaggggctgcaagcctagtgcctgctggggcagcaggtgaacagagaggtgtaactgctgtgacagaagtcatggagtccttggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacwggtcagttccaccagttgtcacaagagaatgcaggctcaggtggccagaacttctcgcttttccagaagagtccgatattctgatttcattatatatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagc

SEQ ID NO: 90354 - DNA, 601 bp, Human
gaccatgcaggcactctgaggcaggggctgcaagcctagtgcctgctggggcagcaggtgaacagagaggtgtaactgctgtgacagaagtcatggagtccttggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacaggtcagttccascagttgtcacaagagaatgcaggctcaggtggccagaacttctcgcttttccagaagagtccgatattctgatttcattatatatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggc

SEQ ID NO: 90355 - DNA, 601 bp, Human
gacagaagtcatggagtccttggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacaggtcagttccaccagttgtcacaagagaatgcaggctcaggtggccagaacttctcgcttttccagaagagtccgatattctgatttcattatrtatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaataca

SEQ ID NO: 90356 - DNA, 601 bp, Human
tggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacaggtcagttccaccagttgtcacaagagaatgcaggctcaggtggccagaacttctcgcttttccagaagagtccgatattctgatttcattatatatagtattctgattaaacmagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtg

SEQ ID NO: 90357 - DNA, 601 bp, Human
aatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacaggtcagttccaccagttgtcacaagagaatgcaggctcaggtggccagaacttctcgcttttccagaagagtccgatattctgatttcattatatatagtattctgattaaaccagacaataaagcaagcagataaaatatttaaaktataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgtctgcaatcttagctacttgggtagc

SEQ ID NO: 90358 - DNA, 601 bp, Human
ttttccagaagagtccgatattctgatttcattatatatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggycaacatggtgaaaccctgtctctattaaaaatacaaaaattagctgggcatggtggtgcatgtctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagag

SEQ ID NO: 90359 - DNA, 601 bp, Human
aaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgyctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtgtcagctctt

SEQ ID NO: 90360 - DNA, 601 bp, Human
gataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgtctgcaatctyagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtgtcagctcttaatgggtcat

SEQ ID NO: 90361 - DNA, 601 bp, Human
ggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgtctgcaatcttagctacttgggtagctaaggcaggagaattgctggaacccrggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtgtcagctcttaatgggtcatggacacgttacaagctaggcgccgtgctgagcactttacat

SEQ ID NO: 90362 - DNA, 601 bp, Human
tcaagagttcaaggcctgcctggccaacatggtgaaaccctgtctctattaaaaatacaaaaattagctgggcatggtggtgcatgtctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttrcactcctttctgggtgttaagaggaggtctagaggaagctggacaactcttagcttgtagtaagcacagtggaagtgtcagctcttaatgggtcatggacacgttacaagctaggcgccgtgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaa

SEQ ID NO: 90363 - DNA, 601 bp, Human
tggtgcatgtctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtrtcagctcttaatgggtcatggacacgttacaagctaggcgccgtgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctatgggggcacagagacttaatgaaatcatggagaggggaattgctttgtcaaccacaagca

SEQ ID NO: 90364 - DNA, 601 bp, Human
ttaagaggaggtctagaggaagctggacaactcttagcttgtagtaagcacagtggaagtgtcagctcttaatgggtcatggacacgttacaagctaggcgccgtgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctrtgggggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccaatacattgtgaagaaataaatctctgtgcttaaaactggttcatcccaaaatattttgaactgacacacaataggtgctaaataaatgtgtgt

SEQ ID NO: 90365 - DNA, 601 bp, Human
gaggaggtctagaggaagctggacaactcttagcttgtagtaagcacagtggaagtgtcagctcttaatgggtcatggacacgttacaagctaggcgccgtgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctatggrggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccaatacattgtgaagaaataaatctctgtgcttaaaactggttcatcccaaaatattttgaactgacacacaataggtgctaaataaatgtgtgttaac

SEQ ID NO: 90366 - DNA, 601 bp, Human
gattagataatttgcccatggccagacagctagtataagaggaggaggtggattgactgcagacattctgtcttcaaaccactacactatgctatgggggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccratacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaaggccaggagtatgggaggtatcaatgtttgcccagcacagaacagggtgccaagaagagaaaagttgacggggtgcatactcggactggaaactggaagggtgagaacagaggg

SEQ ID NO: 90367 - DNA, 601 bp, Human
cccagtgggtacaatggtccctggtgggttgtgctacaatgttagcccatggtcttatgtgtttttcaaatgtgtaaagtaggatgctggaaccactcttagaaccagataccaatacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaakgccaggagtatgggaggtatcaatgtttgcccagcacagaacagggtgccaagaagagaaaagttgacggggtgcatactcggactggaaactggaagggtgagaacagagggtaaaggatagagatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaatta

SEQ ID NO: 90368 - DNA, 601 bp, Human
gatgctggaaccactcttagaaccagataccaatacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaaggccaggagtatgggaggtatcaatgtttgcccagcacagaacagggtgccaagaagagaaaagttgacggggtgcatactckgactggaaactggaagggtgagaacagagggtaaaggatagagatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattatttttaggatccaagtttgaaaacaattttaggctactagatatgaacaacatcttgattatgtagttgaaggaaattaaag

SEQ ID NO: 90369 - DNA, 601 bp, Human
agaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaaggccaggagtatgggaggtatcaatgtttgcccagcacagaacagggtgccaagaagagaaaagttgacggggtgcatactcggactggaaactggaagggtgagaacagagggtaaaggatagasatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattatttttaggatccaagtttgaaaacaattttaggctactagatatgaacaacatcttgattatgtagttgaaggaaattaaagatgaatggtttaattaaaaattaatcagaatgaaaacgattga

SEQ ID NO: 90370 - DNA, 601 bp, Human
ggccaggagtatgggaggtatcaatgtttgcccagcacagaacagggtgccaagaagagaaaagttgacggggtgcatactcggactggaaactggaagggtgagaacagagggtaaaggatagagatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattmtttttaggatccaagtttgaaaacaattttaggctactagatatgaacaacatcttgattatgtagttgaaggaaattaaagatgaatggtttaattaaaaattaatcagaatgaaaacgattgattactaatatatctgcaatggtttattttcctgagtggcagactcactaaggtttttgaatactcctgtgtgattgctctatgtatgtatgtatgtatgtatgtatgcatgtatctatctatctgttgtctaataaaatggatcacatctctgctaataaaaacactacactggc

SEQ ID NO: 90371 - DNA, 601 bp, Human
aagaaacaccataagaacaaatataattcttgcttatgttaaccatgcaatgaagcagagagaaaaagtcagtggcctctttaggaggactgtagtgtgggaagaaataactaaactgggtttcaatcctggcctggccaggatctggagcaagtgagttaatctttctaagccttgagtagtttcttcttcttcttcttcttcttcctcccccttctcctcttcttcttcctcctccttctcctcttcttcttcttcttcttcttcttcctcttcttcttcttcctcctcctcctcctcytcttcttcttcctcttcctcttcctcttcctcttcttcctcttcctcttattcttcttcgtcgtcttcgtcttctttttattttcaaagtgaaagcaagtttattaagaaagtaaaggaataaaagaatggccactccatagacagagtagcctgaaccttgagttcttctataaagtcactatgaatttatactcattttgaaagtgggtgtcaatatgtctgtccactttgcacagctgttatgtggacaaaaggagatctgtgtgaaagtgtaacacagagcctaaactataacagg

SEQ ID NO: 90372 - DNA, 601 bp, Human
aagaacaaatataattcttgcttatgttaaccatgcaatgaagcagagagaaaaagtcagtggcctctttaggaggactgtagtgtgggaagaaataactaaactgggtttcaatcctggcctggccaggatctggagcaagtgagttaatctttctaagccttgagtagtttcttcttcttcttcttcttcttcctcccccttctcctcttcttcttcctcctccttctcctcttcttcttcttcttcttcttcttcctcttcttcttcttcctcctcctcctcctcctcttcttcttcytcttcctcttcctcttcctcttcttcctcttcctcttattcttcttcgtcgtcttcgtcttctttttattttcaaagtgaaagcaagtttattaagaaagtaaaggaataaaagaatggccactccatagacagagtagcctgaaccttgagttcttctataaagtcactatgaatttatactcattttgaaagtgggtgtcaatatgtctgtccactttgcacagctgttatgtggacaaaaggagatctgtgtgaaagtgtaacacagagcctaaactataacaggtaagcaacacag

SEQ ID NO: 90373 - DNA, 601 bp, Human
tggctacttggcaggactgggtcagtgaggaccaacaaaaagaagacatcagattataccctgggggtttgtatttcttgtgtttctttctcttctttgtactaaaatatttacccatgactgggaaagagcaactggagtctttgtagcattatcttagcaaaaatttacaaagtttggaaaacaatattgcccatattgtgtggtgtgtcctgtgacactcaggattcaagtgttggccgaagccactaaatgtgagatgaagccattacaaggcagtgtgcacatctgtccacccaarctggatgccaacatttcacaaatagtgcttgcgtgacacaaatgcagttccaggaggcccaaatgaaaatgtttgtactgaaatttgttaaagcttcccgacaaactagatttatcagtaaggattgttttctgcaagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatgtctccccagctcccca

SEQ ID NO: 90374 - DNA, 601 bp, Human
gccagcaggatccaatggtgtatatgtctccccagctccccattcagtgatatcatgtcagtagcttgaaattatccgtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacacacctgacaacattacccttttattcagttttttaaaagataagtttccagctcatcgggstggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcgggagttcgagaccagcctgactaacatagtgaaaccctgtctctactaaaaatacaaaattagttgggggtggtggcacaagcctgtaatcccagctac

SEQ ID NO: 90375 - DNA, 601 bp, Human
ccatctgtccactgtctccaacacgatctttataaaacacacctgacaacattacccttttattcagttttttaaaagataagtttccagctcatcggggtggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcrggagttcgagaccagcctgactaacatagtgaaaccctgtctctactaaaaatacaaaattagttgggggtggtggcacaagcctgtaatcccagctactcaggaggttgaggcaggggaattgcttgaacctgggaggcggaggttgcggtgagcctagattgctccactgcactccagcctgggcaacaagagcgaaactccatctcaaaaaaataaataaataaataaagtagattacatcagatacctctggcctaggttgtttatgaccaactctcctgctgagaataactagaa

SEQ ID NO: 90376 - DNA, 601 bp, Human
tgatgaccaggacctccgatgaaagccatgggtgctgattgggaaggcattgtcttttatgtgctatggtcttaaagcttcatccaggaagcagaactcggggggtgctgaggacccagaaccgagaataagattagtcagagatttcctgtgggcagaaatcataaggacgccaactgtttgggtgagataagacgaaaccaagagtggacttgtggccagaagcgtgaggaagagggagagagcttcccttgtcccctttcttcctctccctaagccacagtgattgacagcccccccctttggagtcagagcaggcttgagactggactgggaaaggagggtgggtcaggatacagagcaggaaggctgggagtgcagggcaggagcaaggggctggggcattcattgtgcctgatctctcccactttacctggggtaaagaagcatatgcaaaagccacggtgtgagtatttcccaagtgccagggtcagggcatgattcatcacgtgcagcatttcattcaatccttatagtaaccgatgatgtggcttctattattagctctatcagataatgaaactgagaccaagacaggctc

SEQ ID NO: 90377 - DNA, 601 bp, Human
tttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcrtttttgaaacacgtttgagaaatagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttg

SEQ ID NO: 90378 - DNA, 601 bp, Human
tactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcatttttgaaacacgtttgagaaayagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttgaaaacaatgccaggttgggacag

SEQ ID NO: 90379 - DNA, 601 bp, Human
cctggatttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagaatattgtaagtaaggaagttaatgygtatcagagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttg

SEQ ID NO: 90380 - DNA, 601 bp, Human
ttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagaatattgtaagtaaggaagttaatgtgtatcasagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaa

SEQ ID NO: 90381 - DNA, 601 bp, Human
caactttttcctacccataaaataggagcatgcttacctttttcctaatgttccaggccccgggtctagaatattgtaagtaaggaagttaatgtgtatcagagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagargttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctc

SEQ ID NO: 90382 - DNA, 601 bp, Human
agggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcrtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccc

SEQ ID NO: 90383 - DNA, 601 bp, Human
agtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgttta

SEQ ID NO: 90384 - DNA, 601 bp, Human
tctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcrggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtga

SEQ ID NO: 90385 - DNA, 601 bp, Human
ttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaggaggtgaggcacaggtcccaggtcaggctggccrgagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctattta

SEQ ID NO: 90386 - DNA, 601 bp, Human
ctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaggaggtgaggcacaggtcccaggtcaggctggccggagctctgtttattacgtctcacagctttgagtcctgctctcaaccagagaggccctttaccaagaagaaaggattgggacccagaatcaggtcactggctgaggtagagaggaagccrggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacacgtggttagtggccaccctattgggcagt

SEQ ID NO: 90387 - DNA, 601 bp, Human
acctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggamatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccc

SEQ ID NO: 90388 - DNA, 601 bp, Human
cagcctctttgtgtctttgctgtcctaagaaacctgggccaggccaggcgcagtggctcacgcctgtaatcccagcactttgagaggccaaggtgggcagatcacgaggtcaggagtttgagaccagcctggccaacatggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggygacagagcaagactccgtctcgggaaaattaattaataaataaataaacctaggtcccagagtcccacagaatggcagacaggagcacctgggggcttttagggtatggcatttcccctgtactaactctgggctgtccagagggccatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacag

SEQ ID NO: 90389 - DNA, 601 bp, Human
gacagagcaagactccgtctcgggaaaattaattaataaataaataaacctaggtcccagagtcccacagaatggcagacaggagcacctgggggcttttagggtatggcatttcccctgtactaactctgggctgtccagagggccatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacagyggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaagaacctggtcacaggactc

SEQ ID NO: 90390 - DNA, 601 bp, Human
actaacattaataatatgtgatgctaataattctgataaatgatgcttatttttctaaggcggtttactaaagccaaagtctaacagttatctcacattaacacagctgagtatgatctcagatgctattttcaaacggttttccttggttgtgtatttagcctaaatctccagcaattacatggtatttcatttcatttctgtaatgctaactgtactttaaaatattaaattacaactgatggaatctcccttcccttatggaaacagatccaaggcaaacctatagagtttgtggacygaaggggataggggctgttcatttttaaaacaattactattctctgaaagtgtgttattttcaaagcgcccatcagtgacagtttcccaataggtcaattcactatttttcttaactggacagcaaatattttaagggtatctgatagctccctctgagtcccctatgtattgttgattcttcactaaactactaattgttctaaatggaatttaggcatcagcatatttccatgatctttcacacccctacacagagattttcttcttctcctaggttaaactaatactcagtaccata

SEQ ID NO: 90391 - DNA, 601 bp, Human
tccaggaatcagattttgttaaagcaatcctgaaacacgtagtgaggaaatgctaacaagatcgtagctgactttgcctaacacttcccaggtttaggccataaaatggtcatttgtaagctttgaacgagcacaagtaacaaagctgcaggcatttgtgagagtcttgggagcaggggctgttgtatggacaatttacgttaaaagcagacaagattctgaaagaacaaagtgggaaatggatgagatccatcaatggctaaacctgaaggtgaattcttaggatttcatatggattcartggaagagaaatagaaaatttgaacagactgtaaggggtacatgactccagagggatcctcgtggttttggaatcaaacgaaggcgccaacaaagtttaggccagctgtaaacacttctgtgggcactctcttgatggccagcatggggtactatgggcaacctcactaacgcagcagttctcagttagggcgattttgatccccagaggatattcagcagtgtctagagacattgtttgttgtcacactggtctggaggagtgctactcgcatctagtgggaagaggccaggggtgctg

SEQ ID NO: 90392 - DNA, 601 bp, Human
tgcaaaagttggcaaactccaggttagctatggacataatcccagctctgatccacaagaattaggagaagctcaggattgaaatgagactttattcctttgcctgtgatcagagtcaggggcagagcttggctgctaagaacacaagttgagaaacacgttccaactgtgttaccacgtaccatttaccctttgtctcctccatgtttctactcaatagatgatctacccagcatgtccaggaatcagattttgttaaagcaatcctgaaacacgtagtgaggaaatgctaacaagatcrtagctgactttgcctaacacttcccaggtttaggccataaaatggtcatttgtaagctttgaacgagcacaagtaacaaagctgcaggcatttgtgagagtcttgggagcaggggctgttgtatggacaatttacgttaaaagcagacaagattctgaaagaacaaagtgggaaatggatgagatccatcaatggctaaacctgaaggtgaattcttaggatttcatatggattcaatggaagagaaatagaaaatttgaacagactgtaaggggtacatgactccagagggatcctcgt

SEQ ID NO: 90393 - DNA, 601 bp, Human
tagccaacctttcattttttattataaagcagttattaagttaaaagttacatgtatgtacatatagacagggaaattatactaatagagtgtgatctaaaactctgtaagaagtctttttaaataaaatgaaaaaatcaactttctgcattataaaaatattgcatagaaacatttaattaattaattggaaggaatctttgcaaatatattgttaattttcttcttgaccattcaactttcttttcttttttttttttttttttcctaagacagagtcacactctgttgcccaggctgragtgcaatggcacgatcatggttcactgcaaccttgaactcctgggcctatgcaatcctcttgcctcagcctcccaagtagctgggactataagcacccaccaccacacctggttaatttttaaaattcctttgtagatatggggtctcactatgttacccaggctggtctcaaacttctggcctcaagtgatcttcctgcctcagcctgctttcaaggggattacaggtgtgagtcactgcacctggcccaatcattcaactttcttattcaatgaactttttaaaaaataactttatt

SEQ ID NO: 90394 - DNA, 601 bp, Human
ttttacaactattgtttaacttacaccaagtaatatctgtttattttagaaaacctaaagtacaaaaatgcaaaagaggatttaaattcactcagagatattataatattttgatgtatttttctgggttctctttttatactgcactcatttcaaaattccaaaccatttatatataaaggagattgattacagaatcaatcccttacattgtggaagaaatttccattaatagatagagtctatggcccaatcccttgaatttgggctgccatgtagcctgaccaatagaagatagcasaagtgacagtgcatagtttctagcctatgcctcaagaggcttggagcatcttcttcctctcttacaactctgcttccaccatgagtacaaatctgagctagcctgctggagaatgaggccatagggatcagcatgaattatccccaacaacatgctagctgaccgcatatgcatgagcaaacccagtagagatccgccacactctttccacatcaaccagactacacaaacctacagatccatgtgcaaaattaactatccattgttgcatgaaaccaagtgttgtggttgtctgttata

SEQ ID NO: 90395 - DNA, 601 bp, Human
gtacccccatctgtgaggtcttctttgttaactctcagtcatcccaaattctcccttatctaaatatatatggaattggcaggcatccttatatagttttatcccagtttaatattgatgtgttattctgtaaatttccctgtgtcctacctacctagaatggtaagctgtatgaaggttaaggcagttttacatcacaagcctgtgtaagtgacaggggcatgggtgtttaacaaatacttgctggcacagagattgagtaacccattttttttttctggactagtaagtgggaaaaaaatatagggagaagacttgtctttggaaccagtggtccttagttatctgatttcacaaaggatcacaatgtaaaaattatattctgcctcaggagaaacatggggcaaatatggcctcttactttgacattcaccacatccttcaaattggcagtccccctgaattaacagtaacaaggatttgccaaaatgatacagggaatggagagagcaaaattctcttcccttgcatagaagcagagcaatttctggttccaaaaagatggcccaaatgggagaaaatgttttccaaagacacttat

SEQ ID NO: 90396 - DNA, 601 bp, Human
taggaatggaagggagaaaaaacataagtctgaaacaagggaaaaaacataagtctgaaacaagggacattggggcagattatgaaaagagtataaattattttacaattatgccttatttttttattgtactttaagttctagggtacatgtgcacaatgtgcaggtttgttacataggtatacgtgtgtcatgttggtttgctgcacccatcaacttgtcatttacattaggtatatctcctaatgctatccctcccccagccccccaccacccgacatgccccggtatgtgatgttcycttccctgtttccaagttgtctcattgttcaattctcacctatgagcgagaacatgcagtgtttggttttctgtccttgtgatagtttgctgagaatgatggtttccagctgcatccatgttcctgcaaaggaagtgaactcatccttttttatggttgcagagtattccatggtgtatatgtgccacaaaaaaatatgccttcttgattagacagctgcactgtggtttagcaacaaattatcatgggacttcatttttgttatatactttacagtatatatctgtgagagaaaaagaa

SEQ ID NO: 90397 - DNA, 601 bp, Human
aaatgggaaagtttataatttagctaatctgaaaattggaggctacaagaagcatggattgacagcctcatttgaagggatttctgactgccaaaaatcaggaatttaaacccagagtctaaggaatgtgaaagggtaagaaagtgacaaggcagtaggaatggaagggagaaaaaacataagtctgaaacaagggaaaaaacataagtctgaaacaagggacattggggcagattatgaaaagagtataaattattttacaattatgccttatttttttattgtactttaagttctaggatacatgtgcacaatgtgcaggtttgttacataggtatacgtgtgtcatgttggtttgctgcacccatcaacttgtcatttacattaggtatatctcctaatgctatccctcccccagccccccaccacccgacatgccccggtatgtgatgttcccttccctgtttccaagttgtctcattgttcaattctcacctatgagcgagaacatgcagtgtttggttttctgtccttgtgatagtttgctgagaatgatggtttccagctgcatccatgttcctgcaaaggaagtgaactcatc

SEQ ID NO: 90398 - DNA, 601 bp, Human
tgtaaatgggaaagtttataatttagctaatctgaaaattggaggctacaagaagcatggattgacagcctcatttgaagggatttctgactgccaaaaatcaggaatttaaacccagagtctaaggaatgtgaaagggtaagaaagtgacaaggcagtaggaatggaagggagaaaaaacataagtctgaaacaagggaaaaaacataagtctgaaacaagggacattggggcagattatgaaaagagtataaattattttacaattatgccttatttttttattgtactttaagttcttgggtacatgtgcacaatgtgcaggtttgttacataggtatacgtgtgtcatgttggtttgctgcacccatcaacttgtcatttacattaggtatatctcctaatgctatccctcccccagccccccaccacccgacatgccccggtatgtgatgttcccttccctgtttccaagttgtctcattgttcaattctcacctatgagcgagaacatgcagtgtttggttttctgtccttgtgatagtttgctgagaatgatggtttccagctgcatccatgttcctgcaaaggaagtgaactc

SEQ ID NO: 90399 - DNA, 601 bp, Human
cttgtaaatgggaaagtttataatttagctaatctgaaaattggaggctacaagaagcatggattgacagcctcatttgaagggatttctgactgccaaaaatcaggaatttaaacccagagtctaaggaatgtgaaagggtaagaaagtgacaaggcagtaggaatggaagggagaaaaaacataagtctgaaacaagggaaaaaacataagtctgaaacaagggacattggggcagattatgaaaagagtataaattattttacaattatgccttatttttttattgtactttaagttmtagggtacatgtgcacaatgtgcaggtttgttacataggtatacgtgtgtcatgttggtttgctgcacccatcaacttgtcatttacattaggtatatctcctaatgctatccctcccccagccccccaccacccgacatgccccggtatgtgatgttcccttccctgtttccaagttgtctcattgttcaattctcacctatgagcgagaacatgcagtgtttggttttctgtccttgtgatagtttgctgagaatgatggtttccagctgcatccatgttcctgcaaaggaagtgaac

SEQ ID NO: 90400 - DNA, 601 bp, Human
tagagtgaataagacctaatggataatgaacaccatttttagataaacattaggctgcggaggaatgccacacttgtaaatgggaaagtttataatttagctaatctgaaaattggaggctacaagaagcatggattgacagcctcatttgaagggatttctgactgccaaaaatcaggaatttaaacccagagtctaaggaatgtgaaagggtaagaaagtgacaaggcagtaggaatggaagggagaaaaaacataagtctgaaacaagggaaaaaacataagtctgaaacaagggacwttggggcagattatgaaaagagtataaattattttacaattatgccttatttttttattgtactttaagttctagggtacatgtgcacaatgtgcaggtttgttacataggtatacgtgtgtcatgttggtttgctgcacccatcaacttgtcatttacattaggtatatctcctaatgctatccctcccccagccccccaccacccgacatgccccggtatgtgatgttcccttccctgtttccaagttgtctcattgttcaattctcacctatgagcgagaacatgcagtgtttggtt

SEQ ID NO: 90401 - DNA, 601 bp, Human
tgtcgctaaaaatctgctacgtgaaagcaagtgagcaatgaacagatcaactccttttccctagtacggagtcttttccacaaaatggatataagaaacgtttggcaaaactggaattgttttctccctgcttaaatatttcatgtgggtataaatacttcctgtcttgttattagcagaaaataattatgtgtactaatcattccataatgtccaaccacagctaattttggtcatctgcttacagtaagtgtttaattattattactgtcatatgatcatccccatgcttcagatacgygtgtgtgtgtgtgtgtgtgtgtgtgtgtgtgtatacacgagctagagctcgagtcttacagatcttctatctttactatctttacacatctatacaaaattacttagttcattccaagagacagctaggaaaggagggaacctgcctactttcctccatctccaccaccttcatctgccattacctttagtggcttcaacatcagagcatacaattacctcacagttccacagttctcttaggtccagagaattctgtatttgcaattcatgagtgtggtcaccccatcttagatatctg

SEQ ID NO: 90402 - DNA, 601 bp, Human
ctgtttagtcattaatacataatacacaggtcacaataaattgtctttattattatgcttctcccagtaattaggtcaaagtgattaggaacccacatctggcttcaagtcttagctttgcccttattgtgtgattttgagcatattatctaatctctggtcctcagtttcctcatctgtaaagtggagaattaacattatttacatgagattaatgagagataaaatgcaattactaatctaattcactcagtacctggcgtaataagtagtaatttctcattaagtgatgattgctatkgtagacatcatttccactatggagttcagagactggtatatgcaaccttcaagccttcaggtagtgtacactattcagaataaaactactggtttccaaaaaattaatatccctaatggttagttttccagtcaattcactgctttttgtctctatttttagacccacaggtaaactttcattaacaatgtaatataaaagtgaatgtcactggtaatttgagaataagttgaaacaaagatgaggcatttttatttgcaataaagcaattcaatatccaattgtttattaggccacagc

SEQ ID NO: 90403 - DNA, 601 bp, Human
gaaatataacaaaagaatactgaaaagacaatgccagaatataaattaagatatacatcctcaggaccagtaatagtgagtgtggttgaagccaaagcctgatgggtgctgagccccaaatcaggcagtgagacagagaaatctctttccaatgggagacgacaaagtcctctacttactatgaaaggctgaagccaggctttaggcttaaagctggactggatttggcaccctttccttgataaaggaagctaacatcagacattgccaattgactccagggtttacaggttttaccacyggttatcaagggggagtcagtgactttcttccccagaggacatttggccaatgtctggagacatttttggtggtcataactggagggaagttggcactagttgcatttagtgagtagaggctggggatgtttctaaacattctacaatgcaaaggacagctctacacaacaaagaatcatccggtccaaaatgtcaacagtgccctactgagaaaacctggtttatatgaagttaaaacctaaaaacctacagatttaaaagacgtcaacacagcctctgtctagacaaagatctgaaac

SEQ ID NO: 90404 - DNA, 601 bp, Human
tgtagtccaatcattataaatagggcattaaaaaataagttaaatattatgagaaaatacatcagtactgaaatagctgtacttacattcaagtgctgaacataaacaaataaagacaatgctgagtttgtcttacagagtatctacagtttacagagctgttttatctacactgtctcttttgaggctcaagcagcctagataatacttttcccattgtaaagaggatgaaactatgttaacaatttaaagtggctcctctttcaaggtcacagtaatgtatggagaacagaattcaaamccaacccttctgctatggcttggatatagtttctttatccctgccaaatctcatgttgaaatttggcccacagtgtagcagtgttggaggagaagcgtagagagaggtgcctgggacatgggggcaggttcctcatgaatggcttggtgctgttctcactctagtgacagcagattagttctcaagggaatggattatttctggcaagaatggattgttataactagtataccctgggtttggtcccccttcccaagtgactgattcctcctttgaccctctccaaaatgttttggcaca

SEQ ID NO: 90405 - DNA, 601 bp, Human
gctgttgcagtgggtggacaggggatgtatgggaactctgcactttcatctcaatttttgctgtgaactgaaaactgctctaaaaaataaagtctatttaaaggaaaaaaagcagtgagcagaaaaacatggtcctctcagtaggtattaattcactacacacaatgacctagagccttggccaggatcagctaggtaactggcagggtccagcacaaaataaaaatgcagagccacttggtcaaaaaatttaaaattccaaaatggtggaaacagcattaaatcaaacattgggcctctytaaacaatgggcattcatcacatgctgatgaagttggccctggccttgacatacggttccctgcttaaaacccttcaaagccccctgtaaacagtgaggaagttggaagtccttaattaatttgacatgcccttcatgatatcccaggcccattcccccttcagctttatttctctcagccccaccctactctctatgctctagtcacccagagcttcctttactttctaaaattttccatgctccctttgcctcaaggcctttgtatgtatttcccttacctggaatacaattcctcca

SEQ ID NO: 90406 - DNA, 601 bp, Human
tatctattcagataattttgctgtcagaacgtctggcagtgctgatcatttgagtctgtgcagctctaaagtgttatgactataataactacagatgtgtaacatgaaactcaacaaatattttattctttaacttttaagttaaggttacatgtgcaagttcattatatagggaaatcagtgtcatggaggcttgttgtacaagccccaccctccaccctccaccctcagaaaggcctcagtgcctgttgttcccctctatgtgtccatgtgttctcatcatttagcttccacttgtaastgagaacatacagtatttggttttctgctcttgcattagtttgctaaggataatggcctccagctccatccacgttcctgcaaaggacataatctccctctcttttatggccacatagtattccatagtgtatatgtaccacattttctttatccagtctatcatttatggtcatttaggttgactccacatctttgctattgtgaatagtgctgcaatgaacatatgtgtgtgtgtgtctttataataaaacaatctgtattcctttgggtatatagccagtactgggattgctacatc

SEQ ID NO: 90407 - DNA, 601 bp, Human
cctacacagccaagaagtcatctctctgttacgatcaaatcctattgctcatgtcagcatggaatgaaattatttttaaaaagggaacagcatagccaactagtctatttatattccttgctataatttcaaacaacttcatggttcattagatattttggttcacttagccaataagtgttttttaatggagaattattacaaagctaagcaaatagaaaactccacaacaataaatcatgatcaaccaggctttatcccaggaattcaaggaggttcaactttaggaaaactattaacrgaattctctatgtatttatattaaagatggaggaaaaaaaaacatgatcatctcaagtaatgctaagatatattttacaaaatttcacaggctttccagcttgaaagaaaaatataactaccaataagtcaagatggaaagaaactgatttatcttgcttaagttaaaaagtggtctcattaaactcaggagcaaggcaaagatgcctaaaattgacattgtaccagaagtcttcagcaacatataagaaaagatttctttaaagccttaaatacggaaaaggactatgccaaagtgtta

SEQ ID NO: 90408 - DNA, 601 bp, Human
aaatattatgtgtcaattttaaaaaagaatcaacctattaaatcttttgaagttagaaatttggtttctcatacagaacctttatttcatcaagaatagaaaatatattctctggtttttacagttttcttggtagttggtctttggtgcagtggtatgaataatacaaaattaaacctgaatccaccacatgtatttgagagtggaaataaaaatactcttgtataatctctccccccatagatgtctacagtgaaaaagtacagtttgataaagtgtcaaaacgcaggaaggaaaacaragtgactgaaaaatgtggtgaagcagagcaaaaaagaaaagcaatactcctaagtgggaacctttgagacaatctaccaatgaataagcatttactgaacaactactgtgtgaatggggttgtgctgggctccttttgggacaacaaaacacatctgataggatctctgttctgaaggggctcacacaaccaagagggtgataagaaagacaaacctagaaagatacctgaaatacatgccagttcatgaaatgtgtcttctgatggtataagcaattcattaactcatttcaaattaat

SEQ ID NO: 90409 - DNA, 601 bp, Human
agataacccagcctatttacaattaggaatggctatgtgaataaattctaaacaatgagagggaatcagaaacgtcctgtcgcgacaacagatactttgccttaagagacagtggttctcaactgggtgacttgccagccagggaacatgtggcaatgtcttgagacatttttagttgttgcaactgaggttcctactggtatcaagtgggcagagaccaaggttgttgtgaacattctacaatgcacaggacagctcctctcagcaaagaattaccctgcccaaaatgtcaacggcacasagattacacaactccaaatcagacactggatttgaaacaagaactcagaaacaattgcttctagttcttttaagctctggcacagaatccaagggtttttcgtgtctctaatatctacaaagcaataaaagatgatgctggcttatgttattagccatggtatttgaaatatcccaagttctgaacttttgttcaacttgattcattttctctgtcaatcactaaagcagtagttctcataactttctggtctcaggaccccgttacactcataaattattggaagttccaaaagcttgt

SEQ ID NO: 90410 - DNA, 601 bp, Human
gtaatagtttctagactatgataaagaatgtgggctgcatcctgagagtaattatagaaatattgaaaggttttggatttttggaaagatcactgtgacatggagaaagaactggaggactgaagtggtcaagactagagactagttaggtggccttatctaggatagtaggcccttacaatggaaagaaataaatggactcaagagacttgaagtagttacagttcttatctctgtgggcgataaagcccataagctggaatcagctgacttagattcaaaatggagatgctgcctaccrcaatagtgctctcatgggaattaaataacatcaatatcaggtgcttgctgtactgcctgttgacatgcagttgagcagtgaagggtgttattatgggtcccactgtctacactctagagaagatgcttacaccctcacacttaggttaatactatacctccatattgggctcccagtaccctatatctatggtgtaaagtggagtttctcagccttggcaatattgacatttggataatacttgatggcggaggctttcctgtgcatcatagaatgtttgaccacatccctggcctctac

SEQ ID NO: 90411 - DNA, 601 bp, Human
ccagaagcagagagtgagataagaatttgcatgcaagcagtttaattgggagaagatcccaggaagcactgggaaaggatgaaagtgagacgaggaagggaaggtgaccaattcaaatgcattaatgagctggtgactactgtgggcacctgggacttagtccttctgggggcctctgggagattgggtaaagcttcactctgagtcatcccactcaaagggcaaggaagctggttgtgttaagtgttgctttctaggtgtaaccacttccagacttccctgctgtcctactgtcagctgwacatgagtagggagaggtggcagagaaagccatcaagtcaaaagttgccaatgtttgtagtataaagccttcaggctgaagcaggcaggacaccagaagcacctgctgtggctgagaattaaatcactgaccctcccctcccctcaccttgcatttctccccagcttcagtagttgttttcctttgggttcatttctacattcagggaaagaaatttcattcatcttgggtctatctctaagatttaatttctctaatttatagattcccaacttgtgggacatgactgctttgaggtgg

SEQ ID NO: 90412 - DNA, 601 bp, Human
aggtacaggacatccagctaaatttgaattttacataaaaaatgagtatttttttaagagtcggagtcttgctctgttgctatgatacaatggtgcgatcatagctcactgcaaccttgaactcctgggctcaagtgatcctcccacctcagcctcccaagtagctgggattacaggagtgagccacatcacctggctaatttttaacataagtatgtcccatgctatatttgggacagattcatactggcaatattattcattatttatctgaaattcaaattcacctgagcagcctgtwttttacctggcaaccctagggagaaaagaaatagctgtagtttcagagatgcaggcttgccctgaccccgactgtaaccccaactcctaactccatgccactaagtccgtctttccatttccttctaagctgcataccagtcaacttggctggggtattcctagcctgacaatttcattgctcccaaggactgactccagctgcctttggacccacccaaggactggagtccttctgcaatatgctcacctctccagtcttccactgtatgcctcctgtgcttggcatagtctctggagt

SEQ ID NO: 90413 - DNA, 601 bp, Human
ctagtggtacttatagtcccactgctaataaagtagtatgcactcattcaacacatatttcttgagcctcacctatgtttttgcacaaagtatgctgaaagtcaaaacaccctcgtggaacttggtttctcaagagggagacaattattaaatgaagaaatcacccaaataatggaaaggtacaaggaaagaaaagtacagggtgtttacctagcatggatgtgggtaggtatggttgccagatttagtaaataaggtacaggacatccagctaaatttgaattttacataaaaaatgagwatttttttaagagtcggagtcttgctctgttgctatgatacaatggtgcgatcatagctcactgcaaccttgaactcctgggctcaagtgatcctcccacctcagcctcccaagtagctgggattacaggagtgagccacatcacctggctaatttttaacataagtatgtcccatgctatatttgggacagattcatactggcaatattattcattatttatctgaaattcaaattcacctgagcagcctgtattttacctggcaaccctagggagaaaagaaatagctgtagtttcag

SEQ ID NO: 90414 - DNA, 601 bp, Human
tcacctgagtatgctctttcacacagcacctggtaaggctgtagcctatctacatggagagagacatctctgagccagggaagagagatgaactgtatctgggtaaatgtagtcactgagtccctgaggtaatcctggaaccatgctccaggtttatgtctgtggcatgctgactctaaggtggtcctaaggattctcctctttcccttcctggtatttatgcccctacccaatctcttccctttgagcgtgagctggtctacccaaatatggcaaaggtgctgtaacaaatagactccayagcaccttctaacaaatagaatatggcaaaggtgatgggacgtcattgccagaattgtaacttttgtcttgacagttgattctgctgttgccttcttggcttgcatgcattcataaagtaagctgccatattggagagacccatgaggcaaggagtggaggagggtggcctccagccaactgccaatgagaaggtgaggcccttagtcaaatggcctttaaggagattctgcaaacaactagggtaagctggtaaatagggccttccttcaccagttgagccttcagataagaccccagc

SEQ ID NO: 90415 - DNA, 601 bp, Human
ttttaaagttcttatctacttttgtctctcttccacacacataagcaaaataaactttgaaactgttcagcaatttataatagtttcatgtgattttttgaatcagctctaataaatgctaaatgaaaatataattttatatgccatacccattcacacatgcactgctcattttccctgtgatgacttggggcaggattggggtgggtaggatcagtgagcccagttgctacatctcttcaatttgcaggttcgtgaggaagggattttttccacaagaatttagctagctggtgagagraggaaaacatcgaacattgcttcctgacccctgggggcctatgggtgggtgccttactgccttttctctccaactcattcataccaattgaagagctggtccccgattctttcttttatatgtagaagcagttttacagagcagatattttatttgatagcataagaaacagaagctgattttgatctcagtatatagaaatcaccggtaggcatatgattaagtctgcacaggggatgagagcaagagaagcctgtgagaaaagaaatgtgagctcaacacacacaagccacctcctaa

SEQ ID NO: 90416 - DNA, 601 bp, Human
ttttcagagaggtgatcagctgaatgcattggaagtaaaattgtaggaaatgccatttaacttccaaaaatattctgagcttacataatgttggtctcccttctcagctcccaagtttttagtcatgcaataaacattatttttaaagttcttatctacttttgtctctcttccacacacataagcaaaataaactttgaaactgttcagcaatttataatagtttcatgtgattttttgaatcagctctaataaatgctaaatgaaaatataattttatatgccatacccattcacacaygcactgctcattttccctgtgatgacttggggcaggattggggtgggtaggatcagtgagcccagttgctacatctcttcaatttgcaggttcgtgaggaagggattttttccacaagaatttagctagctggtgagagaaggaaaacatcgaacattgcttcctgacccctgggggcctatgggtgggtgccttactgccttttctctccaactcattcataccaattgaagagctggtccccgattctttcttttatatgtagaagcagttttacagagcagatattttatttgatag

SEQ ID NO: 90417 - DNA, 601 bp, Human
cacttgaaagccactgcaagtttcatacagaaaatgtttttaatgcctagtcttccaggatgaatgaggatttatcacggaaagagtattagaagagaagagggagggagaagtaagcttccaaaaaaggtatgcaaggcacaaggtgttttcagagaggtgatcagctgaatgcattggaagtaaaattgtaggaaatgccatttaacttccaaaaatattctgagcttacataatgttggtctcccttctcagctcccaagtttttagtcatgcaataaacattatttttaaagttctyatctacttttgtctctcttccacacacataagcaaaataaactttgaaactgttcagcaatttataatagtttcatgtgattttttgaatcagctctaataaatgctaaatgaaaatataattttatatgccatacccattcacacatgcactgctcattttccctgtgatgacttggggcaggattggggtgggtaggatcagtgagcccagttgctacatctcttcaatttgcaggttcgtgaggaagggattttttccacaagaatttagctagctggtgagagaaggaaaacatcg

SEQ ID NO: 90418 - DNA, 601 bp, Human
gtgtcatgagctagccagtgtaattacccaattatgtatatatgagatccttaacattaagtaaaagaaaacaaaatgagatgtaacattcccctgtctggaagttcacagccaatagtggagacaaagtgtaaatacgtagttctaatgcatgaccactgttctaatgaactcacttgaaagccactgcaagtttcatacagaaaatgtttttaatgcctagtcttccaggatgaatgaggatttatcacggaaagagtattagaagagaagagggagggagaagtaagcttccaaaaaaggtatgcaaggcacaaggtgttttcagagaggtgatcagctgaatgcattggaagtaaaattgtaggaaatgccatttaacttccaaaaatattctgagcttacataatgttggtctcccttctcagctcccaagtttttagtcatgcaataaacattatttttaaagttcttatctacttttgtctctcttccacacacataagcaaaataaactttgaaactgttcagcaatttataatagtttcatgtgattttttgaatcagctctaataaatgctaaatgaaaatataattttat

SEQ ID NO: 90419 - DNA, 601 bp, Human
aaaagaaaaactattaaataggggctttatttttctaactttacatttgagaaaacagaagctcaaaaagttacataaattgccccaagtcacacagttaagtgggtgagcagggattcagaccaggtgtgcctaagtccttagccccattcttagccactcttgtgctcaatgccactgaagacattcactgagaatggaaaacaaacaaacaacaacaacaaaaaaaaaacatatcactcaggtgtcatgagctagccagtgtaattacccaattatgtatatatgagatccttaacaytaagtaaaagaaaacaaaatgagatgtaacattcccctgtctggaagttcacagccaatagtggagacaaagtgtaaatacgtagttctaatgcatgaccactgttctaatgaactcacttgaaagccactgcaagtttcatacagaaaatgtttttaatgcctagtcttccaggatgaatgaggatttatcacggaaagagtattagaagagaagagggagggagaagtaagcttccaaaaaaggtatgcaaggcacaaggtgttttcagagaggtgatcagctgaatgcattggaagt

SEQ ID NO: 90420 - DNA, 601 bp, Human
tttactggctgcttcttgtcatataaatcatgtttagcatttagtttgcaatattacatttaacactcagaaataaaaaagaaaaactattaaataggggctttatttttctaactttacatttgagaaaacagaagctcaaaaagttacataaattgccccaagtcacacagttaagtgggtgagcagggattcagaccaggtgtgcctaagtccttagccccattcttagccactcttgtgctcaatgccactgaagacattcactgagaatggaaaacaaacaaacaacaacaacaamaaaaaaacatatcactcaggtgtcatgagctagccagtgtaattacccaattatgtatatatgagatccttaacattaagtaaaagaaaacaaaatgagatgtaacattcccctgtctggaagttcacagccaatagtggagacaaagtgtaaatacgtagttctaatgcatgaccactgttctaatgaactcacttgaaagccactgcaagtttcatacagaaaatgtttttaatgcctagtcttccaggatgaatgaggatttatcacggaaagagtattagaagagaagagggaggg

SEQ ID NO: 90421 - DNA, 601 bp, Human
aaaatgagagcagaggagaaggaggaagagaaaaaaggaagaaggaggcagaggaggaggaggaagaagagaaggaaaaagaggaaaaagaggagaaaggagaagaagaaaaggaaaagaaagaagaggaagaaaagaaaagagaaaaagaaaataaataaaacaaattggatacataattgggattctaaaaagcttaatggctgtatcattcattaagtatctgttgagccccactccattaaaaaattaaaaagctaaaatttactggctgcttcttgtcatataaatcatgtttagyatttagtttgcaatattacatttaacactcagaaataaaaaagaaaaactattaaataggggctttatttttctaactttacatttgagaaaacagaagctcaaaaagttacataaattgccccaagtcacacagttaagtgggtgagcagggattcagaccaggtgtgcctaagtccttagccccattcttagccactcttgtgctcaatgccactgaagacattcactgagaatggaaaacaaacaaacaacaacaacaaaaaaaaaacatatcactcaggtgtcatgagctagccag

SEQ ID NO: 90422 - DNA, 601 bp, Human
tgtgcccacttcccttttgaccttttctgccatgttttgacacagcacagaagcccataccacaagccaagcagatgccagtaccatagtacttttatagcctgaagaaccataatctaaataaatctcttttctttgtaaattacatagcatcacatattcctttatcacaacacaaaacagacaaagacaggcattcaatattctgcagtattatcttcagtggtttaacagtattccataatagcgctatatgatcatttaatcaatccactattatagactgtttccattcttcttktgccctatttttaaaaaatactgtgataacacatccttgaagctaaattttagcacacacccagggttatttctacaggataaatgtcttgatatgaacctatagagtttcaggaattaacatctttaaggcttttggttcctacagcttttgattcttattactgaattttttcctacccatgccaaaaaagttgtatgcatttgcacctccagcagcatatcttgagtgtttctttcccaatccaattaccagcattatatattatacaattttcatctttgccaaagttacccataa

SEQ ID NO: 90423 - DNA, 601 bp, Human
aatctcttgcagacttctaacaactctaatccactaaaatacagcccaaaactataagtgacaattacctctttgcaccccaggaactaaggtccaacctgggacctctttgcaacccaggaactaaggtccaaggtccaagggtgggaggatgtaaagtattagattttcacgctaattgcacacaatgcctacatacaaggaagggaataatagcagaagaaaagcctatcccaatgtcattctcataggtcacctgtccatttgctctcagtgggagttaattcccagaaactagggrggcacacttgtgagtcaaaagaggcaggagagagaggtgggtacatctgttctatctaatgggattcggttccacagtagagccagtgcccatgttgcataaacaggaggaagcagcctcagatccaggatacctttttttcaccatgatgaatagaacatcagtgcagaagggatgcagaagggaagatgggcctaactggaattatgtagtacatatggtgtgtatgttgtaagttgtaggtatgttgctatctggctagcacagttaaccaaatactgtaagtggacattgtaccct

SEQ ID NO: 90424 - DNA, 601 bp, Human
ccaggtaagcagaaattatttaatattttattttaaaagaaatcactgcattcaatacaatgtatcttgctgagcttttcttgatcggcattttaagctcatatgattaatttttctgactttctgaagcacatagacatgaaaactgaaactaagtcacagataaacaaggagtacacacaaggatgtatcaaaaggcaaagaaaaaagtatcctaacactcaaacaaatattcataaactgtaattacaggggaaaaggcacaggatgttcctgcctgtttataaagattaacaaaccktggccaaacccttcttcttttccttatctccagtaattgccaagcaagttcaactgcaaagctaaagaatgtgccaatctcttctttcaagactttattcctctttgttttcactgctcattttcttcaatacgtcatcacaagttccttagacctacctttagataaaatgcttctgtttccttaactataatgagcttcatgtaaggagcaacaccaacatttatgaaaaatttgtcttccatttcttctaccaagttaaatacctggccctaaagtaatctgggtggccacctggtc

SEQ ID NO: 90425 - DNA, 601 bp, Human
accgtcattggtctagtcaacattgaattacaccatttcacttgtgcctatggattacatggttgaaggaaatgacactgtagcgtcagacacgcactttctccaagatgagggaggaggtacttgagtcttcaagggagtaagttaagatgacaagcctgatgactgtctacatcagaatatcgtgacctattagttttccacaaacccatctgtagttagaaccttccatgtgtcatcatttacaagttacttcatttctatagcaccataacaaactatgatttaaatggttttattraagccaaaactgaaaagtcaaatcaattaaaatatgaacttggaaaccttcccacaaaaataatccactagagtcctttattatcttagatcaggggtcaacaaactacagctctcagaccaaatccagcccactgcctatttttgtaaataaagttttattggaacacagccacaactcattcatgtattgtatgtttgctttaaggttacaaaagcagagttgagtagttgtggcagagattgtctagtctgcaaagctgaaaatatttactctcggctttttacaggaacagtttgc

SEQ ID NO: 90426 - DNA, 601 bp, Human
acaggaaatcaaagggatgctctccaatctcagggctgccatttttggttacagaataaatatatcaaaggccctcctacgaaggaattcagtatgaccaagaggtaaatgcgactcccagagcaggggtgcttcccaagaacacattagtctatgtagagtttaggaggcagaactctctaatttggtttctcaccaaaacaagtgcaatctactcaaaaccctttaaaaaggctgtgctttgataattgggtcttgtctttgcatactctcccctgatcaactctgttatcagtgagayctatctccttgatgtttccacactgaagggacatcacggggcagaataatttgcttttcctaagacaagactctccaaacgttttggttcacaaagtgagaagcccaactagcagccaaccacaggagcctggcaaggacacacttgttccaatgcccctagtcccccaactcaactgtcctcctgggactgccaagtaaaaaagagaaggaacagggaagttatttccctaaggagccccttgggaagcagcggtaacccaagcacaggggccatgccactttgctttctactgtcaga

SEQ ID NO: 90427 - DNA, 601 bp, Human
cacattctgtaggttcacaataacccttaaaactggcctctgctctgaaatcccctcatggaaacctgcactttaaaacaccttggagaagatcagcgagttccctccacagccttgtccttctgtaatttacgtccagcctcccacaagttgagcccagaggaaggccaggcctggggccagagtagagactccagactcatgaatcaatcaatgcaagccccagaggggtggctacaaagtggaagatgtgcttgggggtagcttgtgccagtttgtcagggtcccactgtactgaacmggctgaatgactctccacttgctctgtgtaagaggagaggggaggagaggggaggaaagttggatgtggccccggaatttcagcccttacaatttagttgaatgaaccatccactggcatgtaatattttaaaacaatcacagcataattataattagcagtgggaatgtgaagccaggggtgcaagtggcctgaggaatctaccattagatagtcccatgacagtttatccacctggaaaactggatggttatatctgctaaagtcaatcataggcctaccttccaatccagcaaattc

SEQ ID NO: 90428 - DNA, 601 bp, Human
ggaggtattaaggacacatggagggtcattcatgtcaaggaagacagacccaaaaaaaacccaagatcacaggaaaatgcacagtgggacaaaaccctgttgagcaaagtaagtggaatatttgtgctaaacggcaaaacaagctctggaattatcaaaacccaaatgagggaagtaaacaaaagtgcagcgttagaatagatattataccaccaagggttatactaatatgaaaaacaatgggtcgcacttaataaagaacattctctggacacgtgactgattcagagctgctgctttmtcatcctaaagtatgcataggaaacttcagagagcccgggtgacttattccaacctggaatcccaacaaattccctctggaatcttcctttttatagtcttaaaccagaatatacatacatgataatctgtactagaataaagggctatttcatcagcagtcttcagagccccaagaggggacattagcatcggcttgactcttcagtttatgattttagaagaatcagacagcctaattaaatgacaattttaaaatatttttgtaatatatttacataattgaggcaataaccattca

SEQ ID NO: 90429 - DNA, 601 bp, Human
gaagtattcctataccttttgtatcattagagagtttggctgaaatgaacactgggtggtaaaacaaaggactgctctgaaaacttgtactagattacctcagagtcagctgaggtgaagtattgtattgcactttctgaatctactttgctgctgaatcctacattttgtaggggctgcttgagtagtaagtggttcaccgtgtaaattaatcagtgtttgccaaacccagctgatattggaaccacccccaaagctttttcaaaggattgattccaagtctggtccttagagattctcrtttagtaagaattcagtgaaactggaaagctaatttttagtctcgtctctccctctgacctcaatcatcaactaataaagggttaagtttggaaagtcctagcgtaacctagggaaaaatacacaggcagccagattcatgttctcataaatatttattgtatgcctaccctgtgccaggacctgctctaaggcagtggaaagacagtgggaaaggatcattgggtccttgccctgaataaacttacacactagtcagaggagacagacaaacaatgaatatataatataataccaagtg

SEQ ID NO: 90430 - DNA, 601 bp, Human
aggttcatcctcctgcacagtccagtgagacaaagactcgtggacattatgctttcaatctggtggaagccatggttttttgaacctcagtgagaccctcttagaagacaccaaggtgacatttactcaggaagctgctgagctctaagacaagacctgcaggaaatgatagcgggaggccatggtgtagagctaaagctgttaagacgtcttcattcaaagggtcacaagaatgtggaagagtcagccaaaagaaacatcacaaagtgtaagacagggctacttcctttggcacaacacyggctgcattggcaggacccagagatggctcacccccagctcttgtggctgagcgctcagcaagccacacggagtttaaagaacaggagactggtgtttttagagtcagctcctggaggccctttatgttcttgcctctgagggagttctggatacagtaacataaaaatctcagatacatccacaagaagaactagcattttaaacccatgagtaaatgacacttttctgagtttaagtctccctttcgcactggtaagaatggcaatgtttatgaaaattattctgcctagaataattg

SEQ ID NO: 90431 - DNA, 601 bp, Human
caaaatgagcttttcatgcacctatcaccactggggtggaatgtctttttccttctataagacaaatccatgacggaagacactgctgggtaaaaacacatctggatcccaattctacttttaaggagaatttcttttttctttctttttaaaaaaattactagtcattcctgcaggttggtatcctacaaatcaagggtttactgtatgattattacatatccataagaaaaaaatgacaatttaaaaaattttaatggcaagctctggcatattaattggaaatccttggttcttagtstaaacattgaattgttgtgtaatcaatttctagtcaaataatcaatttctacttcagtttcattaataattatgattaagtcagtagcaaaaaagcatgttatttctcctcgggaagatgtaagacagcttaacttaagggaccctaaatatggtctttgtaatcagtggacttgagtttacaacccaacttcaccacttatttttgtgactttggaaaagttacttagcctctacaagccccagtttcctcatctataaaatgatataaagaaacctattagagagttgtaaggaattt

SEQ ID NO: 90432 - DNA, 601 bp, Human
ccaggtctgcacaaggcaagagagaaaacgttgcatttatgaatgcaaatatgttacagatatccaagttcaccagtctatgccttactgatacttcttgctttttggcatctcctctttaatttccaccacttaactgattcacacctgggtcagaggcaaagccgtcttcctcatctctctgatgagcctctccactctttgcatctcccattgctaatctgtcttgtccccctaccattgcaaatcatctcaacttttggcttaagaacctatgagagtagcaggcagcccaggatcraggtcatccttgcatcaaagccttaaaatccgattctacataatccagccaagcaagagattccaaaggcaagcacgagaatcattaataatgaagtagtcttccaatctattcaagtcaatcctcagtctttttaatgcaacatttacattaaaacataaaaataatccctttgttttgcatttgtttaattcatttacaaattattccatataattagaactcaaagaaagtatcactgtctgccaacaggaaccaaattttcttttcagttcataagttttttaccctccaaaacct

SEQ ID NO: 90433 - DNA, 601 bp, Human
gaaatctgaatccctgtattaagattggtgcaaaagtaattgcagtttttgccattgcttttaatcatcactgttacatcactggtgggaatgtaaaatggagcagccactttggaaaactgtctggcagctcttcaaaagtttaaacatagagctactatgtgacccagcaattccactcctagctatatttcatttcaagagaaacaaaaacacatgtacacacaaaaacttgcacataaatgttcacagcattattcataatagctaaaaagtggaaataacccaaatgtccatcagytgatgaatgaataaacaaaatgtggcgtacccatacaacgaaagattattcagccacaaaatgaaatcctgatacatgtacaacatagatgagccttgaaaacattatgctaagtgaaaggagacagttacaaaaggccatatattatatgattctatttttatgaaatatccataaaaggcaaatctatggggacagaaagtaattagtagttgccagaggtgttaaagggaaagggaggggtggttggctgctaatgaatgcagcaattctttatgaggtgatcaggatgttctagaa

SEQ ID NO: 90434 - DNA, 601 bp, Human
taatatgagcacataactcattctcagtttgatttttccttaacacaaacaagcctcttttcagagtttaaacaaatcacaaaagaatttttaagtcattgttaaaattgacatgatttataagctggaatgaaagtgccattcttgtcccttaaatgcatgaggtgatcaatacgttttttcctagatataagaaattcctttaggtacctgctttggcatggctggcatagacatatttatattaggtaattaagaactcagatgaaaacaatttgatactattgttaagcacaatatrttttaattattatagtcataattatataattatacctttatatatagtataacaatgcattcttttctacagtttgcagtttgattccttttatccttgatgtcatttaggaattctaaatgtcctaatttctccaaaacactgaatgagagttgcagaaagacaaacataaaaccagattaactgcaggtgaaaatggcatgtggataatttatttctgaatccagaggaattacatttttgatgctttgtctctccttagcctagagtctcaagaagcttttatacatacaagtcaac

SEQ ID NO: 90435 - DNA, 601 bp, Human
atcttttttaaattatctaataaaaccgtagttgatcaacatattttttccaaaagtatttacggagtgcttattacatccaagcactgttctaggactcataattttgatatttttgctaggtaccagtccaattctgacagtacttagaaggcaaggtaacatactgtgcacatgcaagcctgtttaaaaacagttctggaatgaatgccaagatgagagacgctgacttacattagggaagcctatacaactgattatcctcattacctctgtttaacataagctcagactttttttwaaaaaaatctcagaacctatatggacattatcagttttaatctagtgtcttttttgcctttataactttctagtatgagcgcatagaatatcctacttaatgagagatcctctaggcatggaggcctagagatttggtaacactaattattttggttaaaacatatacacacacaaacacacacatgtgcacacacaccctaaatgggatccatctttgggaggccaagtagatgagtataggtttcccattcttgggagtagatggtatcattactagcaactgttgtgagatgcccct

SEQ ID NO: 90436 - DNA, 601 bp, Human
gtaaacatttcaaatcaccataggctaccttgagaatccctgattcaaaagacctctctcaccctcaggaacactttaaaatttcttcagagtcaagcagtcaacggcattctggctcagggcatgataccacagaagacacttccctgatggtctcttaggtggcagccatattactcacccagcatgcctggtgtttcctaaatcccttttcaattgcccttcttacacccagaagcatcaaagagaggtctggggatgactgctccctcttactgtagcaactctctcctccagagarggcaggggttaaagttatcttttttaaattatctaataaaaccgtagttgatcaacatattttttccaaaagtatttacggagtgcttattacatccaagcactgttctaggactcataattttgatatttttgctaggtaccagtccaattctgacagtacttagaaggcaaggtaacatactgtgcacatgcaagcctgtttaaaaacagttctggaatgaatgccaagatgagagacgctgacttacattagggaagcctatacaactgattatcctcattacctctgtttaacata

SEQ ID NO: 90437 - DNA, 601 bp, Human
cctcctcctatgtaccattcccaaccccaccccatcactctcatttccttatcctgggtttttcaccagctgtttatcacgagttaattaatcaataacaataaatggccagtgagctcaaagaaacccacaaccattcccatgccctgctgaaacatgaatgaagcctgaatattggttagtactattggtcttgggagagagaaatcctaaaaggaagaaaaataatgaccttattaaaaaatcacactggctagcattttggaggaggctttacatttatagcttaatctcaaattgwttgtctcatttgatgcctatgaaaaactcatagggtggggattttccccattctcaaggtaggaaaactgagtttttgagatgccaaagagcacaaaatcacagaaggaagaatcaaaggcaggcatctgaattcaaagtctaagttctttcaacttctcctagctgacttctttattttttcaacacactcttaagaatcaacaaccaagtcctaagactgtacatacatttgaacttgatattaagtaaatttaacccaccagtatctaaaatgggaaataagagatacaaggcaagt

SEQ ID NO: 90438 - DNA, 601 bp, Human
tttatttgttctttgaggtgtttgaattgttttggagaatctgacatatcgaacttatgattttaactaaaatacttgggacttaatgatttaagtttgcaatctctgtttaagtgtttgaggaaatctgatgagttaaatctagaagtttaaattttgtaaggaatatttagatgctcagtaaaaaattaagtgctagatttgaaagtctcactagctggtatttaagggatcaaaagaaaggtgttgtgttttgttttgtttttaaacattaatgcaaaaatgataaaaaaatgagatrtataaattgggcttaaaggcttaaaaaaggtgtttttaaaagactagcttgatatactagtattacacaaagtgagagtcaacgttaatattcttgtacaagtgaacccacaagcaaaagctaaggctttaaaaaaatacaagtggtgtgatgtttctggaacagctgtggaagtgtgatctcagagaacacaagaagacagcaaagacaattcctgagaaattagaagggaaaggacagagcaggcacagcaaatctagcctcaagtctcagtgaaaaggcccaaaggggccaaacact

SEQ ID NO: 90439 - DNA, 601 bp, Human
aggagcactagtgttagtttttccttttgccaccagggggagaaccaaactttctcacagagtcacacatatttgtcagacgtgcgttacagaggctggcagaccagggttgaacaaagcttttagttacttcctaccagaataaaaatatctgctggcatgaattcacgagagaaggcagtacgaaccacttttgtatacaaggtcttttaagcttttttattccaaacactgcagcaacaactatttttgatcctgggagtcaagagacgacaaagttaactatctctgggtcttcttrctttctttacatttaagatgaggcattaggaataagacaagtaacattaatgttacataagacataaatgtacatttggctccctttagcttcctcaagcctagtattaaaggatgatgacaatggtgatgatgacagtggtggtgattgtaatgttgttggttgtggtagtgatggcagtaatgatgacaaagatgataatggtgatggaaattttagctaaacataatgaacacctaccaccataggatagatcctgggctaagcaacttatattagtagctaattaaactctaggag

SEQ ID NO: 90440 - DNA, 601 bp, Human
gtagcacctctccaggtatgacaaccaaaaatgtttccagacattgccaagtgtcctctgggagtcaaatcacccccattgagaactactggcttaaaggatgggttctgaataaaagagacatgagctgaaatctgccctaaccatttgactacgcatgtggttcaggggagcagtgtccacatggctaaagcttcggtatgagtatgcctccctcacagagttgttgtagggacaggttaagtgaggatgtatttaatcaagtggcatggggcctggccccaaagcagcagtccatagsggttcctgagtattgtatcaaaaaatctttctatgaggcaatatcatccaaactctgtttggaaggtaagcagagttacctacctagaagggtaagtttccgtctacttagttcaagtgtgtgcgttatatttagaattctagagtcttttctcagttcagaggcaataacaataaaataaacccaatatctatctctatgatcatgaagcttaaaatctagttccatggctaatacaccgagcatatttttatgatcctgaaataatctttatttgaaacatagatgtgtttttcaagt

SEQ ID NO: 90441 - DNA, 601 bp, Human
ccagaacataatctttaatctggaagtaaccccaaagctttctcatgaaatttcttcttgagataggggagctctgagatcatcctctggccagagttgattaaggtacttaatgaacttgattgcctggtttcctgtgtcagccttaaattctactcttagttatagccaagcagtaggaatctatgaggtgggatggaggacagtgacgtacaaactacctaaacacagatgttttatctgacatttttatcctttacaatacatccttgcctataatgtatgccccacaaaaatcacrtaaaataccaagtgatgagcaattattgaagagagacccatataaaaataattatttcactggctctcagaagacaatttgtgattagaaaaatgcacaaatagagaagattacttatttgggccagtaaatacgaaactcaatgtaatttctaatttagaattctgtggctctccaaaatgggttttacctaattcaatttaaggtttaattttagataatcaaaccccaaaccaagcctgtgtatatgttgacatcttttgaacctagactaagtctccgagacttcccttcttaagt

SEQ ID NO: 90442 - DNA, 601 bp, Human
gactgaaacagcattttgtaaataacaacttactatttaaacctatagcgtcaacatcattgttgcagtcatcaaaattgttattctcttcctcatcttcaaggtcccttctggctataaacatttctctttcctctgatgtcagtcctaatgtaggacccatgttctttctctctgggtagagtcaccagtgaaagaataaaagtgatatcagaaacttggataattttcttactagaaaatctctacttagtcattgtaaaactggatgttgagtttgaagtgacaatgtgctataggyttacctcctacaattcaaagctcactatagactataattttccattgattaattcattgacttattcattgtacacttgcttagaccatagtacctatggcatgaagaacataataaaatgtctctccctagtgagaactcacagaactaccagggcatgcttcctgaggcccatcacactctacaggtcaatcatgattccatcttgagttaactattcttgacacttacatggcaggtcattttcaaagtatgcttacaaacaacaacaacaacaacaacaacaacaacatgttctta

SEQ ID NO: 90443 - DNA, 601 bp, Human
ttaattgttttcctcaggtagctatgagtggtctcaattcttctgtaaattcttttatgatttagtgacttcctgcctttttataatagaaaaattggtttggtatattttattccattttatcttcataaaggtcctccacccatgtctagaaacattttaatgcaaagtcctaaagaaagttaaatcctaagcacttatctccttaaaaataaattcagcttgatttagaagaattctgtatgtaaaaaaatgggtaaattccccattcattaataactctttgttataatattatctsttatggcatctccttataaagcaaacacctcaggtactaggtattacaaataatttcttccttgtgtgaatgtcaagtcctctgagagctgatggtatgaatctgtacagaaacattttctgctcactgtaaaatctggtagtgccaaacccatcttatatgagacaaacggatcaatctgaattagtgacaccaaaaacaaacaagtttttccatgtaaacatttttatattcaggaacacacaattattcagattttcaggataagaaactttgttagataataagaggacattatgt

SEQ ID NO: 90444 - DNA, 601 bp, Human
ttcgaggtttgcatgtgttgtcgcaggaatcatcccttttgtggctaaatatattcttctgtattgatatatcacatttgtttatttgttgatgaacatttggattgttttcaattcttagctattataaataacactgctctgaacattcatgtacatgtttccatgtagacatatatgttcatttctcttaggtagataaccaagagtggagtttctgcgtcatatggtagttctacgttttaactgtatctttctttctttctttctttctttctttctttctttctttctttctttctttctttttttttttttgacagagttttactcttgttgcctaggctggaatgcgatggcgtgatctcagctcaccgctacctctgcctcctgggttcaagtgattctcctgcctcagcctcccgagtagctgggattacaggcatacgccaccacacccagctaattttttgtattttttagtagaggtggggtttctccatgttggtcaggacagtctcgaactcccaacttcaggtgatccgtccaccttggccacccaaagtgctgggattacaggcgtgagccaccgtgcccggcc

SEQ ID NO: 90445 - DNA, 601 bp, Human
tcccgcctcagcctcccaaactgctaggactccaggtgggcaccacacctactaattaaaaaaagttttttttaagagacagggtctcactatgttgcccaggctggtctcaaactcctgggctcaagcaactctcctgccccagcctcccaacatttcaatatttctgagattcaagattctcctccataaattagatgtttgggaaaaataggccaggcactaagcttctcttactctcaaattgtattacccttagatatgtggataactcctgttattcctgtttttttttttttttggtataatagtgataacaatgggttccataaagggtggatgggaagatatcataaggatagagacagagttaggataagcattttactattggtgggggattgaaaacttatatttttggaaaggaatttgctgaacaaaatagacactggcattttttgctgaattgacaatgtgataagaagcactccccaatttcccctctcagttatttttgagtaagtcctaccccatcttcctggtgtctccttccactcattaaacaaatttctttgttttttgtttctagtgtatttatcac

SEQ ID NO: 90446 - DNA, 601 bp, Human
acatcatttactggaaataaaataataagcaccttgccatttgatctgaggtcgtcatttagtcatttgaacatttatttttctgttttgttttgttttgagacggggactccctctgttacccaggctggaatgcagcaatgtgatcttggctcactgaagcctcgacctcctaggcttaagcgattctcccgcctcagcctcccaaactgctaggactccaggtgggcaccacacctactaattaaaaaaagttttttttaagagacagggtctcactatgttgcccaggctggtctcraactcctgggctcaagcaactctcctgccccagcctcccaacatttcaatatttctgagattcaagattctcctccataaattagatgtttgggaaaaataggccaggcactaagcttctcttactctcaaattgtattacccttagatatgtggataactcctgttattcctgtttttttttttttttggtataatagtgataacaatgggttccataaagggtggatgggaagatatcataaggatagagacagagttaggataagcattttactattggtgggggattgaaaactta

SEQ ID NO: 90447 - DNA, 601 bp, Human
tgtgcctccaggccacagaccatctcctctgaagtcagtgctgaggcccctggatccagctcaatcacttagctcaccatgggaactcagcacatcatttactggaaataaaataataagcaccttgccatttgatctgaggtcgtcatttagtcatttgaacatttatttttctgttttgttttgttttgagacggggactccctctgttacccaggctggaatgcagcaatgtgatcttggctcactgaagcctcgacctcctaggcttaagcgattctcccgcctcagcctcccaaaytgctaggactccaggtgggcaccacacctactaattaaaaaaagttttttttaagagacagggtctcactatgttgcccaggctggtctcaaactcctgggctcaagcaactctcctgccccagcctcccaacatttcaatatttctgagattcaagattctcctccataaattagatgtttgggaaaaataggccaggcactaagcttctcttactctcaaattgtattacccttagatatgtggataactcctgttattcctgtttttttttttttttggtataatagtgataacaat

SEQ ID NO: 90448 - DNA, 601 bp, Human
aaagagtccccatcatgggataggggaaggagcactgggttgggatcagaagtctttgtctgtatcagttctttctctgtgcctccaggccacagaccatctcctctgaagtcagtgctgaggcccctggatccagctcaatcacttagctcaccatgggaactcagcacatcatttactggaaataaaataataagcaccttgccatttgatctgaggtcgtcatttagtcatttgaacatttatttttctgttttgttttgttttgagacggggactccctctgttacccaggctggartgcagcaatgtgatcttggctcactgaagcctcgacctcctaggcttaagcgattctcccgcctcagcctcccaaactgctaggactccaggtgggcaccacacctactaattaaaaaaagttttttttaagagacagggtctcactatgttgcccaggctggtctcaaactcctgggctcaagcaactctcctgccccagcctcccaacatttcaatatttctgagattcaagattctcctccataaattagatgtttgggaaaaataggccaggcactaagcttctcttactctcaaa

SEQ ID NO: 90449 - DNA, 601 bp, Human
atagaaataaagatacagtggttttggttcgtaggtcagctcaagtagtctcatttaacctatgacatacgtgaagtacagagtgggaagtacaaatgtaaaagggaaccccattctcaccgttgtgagaccctggaaaacagcaaagagtccccatcatgggataggggaaggagcactgggttgggatcagaagtctttgtctgtatcagttctttctctgtgcctccaggccacagaccatctcctctgaagtcagtgctgaggcccctggatccagctcaatcacttagctcaccakgggaactcagcacatcatttactggaaataaaataataagcaccttgccatttgatctgaggtcgtcatttagtcatttgaacatttatttttctgttttgttttgttttgagacggggactccctctgttacccaggctggaatgcagcaatgtgatcttggctcactgaagcctcgacctcctaggcttaagcgattctcccgcctcagcctcccaaactgctaggactccaggtgggcaccacacctactaattaaaaaaagttttttttaagagacagggtctcactatgttgccc

SEQ ID NO: 90450 - DNA, 601 bp, Human
cactatactggctactaccattaatagaaacataagtccagcccacaaagtagtgaatccagattaaatgagctacaatcctgtgataggtccccatagccctagagaactatgacaaactacagaatggctggtatacacactcacaaattgccactttgtggaaaaaatggtcactatttatgatcatcaggttttcttcatagtgaagagaagaaaactttccccatacaatttggaagaaactgttactacttatttgtatctcatctgatgcttccttcaggactgcagaggattrtgttttctctaggagatagtcagtatcttagaggctgggcagctagagtttgcctcactgaacactaaatgatctttgcttatattttccaactcagacactcctcaattctgaaagtctgttaagatagctggatatttcaaagtccacatgcattttcccatagaaataaagatacagtggttttggttcgtaggtcagctcaagtagtctcatttaacctatgacatacgtgaagtacagagtgggaagtacaaatgtaaaagggaaccccattctcaccgttgtgagaccctggaa

SEQ ID NO: 90451 - DNA, 601 bp, Human
tttttaagagatgagggtttctctatgctgcccaggctggacacaaactcctggggcacaagtgatcctcccacctcagtctctcaagtagctgggattacaggcgtgcaccaccatgctcagtttaggcatatattataaaagaagcaatttgcctgaagcactacactcccctgtagactgtggacagataagtaagcaaaacaatttttctcccagagtaggagttggcaaactacagcccctgggacaaatccagtccactgtctgtttctgtgaatacagtattaatttaacacakcccagtccattcgtttgcatattatctatggcttctttcagctacaacatcagagttgagtagttgtgacaaaatctgtatagcctcaaaagcctgaaatacttaccatctgtcccattacagaaaagttccctaactcccatcctagggtattaacatatgaatttgttccatagagccactgtaatcccagcactttgggaggcggagaggggaggatggctggagcccaggagtttgagaccagcctgggtaacatggcaaaactctgtctctacaaaaattagccaggcatgctgg

SEQ ID NO: 90452 - DNA, 601 bp, Human
ttcaaagttgccattgaaattgaaaaatatatccagctctctattatgaattaggatggtttatatttactgtcttttagattcatatcccattcccaataggaaagagatgtgatgcattctctatgtctctcttgggagtagattcatgatattattcagtcttcgatgggcagaaaaccatacaaattggatcaaatcgttcatactatgcaccagtgatgctctgaatatatactataaaatcaatattctttctattcttttgcctctcaataaccaattttaataagtggaaaakaattcagattcctctgacaatagcctctttagaaagaatggggaaaattcttgggttacaattgtgtcaatgaaagggattctttattttaaaaaagataaaaatatccaaagcaaataagaacaaatgttaacagttactaaatctgagtaacaaatacatagatacttgttttcgtttttctatatttttctttgaagtatctgattcaaactcaaagaggatgctaaaatcagtttgaacaaagcaccagtgaatacttcaaagaaaaataaagaaaaaagcacgtttttcttggtg

SEQ ID NO: 90453 - DNA, 601 bp, Human
tactcttagatccatcccctagaaatatgctttctctgaataatcaaattattcaatccttttttgtagattctgctcagggcttccctatgacgtctggcttgctctggtattttgggtgctgatgaatcttagagatatacacatatattctcattaatttgcaacttttttcttgatgcaaacaaacacaaagcaatcaaaacaaaaatgttctagaggacacatacattcccttatccacagtgcagggccacagggtacagacagcagaaagtcatgtgttttggcttgctggtamtaccagagatcttcatccctatgctttgtgaagtgaatacatcaaagtgcctctcttccaagatggtttgactcaagttcatgttgatgaatgcattttagactaaacttttttattttgagataattttagattcacattcatttgtaagaaataatatagagccatctcctatactcttctcccagcttcccccagttgtaacatctttcatgactatagtataatgtcacagccaggaaactgacattgattcaactatcttatttagaattcacaagttttacatgttatcatttg

SEQ ID NO: 90454 - DNA, 601 bp, Human
ttttaatgtgaaaaatgatgaatagatacagctggcataattgctggactttaagttcatagcatagtggggaaaggaagaagataaaaaatacaatcaatttattttactgttttatatatatacatataaatctgcattatctttgcttataacagcaatttgagcttacaactaatgtaatcataaatataaaaataagcaaaatgagtaaaattaaaatcatccataatccaacaatcattgattatgtcttaatgaatattatcccctatattttttgcatattgaaattttcttctcaaaaagtatcatattattttgcaatctactatatttaaaacatccccttttatcagatatttagctgttacttattcatccccattgtaaacagtgctgcatatgaatagttggctgaaattattaggttggtacaaaagtaattacggtttttgccattactttccatggcaaaaccgcaattacttctgcaccaatctaaataaattatatatgcttagaaagaaaaatggaaggataaaacacaaatgaagaaattctgaaaaatggaccaatatgtaggatattgttggcttca

SEQ ID NO: 90455 - DNA, 601 bp, Human
caggttctgttgctatcagcctagaggtgacacttagagggacataaaatgaagagcactgcaggaaaaaggtcaagtcactggatgaaaccctacatacttatggattttggtgacatgagcctctaaaattcctaattatttaaggtggtttaaatggattttgcttttattataagccaagggcatcaaagtgatccaaggtccagaatcacaggccactgtacattgctttcttccagggcatcatactgcttggagaaatgacaccggccccaccttagagcaggattccatagtrcagctttacatgaaggatggcaagtagaatggctcatttttccatttcataattattgcttatacactgttgttatggaattatagaattttagagcaggaaggaattttagggatggagaattaagctaaaaccaatgtctatgtttatcttcaaaggaaggccttcaaaagaggatcaagcccggtgcctccaaatattagggaaagtgccattatccacttcaaaacacatcctgagcatgacaagtcatgttacatcttgtgttaaaagcaaaaggaaatattttcttatagccac

SEQ ID NO: 90456 - DNA, 601 bp, Human
aatgcagataacccagaaaaaaatacaggtgaagaaacacttccccaaatcccacagaaaggtttggagagtatgtttattctttagcagttcacaggatttttaaaaaattaacaaataaaaattgtacatatttattgtgtacaagatgatgtcctgacatacatatacaattgtgaaatgtcttcattaagccaattaacatatgcattacctacatagctgtcactttttgtggtgagaatacttaaaatctactctgttagtgattttcaaaataaaatacattgctgttaattayagtaaccatgttgtacaatagatctcttgaatttattccttttgtctaagtaaaatattgcatcctttgaccaacatctctccaaccctcagccccacccccaggttctggaaagcaccattttagtctctgcatctatgagttcaacttttttagattccacatgtaagtgagaaagtgcagcatttgtctttgctttctgtgcctggcttatttcattgaacacagtgtcctccagattcatccatgttgttgcaaataacaggaatttcttcttttttagggctgaatagtaatgat

SEQ ID NO: 90457 - DNA, 601 bp, Human
aatgaccaacacctcaatgtcacctcttctagaaacctctctcgctagtccacagggctggagtgcacaggctcagaggtttcccaggatatgttgaccatgcctctatttcaaacaactgcttctttctacttttgtctcccccttagctgtcaagctccttgaggcagatttggaaaaatacctggaaactggtcagtatgcttaatatctgctcaatgagccatcattagcattaaacacccaggatgctgtcatataaaagtaatgataataataacactgaacatttactgggctyattatatttcaggcactattctaagcacatgacatgtattagctcatttaattctcacaacgttatagaattgtctctatcaccaatttacaaatgagggtttgaactttaaattttaacaagaagttaggctcttttaaaacacacacacactgccccattttttatgagtaccatttgaaagataaactaattcgtcatccgcctctaggattctaattaaacaatctatagctatttttaatggcaaatgtaaattcaactccattagagtcatgaagcttgtctcctgtgacttaa

SEQ ID NO: 90458 - DNA, 601 bp, Human
tcacatgcatgccaagcaggctgcatctgctttttggtggaataaagagcagttgatacaaccagaagccagcaagcttgcacccttgcctcctctcttcctctctcacccacaaaaccaagattctgtgctctgacttcctgaaatcctgcattgcagcgattcctagtttcctcaggggtccctgccttacaaattcagcccttttcccactctctaagatggtattgttcaagagggtataggacctgactaaaaccattcacatccagatgagagagaataaaccttcccatgaaaygtgagcatttttaaagaatataatagagccaatcctaaatgaggccaatgtctgagggagattttctgcatgaccgtctctcctccctggaccccaggcacaaccagagttccacaatacaggcaccagacacttgggccccacttttgagaggacagacagtcctgattcagatcatcattcaggtggccttttatttttaacttgaaaatttttctgccataaaaccgttggcagaataataaaaaaagatcggcctaaacgtcataaatcaactctttcattttccatgggatttat

SEQ ID NO: 90459 - DNA, 601 bp, Human
ataaaaacaagagctacattctgtaattgctatagtccatgataaataaaaaggaaatatacattttgtacttacagagaagccactgtataatgacaacctacttgtaaacacaatctgggtttactaacttgcatctgataacaatgccatacacagggcatcaagtcctagagggtcaaggctgcgcagtctaaggcagtttgagagaacacttcctttaaactgagaacaacaaagataccagttattacctcaatcactttgtgattcccactctgagcaggacagatcctaagarctagaaaggaccacagtcatgatttctttagcccgtttatttacaaatggatttaccagggaggatgacagcttccttcacttacacaattctgaaaagaaaagaggtcacacttatattttctgaaatgtacatatttctaaagtccacaagcttcctctttttagtccattcctgagactaaattagattagtagggtatgatcaaattgtgattgcccacttgttttcgttagctacggtataaatcaaatttcatgcttccttttgctgctcaaggggtgtttatagtctgcagag

SEQ ID NO: 90460 - DNA, 601 bp, Human
atcatatggtaactatgtagccaaaaacaaaaaaaaaaaacgtagacaacatgactccaaatagcaagattcaaacacttattttagtgcaaaacttgttttccgcctcattccattcacatgagatatcaacaattacaagaaaactcatgcaatgtttccacttcatatagatcagccatcagagctttttccaagctgtgataaggaacacaatccttcagtttcttttgctttttacagtctgatgaatatgagtgtcttgaaaaatttagaggtttctagtattcttttttttttwaaaaaaaaattagccctgtaatggctataccacaaagagtagattaactaatttaatcatttatgtttatattttaactctaaagactaattgttgatatccagcatggcaattttacttgttaaagtacagttcagagtttagttcctttcagggagatattcttgcctatatcagaagagaagctaaaaagaatgctacacaaaatagatcaataggcttgctttaattactcttgtcctctttgattttattgcttactgggtgaggaaaagccagaagaatttaataccccttaca

SEQ ID NO: 90461 - DNA, 601 bp, Human
tttgtgtctggtttctttcacttagcatgtttttggagttcatccacgttgtagcatgtgtcattacttcattcattcttatggcaggataatattcactgtatagatatactaaattttgcttgtccattcttcagttgatgggcatttgggttctttccacattttgactggtatgaataaagctgctgtgaatattcatacacactttgtgtgaacgtaggttttcaatgattttgggtatataactagaagtggaattgctggatcatatggtaactatgtagccaaaaacaaaaamaaaaaacgtagacaacatgactccaaatagcaagattcaaacacttattttagtgcaaaacttgttttccgcctcattccattcacatgagatatcaacaattacaagaaaactcatgcaatgtttccacttcatatagatcagccatcagagctttttccaagctgtgataaggaacacaatccttcagtttcttttgctttttacagtctgatgaatatgagtgtcttgaaaaatttagaggtttctagtattctttttttttttaaaaaaaaattagccctgtaatggctataccac

SEQ ID NO: 90462 - DNA, 601 bp, Human
atcatatgccataaaagttaccactttaaagtgtatagttctgtgtttctttttagtatactcatagatagtgtacaaccatcatcactgattccaaaacattttcatcacaccaaaaggaaagcccatacccagtcactccccattcccctctcaccccagcccctgggaaccactaatctactttctgtctctatggttttgcatgtttttgacatttaatataaaagtagaatcatataatatgtgggctttttgtgtctggtttctttcacttagcatgtttttggagttcatccaygttgtagcatgtgtcattacttcattcattcttatggcaggataatattcactgtatagatatactaaattttgcttgtccattcttcagttgatgggcatttgggttctttccacattttgactggtatgaataaagctgctgtgaatattcatacacactttgtgtgaacgtaggttttcaatgattttgggtatataactagaagtggaattgctggatcatatggtaactatgtagccaaaaacaaaaaaaaaaaacgtagacaacatgactccaaatagcaagattcaaacactt

SEQ ID NO: 90463 - DNA, 601 bp, Human
tttcaaaaatgttttctcctcaatatacgacttttaaaatgataaattacacagtatttcacagacctgtgtaaatacttttgctctgatgtatagaaaatcatgctttctctgagcaatgaagcatattgaaatttacattttcaaaaataaattatagtaaaataatagaagagcttggacataaaaatcatatgccataaaagttaccactttaaagtgtatagttctgtgtttctttttagtatactcatagatagtgtacaaccatcatcactgattccaaaacattttcatcacmccaaaaggaaagcccatacccagtcactccccattcccctctcaccccagcccctgggaaccactaatctactttctgtctctatggttttgcatgtttttgacatttaatataaaagtagaatcatataatatgtgggctttttgtgtctggtttctttcacttagcatgtttttggagttcatccacgttgtagcatgtgtcattacttcattcattcttatggcaggataatattcactgtatagatatactaaattttgcttgtccattcttcagttgatgggcatttgggttctt

SEQ ID NO: 90464 - DNA, 601 bp, Human
aaagtaaagtgcgatgcttcaagtttactttagtccattatatattgcagcccacggttcttaacttcttggatttttaaacttctttgttatatttggaattgttaaccaaaagagagatctgaggttattttgttatggcagacccagtgaccaagacaatatctgtattttttgtttccttatttttactttttaaatttctgtgggttcatagtaggtttatatatttatggggtacatgagatgttttgatacaggcaggcaatgcataataatcatcatggagaatggggtatcygtcccctcaagcatttatcctttgaattacaaaccatccaattccactctttaagttattttaaaaatgtacagttaagttattgttgactatagtcaccctgttgtgctatcaaatggtaggtcttattcattaattctaattattttttgtagccattaactatccccacctcccctgatcccccacactgcccttccaagcctgtggtaaccgtccttctactctctatccatgagttcaattgctttgatttttagaacccacaaataggtaagaacatgcgatgtttgtctttct

SEQ ID NO: 90465 - DNA, 601 bp, Human
ccaaatgcccatcactcaatgagtggataaagaaactgtggtatatatataagtatgatggaatactactcagccataagaaggaatgaattaatggcattaacagcgacctggatgggattggagactattattctaagtgaagtaactcaggaatggaaaactagacattgtatgttctcactaataggtgggagctaagctatgaggatgcaaaggcataagaatgacacaatagacttcagggactcagggagaaagggtgggaaaggggtgagggataaaaaactatgaattgtgytcagtgtatactgcttgggtgatggctgcaccaaaatctcacagatcaccactaaagaacttattcgtgtaaccaaataccacctgttcctaaaaaaccatggaaataataaataaataaatacaatttagacaaatgttgccaaattgccttgcaccctgttgcaacaatttacacctctaccaacagtgtatgagagtgtttgtttccccacgaagtgtatcatccaacttttggagccatgccactctgagagaaaaaaaaaatctccttggtgtttaggttgcatttctttaatga

SEQ ID NO: 90466 - DNA, 601 bp, Human
ataccagtagtttttaatctaaatccatctctatcctgctcccctccacctactcactgcaattcttccttgctccattttgtcagttgctcatcctccatgcaactcatcctgggatgagttatcaccccaaactcgggaaatgaacccttagttcaagccaatcccagtgatttatttctacttcccagtattgatttgggcactggcaggtgttgcaattctaggacatgagaagggaatattgctaacttctcagtcatcaaacaagatagtaatagtgaaagtaataacttgtaawgaagattgacttattaaagttacccatttaatgcataactcatgtgtctatagactgcatggtggcatcagttgtttaaaccagtcataaaaatattgacttttattttttgcttaatgccaccaaaggaactcatctcaccttgaaaaaatatttggtcacatatgcagtcatgtgccacataacaatgctttggtcaacaggccatatataagacagtggtctgaaaagattataatggaggtgcttcatacagctatactattttttatcttttatgcaatatttctactatgcctt

SEQ ID NO: 90467 - DNA, 601 bp, Human
agcagaggtttccatgagggctatgcccctgcagcagacttctgcctggacatccaggtgtttccatacattctctaaaatctaggtggaggttcccaaactgcaattcttgacttctgtgtacccacgggaccaacaccacatgtaagctgccaaggcttggggcttgcaccaagcaacagcctgagctataccttggccccttgtagccacagctggagctgaagcagctggaactcagggcaccatgtcctaaggctgcatagagccggggggccctgggccaggcccaggaaaccawttttccctcctaggcctttgggcctgtgatgggaggggctgccgtgcaggtctctgacatgccctggagacattttccccattgtcttggtggttagcatttggctccttgttacttatgcaaatttctgcagccagcttgaatttctccccagaaaatgggtttttcttttctattgcatcatcaggctgcaaattttcgaaactcttatgctttgcttcctcttgaaggttttgctgcttagaagtttcttccaccagataccctaaatcatctttctcaagttcaaagtcccacaga

SEQ ID NO: 90468 - DNA, 601 bp, Human
gggcgacagagggagactccatctcaaaaaggaacaaaaaaataaaaaataaaaaagatgaactagttgatagttaataatcatgactggtctatttgtctgctacactttctttcctctatgtgtggcaagtgcctacttactcttttaagacttgtgtcaaagaccacctagttcttcaccttttctggaccctgttagttctcaaacaaaattgtgccccctttcctctcttttagtggttctgtacctctcaaaccctgtattgtggctgttatttactgaactgttaccctagagwgtaaaaactttatcatagtcctaattttatttttggaaactggtatgttcccagccatacaggaggtgcacaatacacacgtactaaataaagtaatggtcatttgaaagagtaaatggtgaatacacagcaattctccaatctttgtgtttatgcaaacacaagaattaactttattggcctaattcaaacgttatcttgaaatttattcaaagttcccattttccatgaattaaccagacattttttgttactagattttcactaattaaccagttaaatctcttttgtcttatatca

SEQ ID NO: 90469 - DNA, 601 bp, Human
cagataaaaatagtcttcctgtaaaattaatttttatccatttctagaaatatggcagctgcatataagataaatgtcttcaacgtttagtctgtagatccttaacaatattaagttatgtagaaagggacaaccttatgtcgtaaataggttatctattttagttaaattgttttcactattccttttagaaaatcattgttgtaccaaagtggagagagagttaagtgaagtatttcttttgggaaatcttacgggatgaatggctatgatattcttgaacctacttatgagaacccayatgttatttagtttgaggaaatgaaaagtaaactgctgttagagaaaattattgtttctgggaaatttatagtgcagtaaactctcctttgttttcagcacataaagaatgtaagatagctgctctagtagtcagttaggaagggatcctttcagaatgacagtaactcatttcaccttttcccaaaaagaagatttcagctgccattactcccttgctactttatagtataaattatgtgaagtcagttttggtttgaataggattaatttttcatctctctatgacatatgaccgtgt

SEQ ID NO: 90470 - DNA, 601 bp, Human
aaagctacttaaaatttttttgttttgttttgccatgaagcctgatatttctccccttagttgggtgggtgatatgtcttttctttggaaccaccaggatctgccttccttttcccacttagctaccttcgaggcactatagaacatttcagagttttcactgagcctatgtaaatatgatttagtttaaaaaatctataatggcccagtatgtattgttcgattacttccctagcccttccttccatgttaattcaaattcttgcttcctgctgctttgtatatataatacatgcaagcwaacatacatctccttctgttgagggaacatctcatcattctgttgagggaacctcctgcaaaaatgctcattctgcttagtctagccaaatggacactttctgaaaaatcacctaaagtccacattagatgtatttgaatcccaatatcaatatcatcatcctagaataaaccaagtttaaaagagaatacattactaataccaacctgagtgatccctttaatatgctctatacatatggaaaattgctctaatctggagacataaaagtgctctactgcaggaatagaatgagcaaaa

SEQ ID NO: 90471 - DNA, 601 bp, Human
tgttttgtcttttatttccaaatgggaggagggaagccacaaagtcagatgcatctttctgctcgtccctctgcaagtcctgcttgagtttataggccctgtcattcgcaatgacttgggataagggcattccaaatgcctgtgggatgaattctggaatcaaaaaacagacattcactttcagagactgactggtccagtgaacactctcatttatgtttcagacctaagtaagaacagacatattcaaaggaatgttttctgaagaattgactcatcaatcaaaaaggtgacatttgtsttaatcagaatggcccaagtttccatttcaataaagaaaactagtatttataaacacacatcttagacatttaggtctctagtttttctccatgtttcaagtctatccattcattcaacaggcatttattgaatgcctactacatgccacaacaagctaggcaatgggaggcgcaaagcttataaaaggtacagtcctttctcctgaggtgttcagagtgtgggttggggtgaaggagtggataatcagaaatgcaaatcatgataacagagtgagtatcaggtgttagagagatgcatg

SEQ ID NO: 90472 - DNA, 601 bp, Human
agtaagtttggaatgcctctggccccttcttattgatttacagtgcatgttagcttattaaggagtctaaaacctcctgaggaatccgaggtcagggagaggtataactgcatggtatcaaagagggaagggggtgtctcttgttaaggtgaagattaaatacgttgcccataagtaagcaacttaaaattcaagccagcatctcatttgtccaagggtgaaacaaaaaaaaaaatcttgaaatatatgagtgtaaccaaagagaaccagaacccaagatcttagatttggtgggcggggsgggggcacactggggcctgagtggggatcagatccaacaagaacatttctaaagagtctgtgggactatgtacaacctgctttgagcagttgataccatgtgacatcaagacacaatggcaatggtcagcagatcagacccagtttcctccacacctggtttggaagcaggactgaccctcccttgcatcgagcaagtccctgttttggggggagagtttaagaaaggaaaggatcccttgaaagggagacactagacttcttgctcatagtgcagatgggagctccagggataaactgg

SEQ ID NO: 90473 - DNA, 601 bp, Human
agctaaaggggagtacggggtgaaggaagggaactattttttgcttgaagcataaaaaattattcacattcaatatattaataattagaaagcacaggtaagccaaaagaaaaaaaaatgcccataatttcaccactgccaagaatcagccattcctatgccttcctgtgcacatatatacatgtacacctgatattttcttctttaaaactgggatcacatccatatattattttgtaacttgcttactatctcttaacaacatgctacaataatctttccactacaaaaaaaaaaaaaatcctgtcttcaggcttcattggcccctagaatcccactgcacgaataaaccatgatgttttttaaccacagtcaactaataggcattgatgtcgtcttgaattttctgttattataagcaatggtacaaaaaatatccttgaaaagatattttgtgagctcgggtgagcactttttaggagtaaattcctacaagttgaattgttgtaataaggaatatgaacgttttcaaaggtttgggaattttttctacttgtctttctttcaggtgaacgggagagtctgagtaagtttctctagg

SEQ ID NO: 90474 - DNA, 601 bp, Human
tcttctaatctttggctataactgcacatttcgtttcctaacatttaataaaaatttcaaactactggctcagttatattggatgaacacttatttctctattaatttaggtacttaatggagaaataaaagtcaagtaaataaactgataggaaacagcagcttgaaataagtaagaaagaaatatctaggtagaccactgacttaagcataccttttcaggaattaggatgctgtaaaaaaaaatctgactgaggcaacagcccctgaaatccagttttggctctgctgtttataattratataaacttggacacatcaatcaccttctttaggattctgttcccacatctgaaaacatatgcatattcattttacttaatggggggtgttacgggaatcaaaagcgctaaaaaaaaatgaaaatagattaccaattgcaaagagatctagtaataaaatgttttattagaaatagatgaaataagtaagttaaacacttgaaaaaataaaagcagataacatggagatggacaatatttattctgcagttattagtttttattaacagtcatccattcgctttcagagaagaagcact

SEQ ID NO: 90475 - DNA, 601 bp, Human
catggaattccttttcaccaaatttttctaaataatataactttttaagtatctgcaataatcatgagtgaaaattaatttatcaagttcaacaccaatatacaggaataacttaacatgtgttactgtttataagacaccatcgattaagacatgccattattttatttatttgtttatttatttattattatgagacagagtctcactctgtcacccaggctggagtgcagtggtgcagtctcggctcactgcaacttccacctccccagttcaagcgattctcccatctcagcctcaygagtagctgggattacaggcacctgtcactacgcctggctaatttttgtatttttagtagagagggggtttagccatgttggccaggttggtctcgaactcctgacctcaggtgatctgcccgcctcggcatcccaaagtgctggggttacaggtacgggattacgttaggagcttatcattggttataagattagtctcaatttcagagatcataggtcatgggagaaacgtatcttagaattgctgaaatttagtaggttaaaagtataacaaaagtgataattttgtaagagcatag

SEQ ID NO: 90476 - DNA, 601 bp, Human
atgtgcaggtttgttacatatgcatgcatgtgccatgttggtgtgctgcacccattaactcgtcatttagcattaggtatatctcctaatgctattcctcccccctccccccatcccacaacagaccccggagtgtgatgttccccttcctgtgtccatgtgttctcattgttcaattcccacctatgagtgagaacatgcggtgtttggtgtttctgtccttgcgatagtttgctgagaatgatggtttccagcttcatccatgtccctacaaaggacatgaactcttcattttttatgrctgcatagtattccatgatgtatatgtgccacattttcttaatccagtctatcgttgttggacatttgggttggttccaagtctttgctattttcttggaagccctgacactcacctaagatcttggtctagggtctgctcacctacactttaaaattctacttcttactcttacggatagggaacagaaggggctggacaattgtacagcttggaatgggcttaatatgtgtgcttcttccttttcctaatagaagagaaagaaaggttcgctttttaccacagcatttatatgcaaag

SEQ ID NO: 90477 - DNA, 601 bp, Human
ttcaaatcacacctcttttccttctccaaactccaagtggattcatggtctggagcattgattcccttcctttgtcaacacaaggatgcctttttaatgtcaaaaatcacccagctcaaactcccacatgatagtaaatttgtgatatccaacgtggtagatctaagctagaggttcttaaccctggttgctcattaaaatcatgcaagagactttaaacaaaaatccgaatgtccagattgcagcctatgaaaatgaaccagaatctctgaggggtggcccaggcatagttgttcttcargctcccaggtgattccaaggggctggtgagtctgacagccagtgggccagcacctattgtttggcattctacccttggaggcctcctccaacaagtctgaaagctcctaaaagcaagaatatactttgatattttaagctttttaaactcaaagtgtggatcatggaccagtagtatcaggatcacttgggagcttgttagaaattcagattcatagactacctccccgagtcctactgattcagaaagagcattttaacaagatctggtgatacccatgcatagtaaagtttgagaagc

SEQ ID NO: 90478 - DNA, 601 bp, Human; identical to SEQ ID NO: 90390

SEQ ID NO: 90479 - DNA, 601 bp, Human; identical to SEQ ID NO: 90391

SEQ ID NO: 90480 - DNA, 601 bp, Human; identical to SEQ ID NO: 90392

SEQ ID NO: 90481 - DNA, 601 bp, Human; identical to SEQ ID NO: 90393

SEQ ID NO: 90482 - DNA, 601 bp, Human; identical to SEQ ID NO: 90394

SEQ ID NO: 90483 - DNA, 601 bp, Human; identical to SEQ ID NO: 90395

SEQ ID NO: 90484 - DNA, 601 bp, Human; identical to SEQ ID NO: 90396

SEQ ID NO: 90485 - DNA, 601 bp, Human; identical to SEQ ID NO: 90397

SEQ ID NO: 90486 - DNA, 601 bp, Human; identical to SEQ ID NO: 90398

SEQ ID NO: 90487 - DNA, 601 bp, Human; identical to SEQ ID NO: 90399

SEQ ID NO: 90488 - DNA, 601 bp, Human; identical to SEQ ID NO: 90400

SEQ ID NO: 90489 - DNA, 601 bp, Human; identical to SEQ ID NO: 90401

SEQ ID NO: 90490 - DNA, 601 bp, Human; identical to SEQ ID NO: 90402

SEQ ID NO: 90491 - DNA, 601 bp, Human; identical to SEQ ID NO: 90403

SEQ ID NO: 90492 - DNA, 601 bp, Human; identical to SEQ ID NO: 90404

SEQ ID NO: 90493 - DNA, 601 bp, Human; identical to SEQ ID NO: 90405

SEQ ID NO: 90494 - DNA, 601 bp, Human; identical to SEQ ID NO: 90406

SEQ ID NO: 90495 - DNA, 601 bp, Human; identical to SEQ ID NO: 90407

SEQ ID NO: 90496 - DNA, 601 bp, Human; identical to SEQ ID NO: 90408

SEQ ID NO: 90497 - DNA, 601 bp, Human; identical to SEQ ID NO: 90409

SEQ ID NO: 90498 - DNA, 601 bp, Human; identical to SEQ ID NO: 90410

SEQ ID NO: 90499 - DNA, 601 bp, Human; identical to SEQ ID NO: 90411

SEQ ID NO: 90500 - DNA, 601 bp, Human; identical to SEQ ID NO: 90412

SEQ ID NO: 90501 - DNA, 601 bp, Human; identical to SEQ ID NO: 90413

SEQ ID NO: 90502 - DNA, 601 bp, Human; identical to SEQ ID NO: 90414

SEQ ID NO: 90503 - DNA, 601 bp, Human; identical to SEQ ID NO: 90415

SEQ ID NO: 90504 - DNA, 601 bp, Human; identical to SEQ ID NO: 90416

SEQ ID NO: 90505 - DNA, 601 bp, Human; identical to SEQ ID NO: 90417

SEQ ID NO: 90506 - DNA, 601 bp, Human; identical to SEQ ID NO: 90418

SEQ ID NO: 90507 - DNA, 601 bp, Human; identical to SEQ ID NO: 90419

SEQ ID NO: 90508 - DNA, 601 bp, Human; identical to SEQ ID NO: 90420

SEQ ID NO: 90509 - DNA, 601 bp, Human; identical to SEQ ID NO: 90421

SEQ ID NO: 90510 - DNA, 601 bp, Human; identical to SEQ ID NO: 90422

SEQ ID NO: 90511 - DNA, 601 bp, Human; identical to SEQ ID NO: 90423

SEQ ID NO: 90512 - DNA, 601 bp, Human; identical to SEQ ID NO: 90424

SEQ ID NO: 90513 - DNA, 601 bp, Human; identical to SEQ ID NO: 90425

SEQ ID NO: 90514 - DNA, 601 bp, Human; identical to SEQ ID NO: 90426

SEQ ID NO: 90515 - DNA, 601 bp, Human; identical to SEQ ID NO: 90427

SEQ ID NO: 90516 - DNA, 601 bp, Human; identical to SEQ ID NO: 90428

SEQ ID NO: 90517 - DNA, 601 bp, Human; identical to SEQ ID NO: 90429

SEQ ID NO: 90518 - DNA, 601 bp, Human; identical to SEQ ID NO: 90430

SEQ ID NO: 90519 - DNA, 601 bp, Human; identical to SEQ ID NO: 90431

SEQ ID NO: 90520 - DNA, 601 bp, Human; identical to SEQ ID NO: 90432

SEQ ID NO: 90521 - DNA, 601 bp, Human; identical to SEQ ID NO: 90433

SEQ ID NO: 90522 - DNA, 601 bp, Human; identical to SEQ ID NO: 90434

SEQ ID NO: 90523 - DNA, 601 bp, Human; identical to SEQ ID NO: 90435

SEQ ID NO: 90524 - DNA, 601 bp, Human; identical to SEQ ID NO: 90436

SEQ ID NO: 90525 - DNA, 601 bp, Human; identical to SEQ ID NO: 90437

SEQ ID NO: 90526 - DNA, 601 bp, Human; identical to SEQ ID NO: 90438

SEQ ID NO: 90527 - DNA, 601 bp, Human; identical to SEQ ID NO: 90439

SEQ ID NO: 90528 - DNA, 601 bp, Human; identical to SEQ ID NO: 90440

SEQ ID NO: 90529 - DNA, 601 bp, Human; identical to SEQ ID NO: 90441

SEQ ID NO: 90530 - DNA, 601 bp, Human; identical to SEQ ID NO: 90442

SEQ ID NO: 90531 - DNA, 601 bp, Human; identical to SEQ ID NO: 90443

SEQ ID NO: 90532 - DNA, 601 bp, Human; identical to SEQ ID NO: 90444

SEQ ID NO: 90533 - DNA, 601 bp, Human; identical to SEQ ID NO: 90445

SEQ ID NO: 90534 - DNA, 601 bp, Human; identical to SEQ ID NO: 90446

SEQ ID NO: 90535 - DNA, 601 bp, Human; identical to SEQ ID NO: 90447

SEQ ID NO: 90536 - DNA, 601 bp, Human; identical to SEQ ID NO: 90448

SEQ ID NO: 90537 - DNA, 601 bp, Human; identical to SEQ ID NO: 90449

SEQ ID NO: 90538 - DNA, 601 bp, Human; identical to SEQ ID NO: 90450

SEQ ID NO: 90539 - DNA, 601 bp, Human; identical to SEQ ID NO: 90451

SEQ ID NO: 90540 - DNA, 601 bp, Human; identical to SEQ ID NO: 90452

SEQ ID NO: 90541 - DNA, 601 bp, Human; identical to SEQ ID NO: 90453

SEQ ID NO: 90542 - DNA, 601 bp, Human; identical to SEQ ID NO: 90454

SEQ ID NO: 90543 - DNA, 601 bp, Human; identical to SEQ ID NO: 90455

SEQ ID NO: 90544 - DNA, 601 bp, Human; identical to SEQ ID NO: 90456

SEQ ID NO: 90545 - DNA, 601 bp, Human; identical to SEQ ID NO: 90457

SEQ ID NO: 90546 - DNA, 601 bp, Human; identical to SEQ ID NO: 90458

SEQ ID NO: 90547 - DNA, 601 bp, Human; identical to SEQ ID NO: 90459

SEQ ID NO: 90548 - DNA, 601 bp, Human; identical to SEQ ID NO: 90460

SEQ ID NO: 90549 - DNA, 601 bp, Human; identical to SEQ ID NO: 90461

SEQ ID NO: 90550 - DNA, 601 bp, Human; identical to SEQ ID NO: 90462

SEQ ID NO: 90551 - DNA, 601 bp, Human; identical to SEQ ID NO: 90463

SEQ ID NO: 90552 - DNA, 601 bp, Human; identical to SEQ ID NO: 90464

SEQ ID NO: 90553 - DNA, 601 bp, Human; identical to SEQ ID NO: 90465

SEQ ID NO: 90554 - DNA, 601 bp, Human; identical to SEQ ID NO: 90466

SEQ ID NO: 90555 - DNA, 601 bp, Human; identical to SEQ ID NO: 90467

SEQ ID NO: 90556 - DNA, 601 bp, Human; identical to SEQ ID NO: 90468

SEQ ID NO: 90557 - DNA, 601 bp, Human; identical to SEQ ID NO: 90469

SEQ ID NO: 90558 - DNA, 601 bp, Human; identical to SEQ ID NO: 90470

SEQ ID NO: 90559 - DNA, 601 bp, Human; identical to SEQ ID NO: 90471

SEQ ID NO: 90560 - DNA, 601 bp, Human; identical to SEQ ID NO: 90472

SEQ ID NO: 90561 - DNA, 601 bp, Human; identical to SEQ ID NO: 90473

SEQ ID NO: 90562 - DNA, 601 bp, Human; identical to SEQ ID NO: 90474

SEQ ID NO: 90563 - DNA, 601 bp, Human; identical to SEQ ID NO: 90475

SEQ ID NO: 90564 - DNA, 601 bp, Human; identical to SEQ ID NO: 90476

SEQ ID NO: 90565 - DNA, 601 bp, Human; identical to SEQ ID NO: 90477

SEQ ID NO: 90566 - DNA, 601 bp, Human; identical to SEQ ID NO: 90390

SEQ ID NO: 90567 - DNA, 601 bp, Human; identical to SEQ ID NO: 90391

SEQ ID NO: 90568 - DNA, 601 bp, Human; identical to SEQ ID NO: 90392

SEQ ID NO: 90569 - DNA, 601 bp, Human; identical to SEQ ID NO: 90393

SEQ ID NO: 90570 - DNA, 601 bp, Human; identical to SEQ ID NO: 90394

SEQ ID NO: 90571 - DNA, 601 bp, Human; identical to SEQ ID NO: 90395

SEQ ID NO: 90572 - DNA, 601 bp, Human; identical to SEQ ID NO: 90396

SEQ ID NO: 90573 - DNA, 601 bp, Human; identical to SEQ ID NO: 90397

SEQ ID NO: 90574 - DNA, 601 bp, Human; identical to SEQ ID NO: 90398

SEQ ID NO: 90575 - DNA, 601 bp, Human; identical to SEQ ID NO: 90399

SEQ ID NO: 90576 - DNA, 601 bp, Human; identical to SEQ ID NO: 90400

SEQ ID NO: 90577 - DNA, 601 bp, Human; identical to SEQ ID NO: 90401

SEQ ID NO: 90578 - DNA, 601 bp, Human; identical to SEQ ID NO: 90402

SEQ ID NO: 90579 - DNA, 601 bp, Human; identical to SEQ ID NO: 90403

SEQ ID NO: 90580 - DNA, 601 bp, Human; identical to SEQ ID NO: 90404

SEQ ID NO: 90581 - DNA, 601 bp, Human; identical to SEQ ID NO: 90405

SEQ ID NO: 90582 - DNA, 601 bp, Human; identical to SEQ ID NO: 90406

SEQ ID NO: 90583 - DNA, 601 bp, Human; identical to SEQ ID NO: 90407

SEQ ID NO: 90584 - DNA, 601 bp, Human; identical to SEQ ID NO: 90408

SEQ ID NO: 90585 - DNA, 601 bp, Human; identical to SEQ ID NO: 90409

SEQ ID NO: 90586 - DNA, 601 bp, Human; identical to SEQ ID NO: 90410

SEQ ID NO: 90587 - DNA, 601 bp, Human; identical to SEQ ID NO: 90411

SEQ ID NO: 90588 - DNA, 601 bp, Human; identical to SEQ ID NO: 90412

SEQ ID NO: 90589 - DNA, 601 bp, Human; identical to SEQ ID NO: 90413

SEQ ID NO: 90590 - DNA, 601 bp, Human; identical to SEQ ID NO: 90414

SEQ ID NO: 90591 - DNA, 601 bp, Human; identical to SEQ ID NO: 90415

SEQ ID NO: 90592 - DNA, 601 bp, Human; identical to SEQ ID NO: 90416

SEQ ID NO: 90593 - DNA, 601 bp, Human; identical to SEQ ID NO: 90417

SEQ ID NO: 90594 - DNA, 601 bp, Human; identical to SEQ ID NO: 90418

SEQ ID NO: 90595 - DNA, 601 bp, Human; identical to SEQ ID NO: 90419

SEQ ID NO: 90596 - DNA, 601 bp, Human; identical to SEQ ID NO: 90420

SEQ ID NO: 90597 - DNA, 601 bp, Human; identical to SEQ ID NO: 90421

SEQ ID NO: 90598 - DNA, 601 bp, Human; identical to SEQ ID NO: 90422

SEQ ID NO: 90599 - DNA, 601 bp, Human; identical to SEQ ID NO: 90423

SEQ ID NO: 90600 - DNA, 601 bp, Human; identical to SEQ ID NO: 90424

SEQ ID NO: 90601 - DNA, 601 bp, Human; identical to SEQ ID NO: 90425

SEQ ID NO: 90602 - DNA, 601 bp, Human; identical to SEQ ID NO: 90426

SEQ ID NO: 90603 - DNA, 601 bp, Human; identical to SEQ ID NO: 90427

SEQ ID NO: 90604 - DNA, 601 bp, Human; identical to SEQ ID NO: 90428

SEQ ID NO: 90605 - DNA, 601 bp, Human; identical to SEQ ID NO: 90429

SEQ ID NO: 90606 - DNA, 601 bp, Human; identical to SEQ ID NO: 90430

SEQ ID NO: 90607 - DNA, 601 bp, Human; identical to SEQ ID NO: 90431

SEQ ID NO: 90608 - DNA, 601 bp, Human; identical to SEQ ID NO: 90432

SEQ ID NO: 90609 - DNA, 601 bp, Human; identical to SEQ ID NO: 90433

SEQ ID NO: 90610 - DNA, 601 bp, Human; identical to SEQ ID NO: 90434

SEQ ID NO: 90611 - DNA, 601 bp, Human; identical to SEQ ID NO: 90435

SEQ ID NO: 90612 - DNA, 601 bp, Human; identical to SEQ ID NO: 90436

SEQ ID NO: 90613 - DNA, 601 bp, Human; identical to SEQ ID NO: 90437

SEQ ID NO: 90614 - DNA, 601 bp, Human; identical to SEQ ID NO: 90438

SEQ ID NO: 90615 - DNA, 601 bp, Human; identical to SEQ ID NO: 90439

SEQ ID NO: 90616 - DNA, 601 bp, Human; identical to SEQ ID NO: 90440

SEQ ID NO: 90617 - DNA, 601 bp, Human; identical to SEQ ID NO: 90441

SEQ ID NO: 90618 - DNA, 601 bp, Human; identical to SEQ ID NO: 90442

SEQ ID NO: 90619 - DNA, 601 bp, Human; identical to SEQ ID NO: 90443

SEQ ID NO: 90620 - DNA, 601 bp, Human; identical to SEQ ID NO: 90444

SEQ ID NO: 90621 - DNA, 601 bp, Human; identical to SEQ ID NO: 90445

SEQ ID NO: 90622 - DNA, 601 bp, Human; identical to SEQ ID NO: 90446

SEQ ID NO: 90623 - DNA, 601 bp, Human; identical to SEQ ID NO: 90447

SEQ ID NO: 90624 - DNA, 601 bp, Human; identical to SEQ ID NO: 90448

SEQ ID NO: 90625 - DNA, 601 bp, Human; identical to SEQ ID NO: 90449

SEQ ID NO: 90626 - DNA, 601 bp, Human; identical to SEQ ID NO: 90450

SEQ ID NO: 90627 - DNA, 601 bp, Human; identical to SEQ ID NO: 90451

SEQ ID NO: 90628 - DNA, 601 bp, Human; identical to SEQ ID NO: 90452

SEQ ID NO: 90629 - DNA, 601 bp, Human; identical to SEQ ID NO: 90453

SEQ ID NO: 90630 - DNA, 601 bp, Human; identical to SEQ ID NO: 90454

SEQ ID NO: 90631 - DNA, 601 bp, Human; identical to SEQ ID NO: 90455

SEQ ID NO: 90632 - DNA, 601 bp, Human; identical to SEQ ID NO: 90456

SEQ ID NO: 90633 - DNA, 601 bp, Human; identical to SEQ ID NO: 90457

SEQ ID NO: 90634 - DNA, 601 bp, Human; identical to SEQ ID NO: 90458

SEQ ID NO: 90635 - DNA, 601 bp, Human; identical to SEQ ID NO: 90459

SEQ ID NO: 90636 - DNA, 601 bp, Human; identical to SEQ ID NO: 90460

SEQ ID NO: 90637 - DNA, 601 bp, Human; identical to SEQ ID NO: 90461

SEQ ID NO: 90638 - DNA, 601 bp, Human; identical to SEQ ID NO: 90462

SEQ ID NO: 90639 - DNA, 601 bp, Human; identical to SEQ ID NO: 90463

SEQ ID NO: 90640 - DNA, 601 bp, Human; identical to SEQ ID NO: 90464

SEQ ID NO: 90641 - DNA, 601 bp, Human; identical to SEQ ID NO: 90465

SEQ ID NO: 90642 - DNA, 601 bp, Human; identical to SEQ ID NO: 90466

SEQ ID NO: 90643 - DNA, 601 bp, Human; identical to SEQ ID NO: 90467

SEQ ID NO: 90644 - DNA, 601 bp, Human; identical to SEQ ID NO: 90468

SEQ ID NO: 90645 - DNA, 601 bp, Human; identical to SEQ ID NO: 90469

SEQ ID NO: 90646 - DNA, 601 bp, Human; identical to SEQ ID NO: 90470

SEQ ID NO: 90647 - DNA, 601 bp, Human; identical to SEQ ID NO: 90471

SEQ ID NO: 90648 - DNA, 601 bp, Human; identical to SEQ ID NO: 90472

SEQ ID NO: 90649 - DNA, 601 bp, Human; identical to SEQ ID NO: 90473

SEQ ID NO: 90650 - DNA, 601 bp, Human; identical to SEQ ID NO: 90474

SEQ ID NO: 90651 - DNA, 601 bp, Human; identical to SEQ ID NO: 90475

SEQ ID NO: 90652 - DNA, 601 bp, Human; identical to SEQ ID NO: 90476

SEQ ID NO: 90653 - DNA, 601 bp, Human; identical to SEQ ID NO: 90477

SEQ ID NO: 90654 - DNA, 601 bp, Human; identical to SEQ ID NO: 90390

SEQ ID NO: 90655 - DNA, 601 bp, Human; identical to SEQ ID NO: 90391

SEQ ID NO: 90656 - DNA, 601 bp, Human; identical to SEQ ID NO: 90392

SEQ ID NO: 90657 - DNA, 601 bp, Human; identical to SEQ ID NO: 90393

SEQ ID NO: 90658 - DNA, 601 bp, Human; identical to SEQ ID NO: 90394

SEQ ID NO: 90659 - DNA, 601 bp, Human; identical to SEQ ID NO: 90395

SEQ ID NO: 90660 - DNA, 601 bp, Human; identical to SEQ ID NO: 90396

SEQ ID NO: 90661 - DNA, 601 bp, Human; identical to SEQ ID NO: 90397

SEQ ID NO: 90662 - DNA, 601 bp, Human; identical to SEQ ID NO: 90398

SEQ ID NO: 90663 - DNA, 601 bp, Human; identical to SEQ ID NO: 90399

SEQ ID NO: 90664 - DNA, 601 bp, Human; identical to SEQ ID NO: 90400

SEQ ID NO: 90665 - DNA, 601 bp, Human; identical to SEQ ID NO: 90401

SEQ ID NO: 90666 - DNA, 601 bp, Human; identical to SEQ ID NO: 90402

SEQ ID NO: 90667 - DNA, 601 bp, Human; identical to SEQ ID NO: 90403

SEQ ID NO: 90668 - DNA, 601 bp, Human; identical to SEQ ID NO: 90404

SEQ ID NO: 90669 - DNA, 601 bp, Human; identical to SEQ ID NO: 90405

SEQ ID NO: 90670 - DNA, 601 bp, Human; identical to SEQ ID NO: 90406

SEQ ID NO: 90671 - DNA, 601 bp, Human; identical to SEQ ID NO: 90407

SEQ ID NO: 90672 - DNA, 601 bp, Human; identical to SEQ ID NO: 90408

SEQ ID NO: 90673 - DNA, 601 bp, Human; identical to SEQ ID NO: 90409

SEQ ID NO: 90674 - DNA, 601 bp, Human; identical to SEQ ID NO: 90410

SEQ ID NO: 90675 - DNA, 601 bp, Human; identical to SEQ ID NO: 90411

SEQ ID NO: 90676 - DNA, 601 bp, Human; identical to SEQ ID NO: 90412

SEQ ID NO: 90677 - DNA, 601 bp, Human; identical to SEQ ID NO: 90413

SEQ ID NO: 90678 - DNA, 601 bp, Human; identical to SEQ ID NO: 90414

SEQ ID NO: 90679 - DNA, 601 bp, Human; identical to SEQ ID NO: 90415

SEQ ID NO: 90680 - DNA, 601 bp, Human; identical to SEQ ID NO: 90416

SEQ ID NO: 90681 - DNA, 601 bp, Human; identical to SEQ ID NO: 90417

SEQ ID NO: 90682 - DNA, 601 bp, Human; identical to SEQ ID NO: 90418

SEQ ID NO: 90683 - DNA, 601 bp, Human; identical to SEQ ID NO: 90419

SEQ ID NO: 90684 - DNA, 601 bp, Human; identical to SEQ ID NO: 90420

SEQ ID NO: 90685 - DNA, 601 bp, Human; identical to SEQ ID NO: 90421

SEQ ID NO: 90686 - DNA, 601 bp, Human; identical to SEQ ID NO: 90422

SEQ ID NO: 90687 - DNA, 601 bp, Human; identical to SEQ ID NO: 90423

SEQ ID NO: 90688 - DNA, 601 bp, Human; identical to SEQ ID NO: 90424

SEQ ID NO: 90689 - DNA, 601 bp, Human; identical to SEQ ID NO: 90425

SEQ ID NO: 90690 - DNA, 601 bp, Human; identical to SEQ ID NO: 90426

SEQ ID NO: 90691 - DNA, 601 bp, Human; identical to SEQ ID NO: 90427

SEQ ID NO: 90692 - DNA, 601 bp, Human; identical to SEQ ID NO: 90428

SEQ ID NO: 90693 - DNA, 601 bp, Human; identical to SEQ ID NO: 90429

SEQ ID NO: 90694 - DNA, 601 bp, Human; identical to SEQ ID NO: 90430

SEQ ID NO: 90695 - DNA, 601 bp, Human; identical to SEQ ID NO: 90431

SEQ ID NO: 90696 - DNA, 601 bp, Human; identical to SEQ ID NO: 90432

SEQ ID NO: 90697 - DNA, 601 bp, Human; identical to SEQ ID NO: 90433

SEQ ID NO: 90698 - DNA, 601 bp, Human; identical to SEQ ID NO: 90434

SEQ ID NO: 90699 - DNA, 601 bp, Human; identical to SEQ ID NO: 90435

SEQ ID NO: 90700 - DNA, 601 bp, Human; identical to SEQ ID NO: 90436

SEQ ID NO: 90701 - DNA, 601 bp, Human; identical to SEQ ID NO: 90437

SEQ ID NO: 90702 - DNA, 601 bp, Human; identical to SEQ ID NO: 90438

SEQ ID NO: 90703 - DNA, 601 bp, Human; identical to SEQ ID NO: 90439

SEQ ID NO: 90704 - DNA, 601 bp, Human; identical to SEQ ID NO: 90440

SEQ ID NO: 90705 - DNA, 601 bp, Human; identical to SEQ ID NO: 90441

SEQ ID NO: 90706 - DNA, 601 bp, Human; identical to SEQ ID NO: 90442

SEQ ID NO: 90707 - DNA, 601 bp, Human; identical to SEQ ID NO: 90443

SEQ ID NO: 90708 - DNA, 601 bp, Human; identical to SEQ ID NO: 90444

SEQ ID NO: 90709 - DNA, 601 bp, Human; identical to SEQ ID NO: 90445

SEQ ID NO: 90710 - DNA, 601 bp, Human; identical to SEQ ID NO: 90446

SEQ ID NO: 90711 - DNA, 601 bp, Human; identical to SEQ ID NO: 90447

SEQ ID NO: 90712 - DNA, 601 bp, Human; identical to SEQ ID NO: 90448

SEQ ID NO: 90713 - DNA, 601 bp, Human; identical to SEQ ID NO: 90449

SEQ ID NO: 90714 - DNA, 601 bp, Human; identical to SEQ ID NO: 90450

SEQ ID NO: 90715 - DNA, 601 bp, Human; identical to SEQ ID NO: 90451

SEQ ID NO: 90716 - DNA, 601 bp, Human; identical to SEQ ID NO: 90452

SEQ ID NO: 90717 - DNA, 601 bp, Human; identical to SEQ ID NO: 90453

SEQ ID NO: 90718 - DNA, 601 bp, Human; identical to SEQ ID NO: 90454

SEQ ID NO: 90719 - DNA, 601 bp, Human; identical to SEQ ID NO: 90455

SEQ ID NO: 90720 - DNA, 601 bp, Human; identical to SEQ ID NO: 90456

SEQ ID NO: 90721 - DNA, 601 bp, Human; identical to SEQ ID NO: 90457

SEQ ID NO: 90722 - DNA, 601 bp, Human; identical to SEQ ID NO: 90458

SEQ ID NO: 90723 - DNA, 601 bp, Human; identical to SEQ ID NO: 90459

SEQ ID NO: 90724 - DNA, 601 bp, Human; identical to SEQ ID NO: 90460

SEQ ID NO: 90725 - DNA, 601 bp, Human; identical to SEQ ID NO: 90461

SEQ ID NO: 90726 - DNA, 601 bp, Human; identical to SEQ ID NO: 90462

SEQ ID NO: 90727 - DNA, 601 bp, Human; identical to SEQ ID NO: 90463

SEQ ID NO: 90728 - DNA, 601 bp, Human; identical to SEQ ID NO: 90464

SEQ ID NO: 90729 - DNA, 601 bp, Human; identical to SEQ ID NO: 90465

SEQ ID NO: 90730 - DNA, 601 bp, Human; identical to SEQ ID NO: 90466

SEQ ID NO: 90731 - DNA, 601 bp, Human; identical to SEQ ID NO: 90467

SEQ ID NO: 90732 - DNA, 601 bp, Human; identical to SEQ ID NO: 90468

SEQ ID NO: 90733 - DNA, 601 bp, Human; identical to SEQ ID NO: 90469

SEQ ID NO: 90734 - DNA, 601 bp, Human; identical to SEQ ID NO: 90470

SEQ ID NO: 90735 - DNA, 601 bp, Human; identical to SEQ ID NO: 90471

SEQ ID NO: 90736 - DNA, 601 bp, Human; identical to SEQ ID NO: 90472

SEQ ID NO: 90737 - DNA, 601 bp, Human; identical to SEQ ID NO: 90473

SEQ ID NO: 90738 - DNA, 601 bp, Human; identical to SEQ ID NO: 90474

SEQ ID NO: 90739 - DNA, 601 bp, Human; identical to SEQ ID NO: 90475

SEQ ID NO: 90740 - DNA, 601 bp, Human; identical to SEQ ID NO: 90476

SEQ ID NO: 90741 - DNA, 601 bp, Human; identical to SEQ ID NO: 90477

SEQ ID NO: 90742 - DNA, 601 bp, Human; identical to SEQ ID NO: 90390

SEQ ID NO: 90743 - DNA, 601 bp, Human; identical to SEQ ID NO: 90391

SEQ ID NO: 90744 - DNA, 601 bp, Human; identical to SEQ ID NO: 90392

SEQ ID NO: 90745 - DNA, 601 bp, Human; identical to SEQ ID NO: 90393

SEQ ID NO: 90746 - DNA, 601 bp, Human; identical to SEQ ID NO: 90394

SEQ ID NO: 90747 - DNA, 601 bp, Human; identical to SEQ ID NO: 90395

SEQ ID NO: 90748 - DNA, 601 bp, Human; identical to SEQ ID NO: 90396

SEQ ID NO: 90749 - DNA, 601 bp, Human; identical to SEQ ID NO: 90397

SEQ ID NO: 90750 - DNA, 601 bp, Human; identical to SEQ ID NO: 90398

SEQ ID NO: 90751 - DNA, 601 bp, Human; identical to SEQ ID NO: 90399

SEQ ID NO: 90752 - DNA, 601 bp, Human; identical to SEQ ID NO: 90400

SEQ ID NO: 90753 - DNA, 601 bp, Human; identical to SEQ ID NO: 90401

SEQ ID NO: 90754 - DNA, 601 bp, Human; identical to SEQ ID NO: 90402

SEQ ID NO: 90755 - DNA, 601 bp, Human; identical to SEQ ID NO: 90403

SEQ ID NO: 90756 - DNA, 601 bp, Human; identical to SEQ ID NO: 90404

SEQ ID NO: 90757 - DNA, 601 bp, Human; identical to SEQ ID NO: 90405

SEQ ID NO: 90758 - DNA, 601 bp, Human; identical to SEQ ID NO: 90406

SEQ ID NO: 90759 - DNA, 601 bp, Human; identical to SEQ ID NO: 90407

SEQ ID NO: 90760 - DNA, 601 bp, Human; identical to SEQ ID NO: 90408

SEQ ID NO: 90761 - DNA, 601 bp, Human; identical to SEQ ID NO: 90409

SEQ ID NO: 90762 - DNA, 601 bp, Human; identical to SEQ ID NO: 90410

SEQ ID NO: 90763 - DNA, 601 bp, Human; identical to SEQ ID NO: 90411

SEQ ID NO: 90764 - DNA, 601 bp, Human; identical to SEQ ID NO: 90412

SEQ ID NO: 90765 - DNA, 601 bp, Human; identical to SEQ ID NO: 90413

SEQ ID NO: 90766 - DNA, 601 bp, Human; identical to SEQ ID NO: 90414

SEQ ID NO: 90767 - DNA, 601 bp, Human; identical to SEQ ID NO: 90415

SEQ ID NO: 90768 - DNA, 601 bp, Human; identical to SEQ ID NO: 90416

SEQ ID NO: 90769 - DNA, 601 bp, Human; identical to SEQ ID NO: 90417

SEQ ID NO: 90770 - DNA, 601 bp, Human; identical to SEQ ID NO: 90418

SEQ ID NO: 90771 - DNA, 601 bp, Human; identical to SEQ ID NO: 90419

SEQ ID NO: 90772 - DNA, 601 bp, Human; identical to SEQ ID NO: 90420

SEQ ID NO: 90773 - DNA, 601 bp, Human; identical to SEQ ID NO: 90421

SEQ ID NO: 90774 - DNA, 601 bp, Human; identical to SEQ ID NO: 90422

SEQ ID NO: 90775 - DNA, 601 bp, Human; identical to SEQ ID NO: 90423

SEQ ID NO: 90776 - DNA, 601 bp, Human; identical to SEQ ID NO: 90424

SEQ ID NO: 90777 - DNA, 601 bp, Human; identical to SEQ ID NO: 90425

SEQ ID NO: 90778 - DNA, 601 bp, Human; identical to SEQ ID NO: 90426

SEQ ID NO: 90779 - DNA, 601 bp, Human; identical to SEQ ID NO: 90427

SEQ ID NO: 90780 - DNA, 601 bp, Human; identical to SEQ ID NO: 90428

SEQ ID NO: 90781 - DNA, 601 bp, Human; identical to SEQ ID NO: 90429

SEQ ID NO: 90782 - DNA, 601 bp, Human; identical to SEQ ID NO: 90430

SEQ ID NO: 90783 - DNA, 601 bp, Human; identical to SEQ ID NO: 90431

SEQ ID NO: 90784 - DNA, 601 bp, Human; identical to SEQ ID NO: 90432

SEQ ID NO: 90785 - DNA, 601 bp, Human; identical to SEQ ID NO: 90433

SEQ ID NO: 90786 - DNA, 601 bp, Human; identical to SEQ ID NO: 90434

SEQ ID NO: 90787 - DNA, 601 bp, Human; identical to SEQ ID NO: 90435

SEQ ID NO: 90788 - DNA, 601 bp, Human; identical to SEQ ID NO: 90436

SEQ ID NO: 90789 - DNA, 601 bp, Human; identical to SEQ ID NO: 90437

SEQ ID NO: 90790 - DNA, 601 bp, Human; identical to SEQ ID NO: 90438

SEQ ID NO: 90791 - DNA, 601 bp, Human; identical to SEQ ID NO: 90439

SEQ ID NO: 90792 - DNA, 601 bp, Human; identical to SEQ ID NO: 90440

SEQ ID NO: 90793 - DNA, 601 bp, Human; identical to SEQ ID NO: 90441

SEQ ID NO: 90794 - DNA, 601 bp, Human; identical to SEQ ID NO: 90442

SEQ ID NO: 90795 - DNA, 601 bp, Human; identical to SEQ ID NO: 90443

SEQ ID NO: 90796 - DNA, 601 bp, Human; identical to SEQ ID NO: 90444

SEQ ID NO: 90797 - DNA, 601 bp, Human; identical to SEQ ID NO: 90445

SEQ ID NO: 90798 - DNA, 601 bp, Human; identical to SEQ ID NO: 90446

SEQ ID NO: 90799 - DNA, 601 bp, Human; identical to SEQ ID NO: 90447

SEQ ID NO: 90800 - DNA, 601 bp, Human; identical to SEQ ID NO: 90448

SEQ ID NO: 90801 - DNA, 601 bp, Human; identical to SEQ ID NO: 90449

SEQ ID NO: 90802 - DNA, 601 bp, Human; identical to SEQ ID NO: 90450

SEQ ID NO: 90803 - DNA, 601 bp, Human; identical to SEQ ID NO: 90451

SEQ ID NO: 90804 - DNA, 601 bp, Human; identical to SEQ ID NO: 90452

SEQ ID NO: 90805 - DNA, 601 bp, Human; identical to SEQ ID NO: 90453

SEQ ID NO: 90806 - DNA, 601 bp, Human; identical to SEQ ID NO: 90454

SEQ ID NO: 90807 - DNA, 601 bp, Human; identical to SEQ ID NO: 90455

SEQ ID NO: 90808 - DNA, 601 bp, Human; identical to SEQ ID NO: 90456

SEQ ID NO: 90809 - DNA, 601 bp, Human; identical to SEQ ID NO: 90457

SEQ ID NO: 90810 - DNA, 601 bp, Human; identical to SEQ ID NO: 90458

SEQ ID NO: 90811 - DNA, 601 bp, Human; identical to SEQ ID NO: 90459

SEQ ID NO: 90812 - DNA, 601 bp, Human; identical to SEQ ID NO: 90460

SEQ ID NO: 90813 - DNA, 601 bp, Human; identical to SEQ ID NO: 90461

SEQ ID NO: 90814 - DNA, 601 bp, Human; identical to SEQ ID NO: 90462

SEQ ID NO: 90815 - DNA, 601 bp, Human; identical to SEQ ID NO: 90463

SEQ ID NO: 90816 - DNA, 601 bp, Human; identical to SEQ ID NO: 90464

SEQ ID NO: 90817 - DNA, 601 bp, Human; identical to SEQ ID NO: 90465

SEQ ID NO: 90818 - DNA, 601 bp, Human; identical to SEQ ID NO: 90466

SEQ ID NO: 90819 - DNA, 601 bp, Human; identical to SEQ ID NO: 90467

SEQ ID NO: 90820 - DNA, 601 bp, Human; identical to SEQ ID NO: 90468

SEQ ID NO: 90821 - DNA, 601 bp, Human; identical to SEQ ID NO: 90469

SEQ ID NO: 90822 - DNA, 601 bp, Human; identical to SEQ ID NO: 90470

SEQ ID NO: 90823 - DNA, 601 bp, Human; identical to SEQ ID NO: 90471

SEQ ID NO: 90824 - DNA, 601 bp, Human; identical to SEQ ID NO: 90472

SEQ ID NO: 90825 - DNA, 601 bp, Human; identical to SEQ ID NO: 90473

SEQ ID NO: 90826 - DNA, 601 bp, Human; identical to SEQ ID NO: 90474

SEQ ID NO: 90827 - DNA, 601 bp, Human; identical to SEQ ID NO: 90475

SEQ ID NO: 90828 - DNA, 601 bp, Human; identical to SEQ ID NO: 90476

SEQ ID NO: 90829 - DNA, 601 bp, Human; identical to SEQ ID NO: 90477

SEQ ID NO: 90830 - DNA, 601 bp, Human; identical to SEQ ID NO: 90390

SEQ ID NO: 90831 - DNA, 601 bp, Human; identical to SEQ ID NO: 90391

SEQ ID NO: 90832 - DNA, 601 bp, Human; identical to SEQ ID NO: 90392

SEQ ID NO: 90833 - DNA, 601 bp, Human; identical to SEQ ID NO: 90393

SEQ ID NO: 90834 - DNA, 601 bp, Human; identical to SEQ ID NO: 90394

SEQ ID NO: 90835 - DNA, 601 bp, Human; identical to SEQ ID NO: 90395

SEQ ID NO: 90836 - DNA, 601 bp, Human; identical to SEQ ID NO: 90396

SEQ ID NO: 90837 - DNA, 601 bp, Human; identical to SEQ ID NO: 90397

SEQ ID NO: 90838 - DNA, 601 bp, Human; identical to SEQ ID NO: 90398

SEQ ID NO: 90839 - DNA, 601 bp, Human; identical to SEQ ID NO: 90399

SEQ ID NO: 90840 - DNA, 601 bp, Human; identical to SEQ ID NO: 90400

SEQ ID NO: 90841 - DNA, 601 bp, Human; identical to SEQ ID NO: 90401

SEQ ID NO: 90842 - DNA, 601 bp, Human; identical to SEQ ID NO: 90402

SEQ ID NO: 90843 - DNA, 601 bp, Human; identical to SEQ ID NO: 90403

SEQ ID NO: 90844 - DNA, 601 bp, Human; identical to SEQ ID NO: 90404

SEQ ID NO: 90845 - DNA, 601 bp, Human; identical to SEQ ID NO: 90405

SEQ ID NO: 90846 - DNA, 601 bp, Human; identical to SEQ ID NO: 90406

SEQ ID NO: 90847 - DNA, 601 bp, Human; identical to SEQ ID NO: 90407

SEQ ID NO: 90848 - DNA, 601 bp, Human; identical to SEQ ID NO: 90408

SEQ ID NO: 90849 - DNA, 601 bp, Human; identical to SEQ ID NO: 90409

SEQ ID NO: 90850 - DNA, 601 bp, Human; identical to SEQ ID NO: 90410

SEQ ID NO: 90851 - DNA, 601 bp, Human; identical to SEQ ID NO: 90411

SEQ ID NO: 90852 - DNA, 601 bp, Human; identical to SEQ ID NO: 90412

SEQ ID NO: 90853 - DNA, 601 bp, Human; identical to SEQ ID NO: 90413

SEQ ID NO: 90854 - DNA, 601 bp, Human; identical to SEQ ID NO: 90414

SEQ ID NO: 90855 - DNA, 601 bp, Human; identical to SEQ ID NO: 90415

SEQ ID NO: 90856 - DNA, 601 bp, Human; identical to SEQ ID NO: 90416

SEQ ID NO: 90857 - DNA, 601 bp, Human; identical to SEQ ID NO: 90417

SEQ ID NO: 90858 - DNA, 601 bp, Human; identical to SEQ ID NO: 90418

SEQ ID NO: 90859 - DNA, 601 bp, Human; identical to SEQ ID NO: 90419

SEQ ID NO: 90860 - DNA, 601 bp, Human; identical to SEQ ID NO: 90420

SEQ ID NO: 90861 - DNA, 601 bp, Human; identical to SEQ ID NO: 90421

SEQ ID NO: 90862 - DNA, 601 bp, Human; identical to SEQ ID NO: 90422

SEQ ID NO: 90863 - DNA, 601 bp, Human; identical to SEQ ID NO: 90423

SEQ ID NO: 90864 - DNA, 601 bp, Human; identical to SEQ ID NO: 90424

SEQ ID NO: 90865 - DNA, 601 bp, Human; identical to SEQ ID NO: 90425

SEQ ID NO: 90866 - DNA, 601 bp, Human; identical to SEQ ID NO: 90426

SEQ ID NO: 90867 - DNA, 601 bp, Human; identical to SEQ ID NO: 90427

SEQ ID NO: 90868 - DNA, 601 bp, Human; identical to SEQ ID NO: 90428

SEQ ID NO: 90869 - DNA, 601 bp, Human; identical to SEQ ID NO: 90429

SEQ ID NO: 90870 - DNA, 601 bp, Human; identical to SEQ ID NO: 90430

SEQ ID NO: 90871 - DNA, 601 bp, Human; identical to SEQ ID NO: 90431

SEQ ID NO: 90872 - DNA, 601 bp, Human; identical to SEQ ID NO: 90432

SEQ ID NO: 90873 - DNA, 601 bp, Human; identical to SEQ ID NO: 90433

SEQ ID NO: 90874 - DNA, 601 bp, Human; identical to SEQ ID NO: 90434

SEQ ID NO: 90875 - DNA, 601 bp, Human; identical to SEQ ID NO: 90435

SEQ ID NO: 90876 - DNA, 601 bp, Human; identical to SEQ ID NO: 90436

SEQ ID NO: 90877 - DNA, 601 bp, Human; identical to SEQ ID NO: 90437

SEQ ID NO: 90878 - DNA, 601 bp, Human; identical to SEQ ID NO: 90438

SEQ ID NO: 90879 - DNA, 601 bp, Human; identical to SEQ ID NO: 90439

SEQ ID NO: 90880 - DNA, 601 bp, Human; identical to SEQ ID NO: 90440

SEQ ID NO: 90881 - DNA, 601 bp, Human; identical to SEQ ID NO: 90441

SEQ ID NO: 90882 - DNA, 601 bp, Human; identical to SEQ ID NO: 90442

SEQ ID NO: 90883 - DNA, 601 bp, Human; identical to SEQ ID NO: 90443

SEQ ID NO: 90884 - DNA, 601 bp, Human; identical to SEQ ID NO: 90444

SEQ ID NO: 90885 - DNA, 601 bp, Human; identical to SEQ ID NO: 90445

SEQ ID NO: 90886 - DNA, 601 bp, Human; identical to SEQ ID NO: 90446

SEQ ID NO: 90887 - DNA, 601 bp, Human; identical to SEQ ID NO: 90447

SEQ ID NO: 90888 - DNA, 601 bp, Human; identical to SEQ ID NO: 90448

SEQ ID NO: 90889 - DNA, 601 bp, Human; identical to SEQ ID NO: 90449

SEQ ID NO: 90890 - DNA, 601 bp, Human; identical to SEQ ID NO: 90450

SEQ ID NO: 90891 - DNA, 601 bp, Human; identical to SEQ ID NO: 90451

SEQ ID NO: 90892 - DNA, 601 bp, Human; identical to SEQ ID NO: 90452

SEQ ID NO: 90893 - DNA, 601 bp, Human; identical to SEQ ID NO: 90453

SEQ ID NO: 90894 - DNA, 601 bp, Human; identical to SEQ ID NO: 90454

SEQ ID NO: 90895 - DNA, 601 bp, Human; identical to SEQ ID NO: 90455

SEQ ID NO: 90896 - DNA, 601 bp, Human; identical to SEQ ID NO: 90456

SEQ ID NO: 90897 - DNA, 601 bp, Human; identical to SEQ ID NO: 90457

SEQ ID NO: 90898 - DNA, 601 bp, Human; identical to SEQ ID NO: 90458

SEQ ID NO: 90899 - DNA, 601 bp, Human; identical to SEQ ID NO: 90459

SEQ ID NO: 90900 - DNA, 601 bp, Human; identical to SEQ ID NO: 90460

SEQ ID NO: 90901 - DNA, 601 bp, Human; identical to SEQ ID NO: 90461

SEQ ID NO: 90902 - DNA, 601 bp, Human; identical to SEQ ID NO: 90462

SEQ ID NO: 90903 - DNA, 601 bp, Human; identical to SEQ ID NO: 90463

SEQ ID NO: 90904 - DNA, 601 bp, Human; identical to SEQ ID NO: 90464

SEQ ID NO: 90905 - DNA, 601 bp, Human; identical to SEQ ID NO: 90465

SEQ ID NO: 90906 - DNA, 601 bp, Human; identical to SEQ ID NO: 90466

SEQ ID NO: 90907 - DNA, 601 bp, Human; identical to SEQ ID NO: 90467

SEQ ID NO: 90908 - DNA, 601 bp, Human; identical to SEQ ID NO: 90468

SEQ ID NO: 90909 - DNA, 601 bp, Human; identical to SEQ ID NO: 90469

SEQ ID NO: 90910 - DNA, 601 bp, Human; identical to SEQ ID NO: 90470

SEQ ID NO: 90911 - DNA, 601 bp, Human; identical to SEQ ID NO: 90471

SEQ ID NO: 90912 - DNA, 601 bp, Human; identical to SEQ ID NO: 90472

SEQ ID NO: 90913 - DNA, 601 bp, Human; identical to SEQ ID NO: 90473

SEQ ID NO: 90914 - DNA, 601 bp, Human; identical to SEQ ID NO: 90474

SEQ ID NO: 90915 - DNA, 601 bp, Human; identical to SEQ ID NO: 90475

SEQ ID NO: 90916 - DNA, 601 bp, Human; identical to SEQ ID NO: 90476

SEQ ID NO: 90917 - DNA, 601 bp, Human; identical to SEQ ID NO: 90477

SEQ ID NO: 90918 - DNA, 601 bp, Human; identical to SEQ ID NO: 90390

SEQ ID NO: 90919 - DNA, 601 bp, Human; identical to SEQ ID NO: 90391

SEQ ID NO: 90920 - DNA, 601 bp, Human; identical to SEQ ID NO: 90392

SEQ ID NO: 90921 - DNA, 601 bp, Human; identical to SEQ ID NO: 90393

SEQ ID NO: 90922 - DNA, 601 bp, Human; identical to SEQ ID NO: 90394

SEQ ID NO: 90923 - DNA, 601 bp, Human; identical to SEQ ID NO: 90395

SEQ ID NO: 90924 - DNA, 601 bp, Human; identical to SEQ ID NO: 90396

SEQ ID NO: 90925 - DNA, 601 bp, Human; identical to SEQ ID NO: 90397

SEQ ID NO: 90926 - DNA, 601 bp, Human; identical to SEQ ID NO: 90398

SEQ ID NO: 90927 - DNA, 601 bp, Human; identical to SEQ ID NO: 90399

SEQ ID NO: 90928 - DNA, 601 bp, Human; identical to SEQ ID NO: 90400

SEQ ID NO: 90929 - DNA, 601 bp, Human; identical to SEQ ID NO: 90401

SEQ ID NO: 90930 - DNA, 601 bp, Human; identical to SEQ ID NO: 90402

SEQ ID NO: 90931 - DNA, 601 bp, Human; identical to SEQ ID NO: 90403

SEQ ID NO: 90932 - DNA, 601 bp, Human; identical to SEQ ID NO: 90404

SEQ ID NO: 90933 - DNA, 601 bp, Human; identical to SEQ ID NO: 90405

SEQ ID NO: 90934 - DNA, 601 bp, Human; identical to SEQ ID NO: 90406

SEQ ID NO: 90935 - DNA, 601 bp, Human; identical to SEQ ID NO: 90407

SEQ ID NO: 90936 - DNA, 601 bp, Human; identical to SEQ ID NO: 90408

SEQ ID NO: 90937 - DNA, 601 bp, Human; identical to SEQ ID NO: 90409

SEQ ID NO: 90938 - DNA, 601 bp, Human; identical to SEQ ID NO: 90410

SEQ ID NO: 90939 - DNA, 601 bp, Human; identical to SEQ ID NO: 90411

SEQ ID NO: 90940 - DNA, 601 bp, Human; identical to SEQ ID NO: 90412

SEQ ID NO: 90941 - DNA, 601 bp, Human; identical to SEQ ID NO: 90413

SEQ ID NO: 90942 - DNA, 601 bp, Human; identical to SEQ ID NO: 90414

SEQ ID NO: 90943 - DNA, 601 bp, Human; identical to SEQ ID NO: 90415

SEQ ID NO: 90944 - DNA, 601 bp, Human; identical to SEQ ID NO: 90416

SEQ ID NO: 90945 - DNA, 601 bp, Human; identical to SEQ ID NO: 90417

SEQ ID NO: 90946 - DNA, 601 bp, Human; identical to SEQ ID NO: 90418

SEQ ID NO: 90947 - DNA, 601 bp, Human; identical to SEQ ID NO: 90419

SEQ ID NO: 90948 - DNA, 601 bp, Human; identical to SEQ ID NO: 90420

SEQ ID NO: 90949 - DNA, 601 bp, Human; identical to SEQ ID NO: 90421

SEQ ID NO: 90950 - DNA, 601 bp, Human; identical to SEQ ID NO: 90422

SEQ ID NO: 90951 - DNA, 601 bp, Human; identical to SEQ ID NO: 90423

SEQ ID NO: 90952 - DNA, 601 bp, Human; identical to SEQ ID NO: 90424

SEQ ID NO: 90953 - DNA, 601 bp, Human; identical to SEQ ID NO: 90425

SEQ ID NO: 90954 - DNA, 601 bp, Human; identical to SEQ ID NO: 90426

SEQ ID NO: 90955 - DNA, 601 bp, Human; identical to SEQ ID NO: 90427

SEQ ID NO: 90956 - DNA, 601 bp, Human; identical to SEQ ID NO: 90428

SEQ ID NO: 90957 - DNA, 601 bp, Human; identical to SEQ ID NO: 90429

SEQ ID NO: 90958 - DNA, 601 bp, Human; identical to SEQ ID NO: 90430

SEQ ID NO: 90959 - DNA, 601 bp, Human; identical to SEQ ID NO: 90431

SEQ ID NO: 90960 - DNA, 601 bp, Human; identical to SEQ ID NO: 90432

SEQ ID NO: 90961 - DNA, 601 bp, Human; identical to SEQ ID NO: 90433

SEQ ID NO: 90962 - DNA, 601 bp, Human; identical to SEQ ID NO: 90434

SEQ ID NO: 90963 - DNA, 601 bp, Human; identical to SEQ ID NO: 90435

SEQ ID NO: 90964 - DNA, 601 bp, Human; identical to SEQ ID NO: 90436

SEQ ID NO: 90965 - DNA, 601 bp, Human; identical to SEQ ID NO: 90437

SEQ ID NO: 90966 - DNA, 601 bp, Human; identical to SEQ ID NO: 90438

SEQ ID NO: 90967 - DNA, 601 bp, Human; identical to SEQ ID NO: 90439

SEQ ID NO: 90968 - DNA, 601 bp, Human; identical to SEQ ID NO: 90440

SEQ ID NO: 90969 - DNA, 601 bp, Human; identical to SEQ ID NO: 90441

SEQ ID NO: 90970 - DNA, 601 bp, Human; identical to SEQ ID NO: 90442

SEQ ID NO: 90971 - DNA, 601 bp, Human; identical to SEQ ID NO: 90443

SEQ ID NO: 90972 - DNA, 601 bp, Human; identical to SEQ ID NO: 90444

SEQ ID NO: 90973 - DNA, 601 bp, Human; identical to SEQ ID NO: 90445

SEQ ID NO: 90974 - DNA, 601 bp, Human; identical to SEQ ID NO: 90446

SEQ ID NO: 90975 - DNA, 601 bp, Human; identical to SEQ ID NO: 90447

SEQ ID NO: 90976 - DNA, 601 bp, Human; identical to SEQ ID NO: 90448

SEQ ID NO: 90977 - DNA, 601 bp, Human; identical to SEQ ID NO: 90449

SEQ ID NO: 90978 - DNA, 601 bp, Human; identical to SEQ ID NO: 90450

SEQ ID NO: 90979 - DNA, 601 bp, Human; identical to SEQ ID NO: 90451

SEQ ID NO: 90980 - DNA, 601 bp, Human; identical to SEQ ID NO: 90452

SEQ ID NO: 90981 - DNA, 601 bp, Human; identical to SEQ ID NO: 90453

SEQ ID NO: 90982 - DNA, 601 bp, Human; identical to SEQ ID NO: 90454

SEQ ID NO: 90983 - DNA, 601 bp, Human; identical to SEQ ID NO: 90455

SEQ ID NO: 90984 - DNA, 601 bp, Human; identical to SEQ ID NO: 90456

SEQ ID NO: 90985 - DNA, 601 bp, Human; identical to SEQ ID NO: 90457

SEQ ID NO: 90986 - DNA, 601 bp, Human; identical to SEQ ID NO: 90458

SEQ ID NO: 90987 - DNA, 601 bp, Human; identical to SEQ ID NO: 90459

SEQ ID NO: 90988 - DNA, 601 bp, Human; identical to SEQ ID NO: 90460

SEQ ID NO: 90989 - DNA, 601 bp, Human; identical to SEQ ID NO: 90461

SEQ ID NO: 90990 - DNA, 601 bp, Human; identical to SEQ ID NO: 90462

SEQ ID NO: 90991 - DNA, 601 bp, Human; identical to SEQ ID NO: 90463

SEQ ID NO: 90992 - DNA, 601 bp, Human; identical to SEQ ID NO: 90464

SEQ ID NO: 90993 - DNA, 601 bp, Human; identical to SEQ ID NO: 90465

SEQ ID NO: 90994 - DNA, 601 bp, Human; identical to SEQ ID NO: 90466

SEQ ID NO: 90995 - DNA, 601 bp, Human; identical to SEQ ID NO: 90467

SEQ ID NO: 90996 - DNA, 601 bp, Human; identical to SEQ ID NO: 90468

SEQ ID NO: 90997 - DNA, 601 bp, Human; identical to SEQ ID NO: 90469

SEQ ID NO: 90998 - DNA, 601 bp, Human; identical to SEQ ID NO: 90470

SEQ ID NO: 90999 - DNA, 601 bp, Human; identical to SEQ ID NO: 90471

SEQ ID NO: 91000 - DNA, 601 bp, Human; identical to SEQ ID NO: 90472

SEQ ID NO: 91001 - DNA, 601 bp, Human; identical to SEQ ID NO: 90473

SEQ ID NO: 91002 - DNA, 601 bp, Human; identical to SEQ ID NO: 90474

SEQ ID NO: 91003 - DNA, 601 bp, Human; identical to SEQ ID NO: 90475

SEQ ID NO: 91004 - DNA, 601 bp, Human; identical to SEQ ID NO: 90476

SEQ ID NO: 91005 - DNA, 601 bp, Human; identical to SEQ ID NO: 90477

SEQ ID NO: 91006 - DNA, 601 bp, Human; identical to SEQ ID NO: 90390

SEQ ID NO: 91007 - DNA, 601 bp, Human; identical to SEQ ID NO: 90391

SEQ ID NO: 91008 - DNA, 601 bp, Human; identical to SEQ ID NO: 90392

SEQ ID NO: 91009 - DNA, 601 bp, Human; identical to SEQ ID NO: 90393

SEQ ID NO: 91010 - DNA, 601 bp, Human; identical to SEQ ID NO: 90394

SEQ ID NO: 91011 - DNA, 601 bp, Human; identical to SEQ ID NO: 90395

SEQ ID NO: 91012 - DNA, 601 bp, Human; identical to SEQ ID NO: 90396

SEQ ID NO: 91013 - DNA, 601 bp, Human; identical to SEQ ID NO: 90397

SEQ ID NO: 91014 - DNA, 601 bp, Human; identical to SEQ ID NO: 90398

SEQ ID NO: 91015 - DNA, 601 bp, Human; identical to SEQ ID NO: 90399

SEQ ID NO: 91016 - DNA, 601 bp, Human; identical to SEQ ID NO: 90400

SEQ ID NO: 91017 - DNA, 601 bp, Human; identical to SEQ ID NO: 90401

SEQ ID NO: 91018 - DNA, 601 bp, Human; identical to SEQ ID NO: 90402

SEQ ID NO: 91019 - DNA, 601 bp, Human; identical to SEQ ID NO: 90403

SEQ ID NO: 91020 - DNA, 601 bp, Human; identical to SEQ ID NO: 90404

SEQ ID NO: 91021 - DNA, 601 bp, Human; identical to SEQ ID NO: 90405

SEQ ID NO: 91022 - DNA, 601 bp, Human; identical to SEQ ID NO: 90406

SEQ ID NO: 91023 - DNA, 601 bp, Human; identical to SEQ ID NO: 90407

SEQ ID NO: 91024 - DNA, 601 bp, Human; identical to SEQ ID NO: 90408

SEQ ID NO: 91025 - DNA, 601 bp, Human; identical to SEQ ID NO: 90409

SEQ ID NO: 91026 - DNA, 601 bp, Human; identical to SEQ ID NO: 90410

SEQ ID NO: 91027 - DNA, 601 bp, Human; identical to SEQ ID NO: 90411

SEQ ID NO: 91028 - DNA, 601 bp, Human; identical to SEQ ID NO: 90412

SEQ ID NO: 91029 - DNA, 601 bp, Human; identical to SEQ ID NO: 90413

SEQ ID NO: 91030 - DNA, 601 bp, Human; identical to SEQ ID NO: 90414

SEQ ID NO: 91031 - DNA, 601 bp, Human; identical to SEQ ID NO: 90415

SEQ ID NO: 91032 - DNA, 601 bp, Human; identical to SEQ ID NO: 90416

SEQ ID NO: 91033 - DNA, 601 bp, Human; identical to SEQ ID NO: 90417

SEQ ID NO: 91034 - DNA, 601 bp, Human; identical to SEQ ID NO: 90418

SEQ ID NO: 91035 - DNA, 601 bp, Human; identical to SEQ ID NO: 90419

SEQ ID NO: 91036 - DNA, 601 bp, Human; identical to SEQ ID NO: 90420

SEQ ID NO: 91037 - DNA, 601 bp, Human; identical to SEQ ID NO: 90421

SEQ ID NO: 91038 - DNA, 601 bp, Human; identical to SEQ ID NO: 90422

SEQ ID NO: 91039 - DNA, 601 bp, Human; identical to SEQ ID NO: 90423

SEQ ID NO: 91040 - DNA, 601 bp, Human; identical to SEQ ID NO: 90424

SEQ ID NO: 91041 - DNA, 601 bp, Human; identical to SEQ ID NO: 90425

SEQ ID NO: 91042 - DNA, 601 bp, Human; identical to SEQ ID NO: 90426

SEQ ID NO: 91043 - DNA, 601 bp, Human; identical to SEQ ID NO: 90427

SEQ ID NO: 91044 - DNA, 601 bp, Human; identical to SEQ ID NO: 90428

SEQ ID NO: 91045 - DNA, 601 bp, Human; identical to SEQ ID NO: 90429

SEQ ID NO: 91046 - DNA, 601 bp, Human; identical to SEQ ID NO: 90430

SEQ ID NO: 91047 - DNA, 601 bp, Human; identical to SEQ ID NO: 90431

SEQ ID NO: 91048 - DNA, 601 bp, Human; identical to SEQ ID NO: 90432

SEQ ID NO: 91049 - DNA, 601 bp, Human; identical to SEQ ID NO: 90433

SEQ ID NO: 91050 - DNA, 601 bp, Human; identical to SEQ ID NO: 90434

SEQ ID NO: 91051 - DNA, 601 bp, Human; identical to SEQ ID NO: 90435

SEQ ID NO: 91052 - DNA, 601 bp, Human; identical to SEQ ID NO: 90436

SEQ ID NO: 91053 - DNA, 601 bp, Human; identical to SEQ ID NO: 90437

SEQ ID NO: 91054 - DNA, 601 bp, Human; identical to SEQ ID NO: 90438

SEQ ID NO: 91055 - DNA, 601 bp, Human; identical to SEQ ID NO: 90439

SEQ ID NO: 91056 - DNA, 601 bp, Human; identical to SEQ ID NO: 90440

SEQ ID NO: 91057 - DNA, 601 bp, Human; identical to SEQ ID NO: 90441

SEQ ID NO: 91058 - DNA, 601 bp, Human; identical to SEQ ID NO: 90442

SEQ ID NO: 91059 - DNA, 601 bp, Human; identical to SEQ ID NO: 90443

SEQ ID NO: 91060 - DNA, 601 bp, Human; identical to SEQ ID NO: 90444

SEQ ID NO: 91061 - DNA, 601 bp, Human; identical to SEQ ID NO: 90445

SEQ ID NO: 91062 - DNA, 601 bp, Human; identical to SEQ ID NO: 90446

SEQ ID NO: 91063 - DNA, 601 bp, Human; identical to SEQ ID NO: 90447

SEQ ID NO: 91064 - DNA, 601 bp, Human; identical to SEQ ID NO: 90448

SEQ ID NO: 91065 - DNA, 601 bp, Human; identical to SEQ ID NO: 90449

SEQ ID NO: 91066 - DNA, 601 bp, Human; identical to SEQ ID NO: 90450

SEQ ID NO: 91067 - DNA, 601 bp, Human; identical to SEQ ID NO: 90451

SEQ ID NO: 91068 - DNA, 601 bp, Human; identical to SEQ ID NO: 90452

SEQ ID NO: 91069 - DNA, 601 bp, Human; identical to SEQ ID NO: 90453

SEQ ID NO: 91070 - DNA, 601 bp, Human; identical to SEQ ID NO: 90454

SEQ ID NO: 91071 - DNA, 601 bp, Human; identical to SEQ ID NO: 90455

SEQ ID NO: 91072 - DNA, 601 bp, Human; identical to SEQ ID NO: 90456

SEQ ID NO: 91073 - DNA, 601 bp, Human; identical to SEQ ID NO: 90457

SEQ ID NO: 91074 - DNA, 601 bp, Human; identical to SEQ ID NO: 90458

SEQ ID NO: 91075 - DNA, 601 bp, Human; identical to SEQ ID NO: 90459

SEQ ID NO: 91076 - DNA, 601 bp, Human; identical to SEQ ID NO: 90460

SEQ ID NO: 91077 - DNA, 601 bp, Human; identical to SEQ ID NO: 90461

SEQ ID NO: 91078 - DNA, 601 bp, Human; identical to SEQ ID NO: 90462

SEQ ID NO: 91079 - DNA, 601 bp, Human; identical to SEQ ID NO: 90463

SEQ ID NO: 91080 - DNA, 601 bp, Human; identical to SEQ ID NO: 90464

SEQ ID NO: 91081 - DNA, 601 bp, Human; identical to SEQ ID NO: 90465

SEQ ID NO: 91082 - DNA, 601 bp, Human; identical to SEQ ID NO: 90466

SEQ ID NO: 91083 - DNA, 601 bp, Human; identical to SEQ ID NO: 90467

SEQ ID NO: 91084 - DNA, 601 bp, Human; identical to SEQ ID NO: 90468

SEQ ID NO: 91085 - DNA, 601 bp, Human; identical to SEQ ID NO: 90469

SEQ ID NO: 91086 - DNA, 601 bp, Human; identical to SEQ ID NO: 90470

SEQ ID NO: 91087 - DNA, 601 bp, Human; identical to SEQ ID NO: 90471

SEQ ID NO: 91088 - DNA, 601 bp, Human; identical to SEQ ID NO: 90472

SEQ ID NO: 91089 - DNA, 601 bp, Human; identical to SEQ ID NO: 90473

SEQ ID NO: 91090 - DNA, 601 bp, Human; identical to SEQ ID NO: 90474

SEQ ID NO: 91091 - DNA, 601 bp, Human; identical to SEQ ID NO: 90475

SEQ ID NO: 91092 - DNA, 601 bp, Human; identical to SEQ ID NO: 90476

SEQ ID NO: 91093 - DNA, 601 bp, Human; identical to SEQ ID NO: 90477

SEQ ID NO: 91094 - DNA, 601 bp, Human; identical to SEQ ID NO: 90459

SEQ ID NO: 91095 - DNA, 601 bp, Human; identical to SEQ ID NO: 90460

SEQ ID NO: 91096 - DNA, 601 bp, Human; identical to SEQ ID NO: 90461

SEQ ID NO: 91097 - DNA, 601 bp, Human; identical to SEQ ID NO: 90462

SEQ ID NO: 91098 - DNA, 601 bp, Human; identical to SEQ ID NO: 90463

SEQ ID NO: 91099 - DNA, 601 bp, Human; identical to SEQ ID NO: 90464

SEQ ID NO: 91100 - DNA, 601 bp, Human; identical to SEQ ID NO: 90465

SEQ ID NO: 91101 - DNA, 601 bp, Human; identical to SEQ ID NO: 90466

SEQ ID NO: 91102 - DNA, 601 bp, Human; identical to SEQ ID NO: 90467

SEQ ID NO: 91103 - DNA, 601 bp, Human; identical to SEQ ID NO: 90468

SEQ ID NO: 91104 - DNA, 601 bp, Human; identical to SEQ ID NO: 90469

SEQ ID NO: 91105 - DNA, 601 bp, Human; identical to SEQ ID NO: 90470

SEQ ID NO: 91106 - DNA, 601 bp, Human; identical to SEQ ID NO: 90471

SEQ ID NO: 91107 - DNA, 601 bp, Human; identical to SEQ ID NO: 90472

SEQ ID NO: 91108 - DNA, 601 bp, Human; identical to SEQ ID NO: 90473

SEQ ID NO: 91109 - DNA, 601 bp, Human; identical to SEQ ID NO: 90474

SEQ ID NO: 91110 - DNA, 601 bp, Human; identical to SEQ ID NO: 90475

SEQ ID NO: 91111 - DNA, 601 bp, Human; identical to SEQ ID NO: 90476

SEQ ID NO: 91112 - DNA, 601 bp, Human; identical to SEQ ID NO: 90477

SEQ ID NO: 91113 - DNA, 601 bp, Human; identical to SEQ ID NO: 90464

SEQ ID NO: 91114 - DNA, 601 bp, Human; identical to SEQ ID NO: 90465

SEQ ID NO: 91115 - DNA, 601 bp, Human; identical to SEQ ID NO: 90466

SEQ ID NO: 91116 - DNA, 601 bp, Human; identical to SEQ ID NO: 90467

SEQ ID NO: 91117 - DNA, 601 bp, Human; identical to SEQ ID NO: 90468

SEQ ID NO: 91118 - DNA, 601 bp, Human; identical to SEQ ID NO: 90469

SEQ ID NO: 91119 - DNA, 601 bp, Human; identical to SEQ ID NO: 90470

SEQ ID NO: 91120 - DNA, 601 bp, Human; identical to SEQ ID NO: 90471

SEQ ID NO: 91121 - DNA, 601 bp, Human; identical to SEQ ID NO: 90472

SEQ ID NO: 91122 - DNA, 601 bp, Human; identical to SEQ ID NO: 90473

SEQ ID NO: 91123 - DNA, 601 bp, Human; identical to SEQ ID NO: 90474

SEQ ID NO: 91124 - DNA, 601 bp, Human; identical to SEQ ID NO: 90475

SEQ ID NO: 91125 - DNA, 601 bp, Human; identical to SEQ ID NO: 90476

SEQ ID NO: 91126 - DNA, 601 bp, Human; identical to SEQ ID NO: 90477

SEQ ID NO: 91127 - DNA, 601 bp, Human; identical to SEQ ID NO: 90464

SEQ ID NO: 91128 - DNA, 601 bp, Human; identical to SEQ ID NO: 90465

SEQ ID NO: 91129 - DNA, 601 bp, Human; identical to SEQ ID NO: 90466

SEQ ID NO: 91130 - DNA, 601 bp, Human; identical to SEQ ID NO: 90467

SEQ ID NO: 91131 - DNA, 601 bp, Human; identical to SEQ ID NO: 90468

SEQ ID NO: 91132 - DNA, 601 bp, Human; identical to SEQ ID NO: 90469

SEQ ID NO: 91133 - DNA, 601 bp, Human; identical to SEQ ID NO: 90470

SEQ ID NO: 91134 - DNA, 601 bp, Human; identical to SEQ ID NO: 90471

SEQ ID NO: 91135 - DNA, 601 bp, Human; identical to SEQ ID NO: 90472

SEQ ID NO: 91136 - DNA, 601 bp, Human; identical to SEQ ID NO: 90473

SEQ ID NO: 91137 - DNA, 601 bp, Human; identical to SEQ ID NO: 90474

SEQ ID NO: 91138 - DNA, 601 bp, Human; identical to SEQ ID NO: 90475

SEQ ID NO: 91139 - DNA, 601 bp, Human; identical to SEQ ID NO: 90476

SEQ ID NO: 91140 - DNA, 601 bp, Human; identical to SEQ ID NO: 90477

SEQ ID NO: 91141 - DNA, 601 bp, Human
cagggaagctattttggaacagaaaacttgaagagtctggtcttgcacttcctgcaacagtaagtatcccagggtcccccctccccaccccgaggttgagggggaatggtgggcagacccaggcacacatcaatctttttgttttgttttttgttttgtttttttttttttttttggacagtgtctcactgtgtcacccaggctggagtgcaatggtgtgatcttggctcactgcaacctctgcctcccagggttcaagtgattctcctgcctcagcctccccagtagctgggactacagrtgtgtgccactgcacctggctaatttttgtatttttcgtacagatgggatttcactatgttggccaggctggtctccaactcctgacctcatgatccacctgcctcttcctcccaaagtgttgggattagaggcgtgagccaccgcacctagccattttttttgtatttttagtagagacagggtttcgccatgttgcccaggctggtcttgaactcctgggctcaagctattcacccatctcagcctcccaaagtgctgggattacaggcatgagcttccatgcccggccacaactcac

SEQ ID NO: 91142 - DNA, 601 bp, Human
gcacacagcaccagaggctgccatcaagatgaggttgagggccagagggcacagccacatggctctgggtccagtcgctgctcctgcaggagggatggccgtgagcccatctgccacctctgccaacatctcccccactgtgctctgtcaggactcaggaagctgggcagagcccgagaggcagggcgggcgagaccagagtgctgggaagacccgaagctcccgggaaaattcccagcatcacctggcacctggcatggcctcatgcttcaggcctccggctggaggttgtggggtctcmaggctgctgaggaggaggaagagtaaggagctctggggagcccggggacctgggctccagtgcagtctcctttctttcagtgcctcactatgttaccctgggaaactggcttcacctctctgacttcagctgaatcttccgtgctctgcagaaaacctgccctgtccctcccaggctattagtcaggtcactcactcactgactcacaccatctgtcctcatccctgctgtgttactttcttttcaggctccaagaaatcagcgacctgagaatgaaaaaagatgaacggggcccgcagc

SEQ ID NO: 91143 - DNA, 601 bp, Human
catcacgcttctgctcttacagagctgacagcctgcaggggagacacggagacagacacgtaaacaaacagtgctagacacacctccacgcacagaggatgacaaataacacagtgggggcgtcagggagagcttcccggaggaggagacatgtcatttgagaattaagtatgaggaagaattatggctgagggtgtgggatgataggaggaaagccgttctgagcagaggaaacaggaaaacaggaggggagacatgaaattgatgtgtgtgtgtgtgtgtgtgtgtgtgtgtgtgtgtgtgttgatgacaagcaaatttgtttttcaacatcaacattgcaggctcttccagctatggcagagctcacgttgtaaaacctgttccccaccagcaccgctgggtctgttgcttctcaccacctctccccgcaaccccagcccccattttgctagagccagggtagacagatttcattcaacgtccacatttgtggtgaggtctcatcctgcttctcccacaaattggcccatagaaagcaactgcaattagaagattctcttcttctagccccagttccaggctgaaaggcactgctgtc

SEQ ID NO: 91144 - DNA, 601 bp, Human
agagaatgaagactcgtaaaccctggggattatgcatcattttggcagcacatggagaccaacaggaaagaggaagaaatatgctaaaatgagaagaatataagttaacaaaaaaatttaattaattctaagtttcagcgtttgagactagaacccaaatttttctttttttttttttttctaatatgcattatcctttattaaaatgggatatttttctttttttttttttttaaggttatagattttcttttttttttttaaattttttttttttctattatactctaagttttagggkacatgtgcacattgtgcaggttagttacatatgtatacatgtgccatgctggggcgctgcacccactaaagtgtcatctagcattaggtatatctcccaatgctatccctcccccctcccccgaccccaccacagtctccagagtgtgttattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatc

SEQ ID NO: 91145 - DNA, 601 bp, Human
gtaaaccctggggattatgcatcattttggcagcacatggagaccaacaggaaagaggaagaaatatgctaaaatgagaagaatataagttaacaaaaaaatttaattaattctaagtttcagcgtttgagactagaacccaaatttttctttttttttttttttctaatatgcattatcctttattaaaatgggatatttttctttttttttttttttaaggttatagattttcttttttttttttaaattttttttttttctattatactctaagttttagggtacatgtgcacattgkgcaggttagttacatatgtatacatgtgccatgctggggcgctgcacccactaaagtgtcatctagcattaggtatatctcccaatgctatccctcccccctcccccgaccccaccacagtctccagagtgtgttattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgc

SEQ ID NO: 91146 - DNA, 601 bp, Human
tttgttacaatgaattctcatcaaatttttaaccacagctattctaaatttttgtcatccacagttttgatttttctcataaagtcatctgcagtcagattcatggaaaagactctaataagtagccttgaatacatgtttctgataacttaaaaatcaatggattaagtacaaatttccaaaagtctaattaaaataactgacatattcatgaaactgctaaccaagatcaaacagagcaacagttaattacatgggactaaactgataatggattataatttttatgacttttatttaraatattgctaattctttaatattttattttccagatttaaggaaacttttttcttaaggtacctatagcaatttggttatgtatactcttgtgaataatattaaaatgtttgctttttctccctatcttatctctctaaaattaaaaaaaactattcgtgagtattttttattttatgacaatgtatttacataattttgataaaaatttattttttaaataacaagatacaatttaaaatgttaattatattagcaaggtttgacttagacatcatatttaaaaattcttgtaggtact

SEQ ID NO: 91147 - DNA, 601 bp, Human
acattgatttctctctaaattatatttctagcccagatgcttctcctggatacagacacacaaatctaagtgcctgcatcacctctctccttggatatttaaaaaatctcaaatttaagatgttcaaatgtgaactcttaattatctctaccccaaactgtttttctacttgtgatctcttaagcaaaacaaaacaaaccaaagtaaaacaaaaaccaggactcatccttgacatttctttcccttattcccaattcatcagcaagcctttcctcttggttctactttcaaaatacaaccrtttgcttttctccatctctgctactatcaccttggtcctggccatcatttcttgcccccatgattgtagtagcctcctaaccaatttccagaccagctacaattcatttgcccacaatggccaggatactgttttaaaaaatgtatctcgggccagtgcagtggctcacacctgtaatcctttagaactttaggaggccaaacatgtatacatatgtaacaaacctgcacattgtgcacatgtaccctagaacttaaagtataataataataataataataataataataataataacag

SEQ ID NO: 91148 - DNA, 601 bp, Human
gatactgttttaaaaaatgtatctcgggccagtgcagtggctcacacctgtaatcctttagaactttaggaggccaaacatgtatacatatgtaacaaacctgcacattgtgcacatgtaccctagaacttaaagtataataataataataataataataataataataataacagcaataaaaacagctcatgtgggaaaaaaaaaagaactttaggaggccaaggagggcgaatcacctgaggtcaggagttggagaccagcctggccaacgtggtgaaaccccgtctctactaaacayaaaaaaattagctgggcatggtggtgtgtgtctgtaatctcagctactccagaggctgaggtaggagactgtcttgaacccaggaggcagaggttgcagtgagccaagattgcaccactgcactccagcctgggtgacagagcaagactctgtctcaaaataaataaataaataaaaaagtaaaaaataaaaacatgtatctcagaccatgtcattcttctgcttgcatgtcttcagtggcttccagttgaatttaaaataaaacctaagcttcctcttcgggcctgtgaaacctcactt

SEQ ID NO: 91149 - DNA, 601 bp, Human
tcgtataaattttagaatactcttgtctatataaaaaaatcttgctggagttttgataggaattgcgttaaacctgtatatccatttggaaagcattgatgaacattgatatgtttcctgttgtaagtcttctaatcaatggatatggtgtatctctgtgtgtattttgctctttgatttctctcatcagcattttgtagttgtcagcacatagatcgtgtgcatgttttattaaatttgtagctaagtattcatgccttttttttagtgattgtaaaaggtattgtattttcttttcttwttttattttatttttttgagacggagtctctctctgtcacccaggctagagtgcagtggcacaatcttggctcactgcaagctctgcctcccgggttgacgccattctcctgcctcagcctcccgagtagctgggactacaggtgcccgccaccacgcccagctaattttcttttatatttttagtagagacagggtttcaccatgttagccaggatggtctcgatctcctgaccttgtgatctgcccgccttggcctcccaaagtgctgggattacaggcatgagccactgcgccctgc

SEQ ID NO: 91150 - DNA, 601 bp, Human
ttagttctaggagtttttgtttttgttttttagattccttgggattttctatgtaaacaattatgtcatctgtgaatagggacacttttatttcttcctttccaatctgtaggctatttattttcttgccttatttcactgtctagaacttccagcattatttgaataagagtagtgagagttgacatccttgccttgttccccatcttgggaggaaattattcaatctttcactattaagtgtagtgttcactgtaggatttttgtagatgctcttaaccacagtgaggaaatttccctstatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtacc

SEQ ID NO: 91151 - DNA, 601 bp, Human
ggaggaaattattcaatctttcactattaagtgtagtgttcactgtaggatttttgtagatgctcttaaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttrttgtatttttttggtgtctatatccatgagggatattggtctttagtagtgttttttttttttttttgtaatttgtctagttttggtaccttaataaaattaactgggaaatgttctttcctgttctgttttctgaaggagattgtgtagaattggtattaattctttagacaattcagagaattttccagtaaaaccatctaggcctggtgatttctcatttgggaaatttcaaattacacgtttaatgtccttaatagtgatatagtgttattcaaattatctgttttttatcgagtg

SEQ ID NO: 91152 - DNA, 601 bp, Human
aaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtaccttaataaaattaactgggaaatgttctttcctgttctgttttctgaaggagattgtgtagaattggtattaattctttagacaattcagagaattttccagtaaaaccatctaggcctggtgatttctcatttgggaaatttcaaattacacgtttaatgtccttaatagtgatatagtgttattcaaattatctgttttttatcgagtgagttttattagtttgtgtttttcaaggaattggttcatttcaattaagtgatcagttttaggcatga

SEQ ID NO: 91153 - DNA, 601 bp, Human
gtgtgattaattattatgatccactgccaaatggctggcactttttttttttcagagtcttaggtaagcgtatattgcttggatagttcatctgcaggttgcctttttctcagtttttgaatagtggaaggatgttacctgctcacccatagcttggccagtatttgctcaggagctgcatatggtctctgtagagataactcctggctttttgtctgaggatgttcctgtaaaccttattgggaggcagattgggtagtaatgaactgagcgcttgcccatgtgctgttgtgttaatccsttgaaggagcttggctggcagaatgtgagagctctggcatgatcggggataaggacagaaagctgtcaagtcatgatacagatttgacgatgctgggtgggcagagcagcagaaggcaggctttgaaatgggtgggcagcctcacaagtgggctgagcaaaggctggcaagaaatgaggtggagggagtgctttgcttgtagtgacctatttaggaatcttttgagaacaggatgcaagaataggtattctctcgaatgttataaggcagatataatccccttcttggtggtctcattga

SEQ ID NO: 91154 - DNA, 601 bp, Human
cagatgtggtggatgctatacaaagtgttttagtggaaaggtctcatttaatcctcataactatcaaaaaatagtataaacagtcaaatagtatgtcaaatagtataactagcaaaaagtagattaaaatagtattatttttatcctccttctacgaaggagggaattgaggcttggcaaggtcaagtaaaatttgctgaagtttatacagttggaaagtgatctttccaggactcaagagcaggcttgtgtgattccaaggcaagtacagtacagtatttgttaccatcgcatgagataratatttgtgtttgtatttgtcaccattgcatgaaataaatctgttgctaattctctaaccttttctccatgattctgaatccttatataaatttgaggtgctttcatcattcattggagccagatgtcacctgtttacactctgtattacatagaatattctaaaacaggggttggcaaacatttggcctgtgggccagatatggcccactgcctgttttattgtacagcttgtgagctaagaatggtttttataatttcttctaatggttgaaaaaaatcaaaagaataaaaatattta

SEQ ID NO: 91155 - DNA, 601 bp, Human
ggctggagtcgcagctcagccattttggtagctgtgtgatggtgaacgagtcacatatcctatgtaagcctcactctcctcttccgtatactagggtaaagagcagctccaacacggtggactcaactttggggattaaatgagctaatgcacatgaggtgctcagcacagggcttggcccataataaacgtgtaataaatgctagctgataactttctccactgacctcctgcctggaacagaaaatgaaattctgcttcttaaaaccaaatgttataagcttcatccttataaaccaastgcctttagaaatgtcctctttctactcttctctgggttcctggggagcagaacgcctgcttgggtgatgacttatgtctctcaaatcctctctacccctccatgatatcacacatttccgtcgtacggcatgtactaaggtctgcacttaatttatgatgtaagggccaggtgcgtattttcagccttcaaaggctgagtatatttgggattgactctgaagggggaatcccctgttgtttcattcatacagtaggtatagcctgatggttagagtgtgggttagtatatctgggctgc

SEQ ID NO: 91156 - DNA, 601 bp, Human
tgtctcaaaaaaaaaaaaaaaaagagaaataattcctgtcacagggagcggaaacatgctgaaataattatttgctgaaattgttttccaacagatggctttaggaatcaggagatttgacactaggacgttaggtgggcaatggatttctagtaatttgtcagctttgttttattgaggtggagctgcatttaaattgctacttctccctgctggtttggtttggttctcctcagaaatggcttactttatttgtacttgacttgagttacattaaagcaggcaaaaatatttcttaagrgctgaaatttcaggttggcaaaaggaaacaatgcaatctttaatcatatatctgaaagagcacagtggtgcattatgatggcagaacttcattccctaaccctgtacaaaggtttttagagactaaaggattgatcgtttttttcccctgacaaaacacctcttttgacatgtgcagagaaatatgtaatttgggttgcattgaaagaaagctactcttgctatttctctctccaagaggctgtgctcttggagttaatattttctactggagacagttctacttgaaaggcaaatatta

SEQ ID NO: 91157 - DNA, 601 bp, Human
ttttttgaggtggggtcttgctctgttgcccaggctagagtacagcagcatgatcatggctccctgcagcatccaccttccaggctcaagcaatcctcctgcctcagcctcccaagtcgctggaactacaggcgtatgccaccacacctagctagtttggtttttgttggcattttttttttatagagtcagggtctccctatgttgtccaggctggtctcgaactcctgggctcaagccatcctcccgccttggcctcccagagtgctgagattacaggcatgagccaccatgcctggcyggaagtttactttttactgcctaccatgtggatttgtttttttaaatttctattatgaggaattttatacatacagaaaactaaagagaaaaatactatgaatacctctaccccatcacatagattaacaggtattaacattttgccatctttggtttatcttgttttattcctgaagcattttaacagaccacgtaacatttcattcccaatacttcagtatgcacatctgaaaaataagggcctttctcttaggcctttctctaaccatgctaccactatcacatctaacaatgattt

SEQ ID NO: 91158 - DNA, 601 bp, Human
aatacttcagtatgcacatctgaaaaataagggcctttctcttaggcctttctctaaccatgctaccactatcacatctaacaatgattttttatgtcctccaatgcccagcctatattcaaatttctctaatattctccaaatgtcttttatggccagcctgtatgaatctggatctaaccaaagaccatacattgtatttgatagttatgtctcttatactgcttttttttaaattcaaatttacataacataaagttagccattttaagatgaataattcagtggcatttagtagtcwcagtgttgtacaatgatcatctctatctagttccaaaacattttcatcaccccaaagtaaaacctcataccctttaagcagttactcctcatttcccaccccacccatctcctgggaatcactaattatcctctgcctctgtggatttacttattctggatattttatatgaatggaattgtacaatatgtgaccttttgtgttttgcttcttttacttagcacagtgtttttgatattcatccatattgtagcatgtatcagtactttattccttttcatggctgtataatattccatt

SEQ ID NO: 91159 - DNA, 601 bp, Human
gatcacgaggtcaggagatcaagaccatcctggccaacatggtgaaaccccgtctctactaaaaatacaaaaattagctgggtgtggtggcatgcgcctgtaatcccagctacttgggaggctgaggcaggagaattgcttgaacctgggaatcggaggttgcagtgagccaagatcgccactgtactgcagcctggtgacagagcaagactccctctcaaaaaaaaaaaaaaaaaaaaaaaggaaggtatggacgataaggggttcatatcaaacaacactatgggaatgaagtccatcrgatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtccccaaggttacacatggtaagcggagcagagtgcccgagaattaatggcctagagagttaatgtctctggaag

SEQ ID NO: 91160 - DNA, 601 bp, Human
aaaaaaaaaaaaaaaggaaggtatggacgataaggggttcatatcaaacaacactatgggaatgaagtccatcggatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtmcccaaggttacacatggtaagcggagcagagtgcccgagaattaatggcctagagagttaatgtctctggaagcagtgcttagccaaagatgggtggaaagctggtggacaaataccccagcttccttccctctatcccccagggttgggaaaactctcagtggtgccccacactgttttccagagttgtccagagagactgagcttcatttgcccccagcagtaacgaaccctttgttggtggtcctcccactgtctcactttccggctcccctaccagtttcactggggtcacctccc

SEQ ID NO: 91161 - DNA, 601 bp, Human
tcccactgtctcactttccggctcccctaccagtttcactggggtcacctcccagataaaccatttgcactgaaatcattgccccagggtctgtttctgggggaaaccaaagtaggacagggacaaatcaatccatggaacaagtgaaccttatttccatctggattcaaacaacccatctgccaaaaggcatttatgagttaaatgtggaaacatgatcatagatgggatattagatgattttaaataatcgttctttaatttctttaggtttgattgttgtttcttggttatttttttwaaaaagagtgcttatctgctagagatccacattgcagtatttacaaatgagatgatacgatgtctgtggtttgctttaaaataatccagtggtggtggtggaggtggaggggcaccagggaggggatccggggactataaggtgggcaaaactttaataactgttgaagctgggtgatggggacatggcagttcattacagaggttttgtggtgtatttaaaatctttcatagtaaaatgttaaagaaaacaaaaaaaagcacatgtacacctttctggtctccctcctctgaggcaaaa

SEQ ID NO: 91162 - DNA, 601 bp, Human
atctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagytcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccat

SEQ ID NO: 91163 - DNA, 601 bp, Human
tccctcagcctcctgagtagctaggagtacaggcatgctccaccttgcctggctaattaaaaaatacatatattttgttgagggggtttcactatgttgcccaggctgggggctcaaggttttctcatgggtttatttgctaattgtgtttctcctgttatgacttgttcacacccttggcctagccatcctttggagtattagtttttttcttatgaatttggatgagctcccaatatatataccagaggcttatgtgaccagaggcttgaaagaacctaacttctatttcctttaggarcaatggttcagtattcattaattgagtgtttgtagtggcttttaatagaacataattacttttaataatgaaagtccactgtatttatttcacacctcttgatttttctgttcattattttggattgtttttaaataaatcatgtatttcatacatcacttatgttcattgatgaaacattataaaatacaaaaaaagaaaaaaacattataaaatacaaaaaaccaccagcaaaactgttatccacatctcattaccctatattgttactcttaatattggatatatacccaatattat

SEQ ID NO: 91164 - DNA, 601 bp, Human
agaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacrtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcac

SEQ ID NO: 91165 - DNA, 601 bp, Human
gtcctctcaagggggataaatgccacctgctatttaaggagacttgaccccatccctgcttctatccattaatgggtgactttttaattcttctggaactcttattgccaaggtcttggtgggactgagggtgagatcgcttttctgtaacacagatgcattgccattttgctccttgatagtgtaagatgtttaagtcaattaagacaaaaatgtgcttaatactcttttcatttgccttaacaactccacgtttatttaatatcagtttaattcttggctgctgcaaggtctgggtagytttcatttcgaaactactcctagggtgagaagtctcttaagtgcctgtggtattcccaaagaatttgcttttgtgcggcagtcacagcctggaagcgcgctgctttctttgctcctggtgtcagaaaagctactcctggttctcagattgggctttcctgcacattagaattggaaaggtcctctttgtgtctgcccctgtaagggagccaaacaaaaggcgccagagtggtggtagggcagcatcatcgctccctaacctccaccctcctccttctctcttccttcctccccgtccctg

SEQ ID NO: 91166 - DNA, 601 bp, Human
tgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtacagactgttggatttttataaagtgaacactaatgttacccyatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcggg

SEQ ID NO: 91167 - DNA, 601 bp, Human
ccagtgtttagctcccacttataagtgagaacatgcagtatttggttttctgttcctgtgttaacttgcttaagataatggcctctagctgcatctgtgttgctgcaaaggacattatttcattctttttatggctgcatagtattccatggtgtgcaagtaccacattttctttatccagtccactgtcgatgtgaacctatctttgctattgtgaatagtgctacgaatgaacatacatgtgcatgtgtccttttggtagaatgatttattttcctttgggtatatgcccagtaatggkattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcattgtggttttgatttgcatttctctgatgattagagatgtggagcattttttttgcatgtttttggttgcttgtatgtcttcttttgaaaagtgtttattcatttat

SEQ ID NO: 91168 - DNA, 601 bp, Human
gtgaacctatctttgctattgtgaatagtgctacgaatgaacatacatgtgcatgtgtccttttggtagaatgatttattttcctttgggtatatgcccagtaatgggattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcrttgtggttttgatttgcatttctctgatgattagagatgtggagcattttttttgcatgtttttggttgcttgtatgtcttcttttgaaaagtgtttattcatttattttgctcatttttcaatggggttatttgttttttgcttgtgcaattgtttaagttccttgtaaattctggatattagacctttgttggatgcatagtttgcaaatattttctcccattctgtggagtgtctgttgactctgttgatagtttcttttgctgtgcagaagctctttagtttaattaggtcccact

SEQ ID NO: 91169 - DNA, 601 bp, Human
ggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcrttgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactacctatatgtatattaaaacattatgttgtgtatcttaaacatatgcaataaaaattaagcaaaaaataaaaaggcccgtatttctcttaacctgttaaatac

SEQ ID NO: 91170 - DNA, 601 bp, Human
actgagctacatgcttcagagatgacagagctccatgggctgttgggttgttgaggaaggggctgaaggaaggacaagtgtcaggagtaagagtcttcttcattgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactayctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcctcttactgatatttattcttccctttccagtctgaaaagcagtctccatggcagaataattggtaaccaaatgtagatctatctgcaatggaaagtgacattttgtgagc

SEQ ID NO: 91171 - DNA, 601 bp, Human
tgtctctgtcttcctttccccctgcctccctccttctctctcttctttctttctttccttcttctcatttcccagtggtctggtctccaaaaacaaatgaatgtgtgaaatcagtgaggattcttctccctggaaacaatgtgttgttggcaaaagcaacaactgcctctgcaaacatcaaaatcctccaaaagagtgaatggggaagatcatatttggtgttcagcaatctaaaaaaaaaaaaaaaaaaaacagacagcaaaaacccagaggaagtgaagaaagttagtaggaactggtmatactatacagatgatttcttctccacctgtttggaagttttgcttaagtctggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcatt

SEQ ID NO: 91172 - DNA, 601 bp, Human
tactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgtgtggtttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctat

SEQ ID NO: 91173 - DNA, 601 bp, Human
tgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctatttt

SEQ ID NO: 91174 - DNA, 601 bp, Human
agggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttcyttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtt

SEQ ID NO: 91175 - DNA, 601 bp, Human
caggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaarcaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaag

SEQ ID NO: 91176 - DNA, 601 bp, Human
aactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtataygtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaagcaaacactatcatagatcaaagcctaattatacagtttttttatttaaaacaagctgttcttgcatattcattaaaaaaaaaactcaggtatattatttgtgccagaacagtctttagacctatattta

SEQ ID NO: 91177 - DNA, 601 bp, Human
tagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaagcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatac

SEQ ID NO: 91178 - DNA, 601 bp, Human
ttatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgcyttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaa

SEQ ID NO: 91179 - DNA, 601 bp, Human
ttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaawgttctgtaaatatctatgaggtccatttggtctatagtgcagaataggtctgatgtttctttattgaaatgctaatgagtagtttacacaccacaattacagtgttattatagtctgtgtttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctg

SEQ ID NO: 91180 - DNA, 601 bp, Human
ttgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtrtttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaa

SEQ ID NO: 91181 - DNA, 601 bp, Human
tttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctrtcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagctttttttttttttt

SEQ ID NO: 91182 - DNA, 601 bp, Human
aaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattc

SEQ ID NO: 91183 - DNA, 601 bp, Human
ttctgttgggttcttaattttagttattggattttcatctgtaattttcatttgctttctttttatgtattccaatttttgataaaaattttacattgtcatttattttattcaacatatttatcatagttacattaaaaatcatttctgatgtcaatactgggattacctgttggatcatctaattcttttcttagttttccattgttggttcagtatcctggtatgccaaattatttttatttgaatggcacatattgtgtgtgaagaattgtagcaggtctgagtaatgtatcttccwccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaatttctgtctcttgatcactgtgatactgcagaaatacctgcttagatatttagccttctagcagcctctttgtgctggtttcttatcatctgccttg

SEQ ID NO: 91184 - DNA, 601 bp, Human
gttggttcagtatcctggtatgccaaattatttttatttgaatggcacatattgtgtgtgaagaattgtagcaggtctgagtaatgtatcttcctccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaattyctgtctcttgatcactgtgatactgcagaaatacctgcttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatg

SEQ ID NO: 91185 - DNA, 601 bp, Human
ccaaagtgctgagattacagacatgagccactgtgcccggccctccattaccattttaaagcctctgaaaatgtttcagtaaagaaatctgcttaattttgttttccctgtgtttccaaatatatatagtcaagagctgtttttgtttttgtttgtttgtttgttttactttgcctggcccttaggtacatcccatggagctagtgttttgtggcacacatactggaaaatactattctggagcattttctaaaatcctaagttacaaattttgcttttttacattttctcttaggttccrgctttcttgctgtttaatttcttgcttcatgaaagggaagaagatggagacgccaaggtttctttgaaaacagatatttgcacgagaaggcagccaaggctgtgttaacattcaccattaaaaacccaacacatctagacaaaacaccaaatgcaaaagcttcacgtttcccaaataaatttcttttataatttgtcactgctcggttgtaggctttgaaaatagttttcattttcctgttattgacaaaattaaagctgccaagaagtagatggtgaacaaggattttatctctgactg

SEQ ID NO: 91186 - DNA, 601 bp, Human
aaatctattaacagcattttcctaagcccttacatttcttgtgactaataagacatatttagttaatcagattctcttaaacatttcaacgatcttggcaaatagctgaacataccaaagagagctcaaagtcacaaaacttgttactaggccaaacgcacactcacatgcccacttgcacacacagcacacaagtatcagtaatataggtttgactccttttttatcatttctgtactgtcttttaaaactttcctggggctccagattaatttatttagcccaaattaatgtatttacytaaggggaacaaatacgatttcaggctggataagattgcttggttgcaaacttgtgaccctggcaggatcatagttttctaaattacaaaaatgatttgtcttctattataaatcattctgcagcttgcttgctttctatgtatgtactttgaatgtcgatcttccttattttttttccttatgattaaagagtattcctttacttggatgtttcataatttatccatcagtctcctgttgatttccattttcaatattacataaaatggcctaacaaacatgtttttccttcactgcaa

SEQ ID NO: 91187 - DNA, 601 bp, Human
taaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcmccatattggccagcctggtcttgaactgctgacctcaggtgatccacctgcctcagcctcccagagtgctgggattacaggtgtgtcccaccgtgcccagccttttccttctttcttgtttgtttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgtt

SEQ ID NO: 91188 - DNA, 601 bp, Human
gcctgcctcggcctcccaaactgctgggattacaggagtgagccactgcacttggcttgttgtgtatcttttatgccttgtttattcttatatgtattcatatgtacttttaaaaactacagtaaggctatagtacatatactctttggtaacactgactatataatgatccatatcgtaaaataattaatcttccatgatattgtttttaatggctacataatattccatgtatcatagtttgttcagtcaatcccatttactaaataaatgtttctttatgtaaaaacattttacatarcatttacaataaccattttcataggtaaatctttggggatatccaaaattatattctttgacataatttagataacatgtctagtataaaattgctgagtcaagagtatgcttatttttcaggttttgaaagcatattcccaacctacccttcagaagggttacactcatttgacactgttgccaggagtgagtgagggtatatttctctacatagttcctaaccctagagattatctttttagtttacttttaaataactgatcatttgatatgtagtatacaaaaatgatatctcatt

SEQ ID NO: 91189 - DNA, 601 bp, Human
aatagttcattctagtgcagcatttcccagggatgttttctagagaccctgcaaccctcattgtacagagaactagagggcacctggtttgcagtaatctggcaaattactgccgattaaccggactgagatagcacactgtaatccaggaaaaactacctgccactacccgagccaggaaggctggcctgggctccaacgcaccagcagacccccaccccaccctgctgacaggatgtcccatgtgacactggcaggctttctttgacatcagagagggcacggaggcttagaaccttcyagaaggatacggggagtagccttgagaagatcccacggctagaagctgagatgttttgttggtttatttctattgtaatttttactggttaacacttagccccatgagtgaatcctttcattgtttacaaagagattttattctcaagcttctaaggaaccctccgtgccagtttcccaaattaccagttttttagaaaggatctttatccccatctagtggtccaaatggtaagtacttcggtctgctagcctcagttgtattttctgtagtggtgaaagtgcagaccatagagaggaa

SEQ ID NO: 91190 - DNA, 601 bp, Human
tcagaaatcttatgggtgaagcccagcaagtctgtgttttataaagtcctccaggtgattctgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattmatccatcaactgtgtatagcctgctctgccctgctacagtggtggtgggcactggccatacgtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagaggg

SEQ ID NO: 91191 - DNA, 601 bp, Human
tgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattcatccatcaactgtgtatagcctgctctgccctgctacagtggtggtgggcactggccataygtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagagggccagggctgtgagagcaggcaggctcggggacctcggttgtgtgatatggccaggggatag

SEQ ID NO: 91192 - DNA, 601 bp, Human
cccctcggccccgacactcataccatcctcttcttccatctcaggggaaacatgtccctgttgctctcaagccagtcctcctctgggccgcagggtctgtcacctctcacctcctcagggccgttgtgacatccatcgtcctctctggtgtatcttcattctttccctttctgtctgttggcttcttcctgttaacatttacacacagcacagctgcccttgacccctggtgtcacatctcactccctcctgtccattctccagcccacagccagggcaccctttctgagctgcaaaccttcctggctgcccactgacagtggggtgaagatacagaccctcagcccttcacagcctggcccctcctttcctctgtggccttattgccaccccttccccacatgaactctgcccagcctcactgaattatttccagctccctggtgacgttttgctttgtgctttctcgctatttgctgtctttgtcctttcaccccttctcctggctgtcacctcacccctcagctcggatgtgctttcctttgggaagctgtttgttctttcgctagacttcgtggggtatcccttctgtgcctctgtg

SEQ ID NO: 91193 - DNA, 601 bp, Human
ggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgsagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattg

SEQ ID NO: 91194 - DNA, 601 bp, Human
actgacaccccatgataaagaggctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacrtgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctgg

SEQ ID NO: 91195 - DNA, 601 bp, Human
gctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctgrtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcag

SEQ ID NO: 91196 - DNA, 601 bp, Human
cagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttyggccccacactgtagcctttggttgtcttgtgaatgggagctggattagagacattgagcatctcttcacatcttgcctgaggctgagcagtgtcgttattctgtaggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatct

SEQ ID NO: 91197 - DNA, 601 bp, Human
agcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaayaaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttca

SEQ ID NO: 91198 - DNA, 601 bp, Human
gtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttrccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaatt

SEQ ID NO: 91199 - DNA, 601 bp, Human
agataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaaaaaaaaaaaaaaaaaaaaaaggtagtgccttcacttcaccagtacgaatttcaggatatgttcataatattgactagtattgaaagagtcaaaatattgacaaatttcaggctgtgttcataatattgacaggtattgaaagagtcaaaaatatcttctgaacaatcaaagaaaggtttctgcattccttgtgaatttaatcatagatgtagtctatacttttctgaaaattagtaatattatatatagtctgcatggcaaccctgtttattaaaatattttaaattaggtttgataacagaaaattgttttacacagga

SEQ ID NO: 91200 - DNA, 601 bp, Human
ttaatttatttttaagttgaaattagcatttttgagcaactgctatatgctagatactatcttaagtgctgcatcgttattttttattaaacaagtgatgcaaatgtgtcttttagtaaaataatcaaacagaaaaaaattggtaaaataatcaaacagaaaaaaaaatttaatggtataagtcattctatagtctcttgtgatcacctacaccatcgcagttcgcttcctagatgtagccactgttaaaaaaatttggtataactattatcatatctattgaggtacataaatatacacwtaaacagcgttttggatttttttctgttttttctttttttcttttttgagacaaagtcttgctctgtcacccaggctgtagtgcaatggcatgaacatggctcggtgcagccttgacctcctgggctcaagcaatcctcctgcctcagccttccatgtagctggaactacaggtgtatgtgaccctgccaggcaaatttttttattttttgtagagacaaggtcttactttgttgcccaggctggcctgcaactcctgggctcaagcaatccttctgcctcggccttctgaagtgctggg

SEQ ID NO: 91201 - DNA, 601 bp, Human
gcacatttactttatataatgaacatatatttatattagctaaagtccacacttcattcacatttccttagtttttacctgctgttctttttctgttctaggatcctatccagaatagcacgttgcatttagtcctcacatctccttcggcctctcttgctgtggcagcttctaagactttctttgtttttaatgaacttgacagttttggggagtactgtttacatattttgtagaatgtcccccagttgagatttgtctgatgtctttacatggttagactggagttatgagtttctgrgaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcagtttctcacacaacttaaagcagaactatcatttgacccagcattcccgttactgcatatatacccaaaggaatataaatcattctaccataaagacacatacacgtgtatgt

SEQ ID NO: 91202 - DNA, 601 bp, Human
tttaatgaacttgacagttttggggagtactgtttacatattttgtagaatgtcccccagttgagatttgtctgatgtctttacatggttagactggagttatgagtttctgagaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcartttctcacacaacttaaagcagaactatcatttgacccagcattcccgttactgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaact

SEQ ID NO: 91203 - DNA, 601 bp, Human
acttgacagttttggggagtactgtttacatattttgtagaatgtcccccagttgagatttgtctgatgtctttacatggttagactggagttatgagtttctgagaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcagtttctcasacaacttaaagcagaactatcatttgacccagcattcccgttactgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaactcaggaaca

SEQ ID NO: 91204 - DNA, 601 bp, Human
aaaacgtactacatatattccatgggacagtacacggccataaaaaagaatgagatcatgtcctttgcagcaacatgggtggagctggagaccatgatcctaagtgaactaactcaggaacagaaaaccaaatactgcatgttctcacttgtaagtgggagctaaacattgagtacacatggacacaaagaagggaataatagccagtggggcctgcttgagggtggaggttgggaggagggtgagaattgaaaaactacctaccctgtactatgcttgatcacctgagtgacgaaataayctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgttttttttttttttcctgcatgaaggctttaaactataaattcaacgtctttatagatagaaggcaattgaggttatctgtttcttcctgagtgaactttagaagttggtgtct

SEQ ID NO: 91205 - DNA, 601 bp, Human
aagaagggaataatagccagtggggcctgcttgagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgttttttttttttttcctgcatgaaggctttaaactataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaatttt

SEQ ID NO: 91206 - DNA, 601 bp, Human
gagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgttttttttttttttcctgcatgaaggctttaarctataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaattttattgatcttaaagagccagctctctgtctcat

SEQ ID NO: 91207 - DNA, 601 bp, Human
tattgatcttggtctgctggctgaggcagtatttgtcagctctctgtaaagttactccttgttttttttttttttcctgcatgaaggctttaaactataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttaraaattggtaatttttgtctttttcttttcttaatcattttagctatagatttatcaattttattgatcttaaagagccagctctctgtctcattgagttttctctgttgtcattgagtcctttcgccttttccgatatatgtgtttagcgctatcaatttccccctaagtaccacttgagcaccatctcatgcattttgatgtgttgagttttccctttcatcctctttaaaattgtttctaattttacttttgataacctctttaactcttggtttcttctgaaatgtgttatatcatt

SEQ ID NO: 91208 - DNA, 601 bp, Human
tgtggatatttttcagatctctttctgttttagatacctatttaattccattttttatcaaataagatactttgtatgaatcatacccttttaaattttttgaagcttgcttgatgggccagaatatgatccatcttggtaaatgatctgtgtacacttgaaaagaatgtgtattctattcttattgggtagggtgctttataaatgtcaattaggtcaaattatttaatagagttcttcaagtcttccatattcttgctgattttttggtctatgttttcctattaattttgtggcagarggtattaaaatctctgattatagttatggatttgtctatttctcctggcaattgtatccagaagtatgggaagttggctacattcccttccgtattcctcattcgcattgacccttttagtctgattacttgcattttttaaaacacggaaagtgtgtttttgtttgtttgtttgtttgttttaagatacggggttttgccatgttgctcaggctggtctccaactcctgggctcaacattccttccacctcggcctccaaagtgctaggattataggcgtgagccactgcacccccact

SEQ ID NO: 91209 - DNA, 601 bp, Human
taaacaactactagaggttgaaactttttgtccttcctcggacaaaaagtcttttcctccttgctctctgtacctctgtttttttattctgccctctgaggacatttcaccttcttactttattctttgatccagttatttatttagcatatctattgaatttcttactccaattgtattagttctctattgatgctgcaatgaaataccacaaactgtgtggtctaaaataacacaatgtatgatctattttatagttctggaggtcagaagtcctcaaatcaaggtgttcacattccasacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcgtcacattccctttcgctgtgtaaggtaacatagctataggttctg

SEQ ID NO: 91210 - DNA, 601 bp, Human
agttctggaggtcagaagtcctcaaatcaaggtgttcacattccagacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcktcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatcttggctcactgcaacct

SEQ ID NO: 91211 - DNA, 601 bp, Human
taacttaatcacatcgtcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatctyggctcactgcaacctccgcctcccaggttcaagcgattctcctgcctcagccttccgagtacttgggattacaggtgcctgccaccgtacctggctaatttttgtatttttagtagagacggggtttcaccatgttggccaggctggttgcgaactcctgacctcgtgatctgcccaactcggcctcccgaagtgctgggattataggcgtgagccaccacgcctggcccttaattatgctttttaaaaagtctccacttaattcttatctccttgagtgtttgttgggatctggagtct

SEQ ID NO: 91212 - DNA, 601 bp, Human
ttccaggcattcttgtattcctcataatttctggtctaccagcagtatttagtctcattttccaacattatttgcaaccttaaaaagtcctattttgtaagtgatagggatttggtacatgaaaggaaggctgcagtcctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcarttctcttatattcattccaatttcaaggagataagctacagttttgtgctggagtatttttaatgttcaattttaacagagaggagaggcctccggttaaaagtcatttacagactacagaatgtatcttttggatgtaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtaca

SEQ ID NO: 91213 - DNA, 601 bp, Human
ctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcaattctcttatattcattccaatttcaaggagataagctacagttttgtgctggagtatttttaatgttcaattttaacagagaggagaggcctccggttaaaagtcatttacagactacagaatgtatcttttggatgkaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagt

SEQ ID NO: 91214 - DNA, 601 bp, Human
actagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagttgggggagaatttcaacttcccatgtgaagcactccccctttcctttctttatttttttggtrttctaatttttttccttaggtttttgaggaacaggtggtatttggttacataagtaagctgtttagtggtgatatttgtgagatttcagtgcacccatcagccgagcagtgtacactgaacccaatttgtagccttttatcccttaccccttccaccctttctctcaagtccccaaagtccattgtatcattcttatgtctttgcatcctcatagcttagctcccacttatgggtgagaacacatgatgtttggttttccattcctgagtttcttcacttagaataatagtctccaattc

SEQ ID NO: 91215 - DNA, 601 bp, Human
ttcagggtttctctgaagactttttatattgtattatgctaacactagtttgtgtctcaaaaaaaaaaaaaacaaaacataaaaccgaaatgcagtaaaataggatttcctcactcctgccacagtccagggagaatattccaagaagataggtggttctaatgcatagagtctctcaggggtctaggctgatggcagctctgccatcttcatcatatggcttcctagttgttgccactccagccagcaggaaggggagaaagaacaaacatttaggttagatatttcctcttacacccgyaaggtggaaatgacacacacattccagggatgagcgctcaaacagccacacctagtagcaaagcaacttgggaagtacaacctctagctaggcagctgctatccagttgtaatggcatcttagtttgtttgggctgctgtaacaaaataccttagactgggtagcttttacttacagtctggaggctgagatgtctaaaatcaaggtgccagcagaactggtgcctggtagaggccattcctcatagatgacaccttctagctgtgtcctcacatggcagaaggggcaaacaagctccca

SEQ ID NO: 91216 - DNA, 601 bp, Human
cttgaatgccagattttaggaatgagagacataggaaaagtgtaagaaaatagtgcaaggctggtgataaatggctgactctaagcttccaagtcaggatcatgacagagggaggtgtgtcttcaacaactagaaaacacttgttctttctgaagggggtggccgatagtctacggcaagcgccccttgcctgagaatgtgagcccatcatagctagcctttctgatttttcaagagaagccagaaaccctatgtttatgtgacatctcctgacttttagatgttggcaactaatccacaktgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcac

SEQ ID NO: 91217 - DNA, 601 bp, Human
ctacggcaagcgccccttgcctgagaatgtgagcccatcatagctagcctttctgatttttcaagagaagccagaaaccctatgtttatgtgacatctcctgacttttagatgttggcaactaatccacattgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcacaatagacaagtcattgttttgtaaggtgggggagggcaaaactttattagttaaacccatctaatataacccgagtaaattgaggaagattggcattaaggttaacataaatcacacatgcttatttttacagatttcaatgattaagcttgagttccattgacaagtaa

SEQ ID NO: 91218 - DNA, 601 bp, Human
gggacttcagccaaaaaatatatatatatatatataatatgtatgtgtgtgtgtataaatgtatgtgtgtgtgtctatatatatatatagagacaaaataagtggagttgggggaggggcaccgcaaataatgttcctgctgttaaaataagagggactgaaccatattaatgccaagggggaagttcagtttatttcaggggggacgtggttttcctacctcctactgtgttactgatacagtacttactgaccagccgtcttaaactcttgtggtagggtctctctctctctctctctctttctctttttcctaatggtgtggaacagagcttgaataataaatatttaacagggacactcccttttctctgttaaaataatctttgtttcaatactttaacaaggaagactgtgttttcccacctctgctctcacgtttcgttgaagccaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctac

SEQ ID NO: 91219 - DNA, 601 bp, Human
tttcagctgaggtgctggcttctgatggtgggaaaccaagcattcaggtcccttggagaggcttatatctaacagttggaaagcctccattgaggaaatccagcccattctgcctggactttggggctccatccatggtgacttttgtgtcaagggaaaattcacacactgtccctcaggcgggcagcaacttaatttctctttagctgaactgaacttgcttgcaagcctctatgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgaggggggtttacagaacatcatggtggcaggtagggaggctcacttccacagctgaggtgactcgtcac

SEQ ID NO: 91220 - DNA, 601 bp, Human
tgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgagsggggtttacagaacatcatggtggcaggtagggaggctcacttccacagctgaggtgactcgtcacaggaggcctggggcctgggccaggatctgtgctgacatctgtggcttaggcctccctctctgggttgctgaatctctgtatttggagccgtgtgtcactgcccccaggcagcctctggcctcagtggcccctcagcacttcctgctggggacttgagggaatttgttcacagttcacagggagcgaccagccttcaggccccatctgtacttagtgacaccacatggtttccac

SEQ ID NO: 91221 - DNA, 601 bp, Human
tctctggatggcaggaaacagctcctccctctccatggcttgtaatcaaaatgctaggctctgagttcttcaagctctagttcttggaacccagaagtttctctctctctctcgctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgwgggccccaggcaacagaaatgacccagaatgaaaaatgcattgatacttcagaatatcgtccggctgcatgtataattcagggcagccagtctgagctctggttggggtggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtg

SEQ ID NO: 91222 - DNA, 601 bp, Human
gctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgagggccccaggcaacagaaatgacccagaatgaaaaatgcattgatacttcagaatatcgtccggctgcatgtataattcagggcagccagtctgagctctggttggggtggayttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttgtgt

SEQ ID NO: 91223 - DNA, 601 bp, Human
ggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttstgtgtgtgtgtgcagcaagaacccaggtttacacatggaggtggtggcctggtttacacatggaggtggtgcatacacttggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcagcctatgaaatgtcttggcaacccttagtggtgtcatagatcatgtacgaggtgacatggagca

SEQ ID NO: 91224 - DNA, 601 bp, Human
atctctagcagaacttgttcaattctcacttgaagtctagagggaggaaaaagtcttataacagaaaaaggaaataaaaatggaaatcatcaaataggatggcaaaagtcacttattaagaaaaaaaaaaactcctaagattaatcttattaatactcaaagaaaaaaagtatgaactagtcaaaattgaagtgagatttttgtgagagaaatgtgtcatattaatactgaaatatacctagttaaatgaattcatgagaatagcaaggaaatattgaaatagaagggtaatgactatgarctagttttactagttattaacattttatttatttatttatttttgagatggagtctcactctgtcacccaggctggagtgtagtggtgtgatctcagctcactgcaacctccgcctcccaggttcaagtgatcctcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattaca

SEQ ID NO: 91225 - DNA, 601 bp, Human
tggggtttcaccatgttggccagggtggtctcaaactcctggcctcaagtgaactgcccgccttggcctcccagagtgctgggattacaggtgtgagccaccacacccggcctgttaacatttattataaagccacagtatttaaaatgatatggtactgttaccaaaatgagtcagtgggacaaaatagaaaaaatccaaaaatagatctaagtcccatgatgattaaatatatgataaagataaaggcaatacttgaaatcactggagaaaatatggattatttaagtatgttgttatractgcataagcattattaaatataatagatatttacctcattttgccaaaatccaaatagattataaaagttctgatgtgaaaaaaattaaataaaaatactagaataaaatttagttgagtctttatataggactgtggagaataaaccatgaatagaaagtttgattagtttgactgcttatactcttcaatttgtgcattcatgccaaaacaaaatagaaacccctttccctgccccactgccagcacaaacttcaaaaacaaaatgagaaaaaaaaagaacagatgataagttggg

SEQ ID NO: 91226 - DNA, 601 bp, Human
gagtgcggtggcgcgatcttggctcactgcaacctccgccttccgggttcacgccattctcctgcctcagcctctccaagtagctgggactacaggtgcccgccaccacgcccggctaatttttttgtatttttagtagagacagggtttcactgtgttctcgatctcctgaactcgtgatccgcccgcctcagcctcccaaagtgctgggattacaagcgtgagccactgcgcctggccactgtgattgcttttgcaccaacctaatagaaaaataaattgacactaaatgtcagatatyttagaaagaattcatgttctatgaccatgaaatccttttcttggaatttatcctcagaaattaatagtgcacatttgtagatatttatgtataagctctttttcccaaagaattgtctataaaagccaagggggaataaaagagacaacagaaagaaatgaagaaaaaggaagagaaatcgagaaaaacagggagggagaaggaagaaaagaatgaaggaaggaaggaaaagaagagatgaaaagaagagaaggaaggaaaagaaagaagaaccgtaaatgtccaacaataggagattag

SEQ ID NO: 91227 - DNA, 601 bp, Human
tagcttgtacaagaagaatcttttatgaaaacaactatatgtaaatatatgcacaaatataatcatgaagacatctggaatctgaaagctagcccagttatctctggggtaatggtttacagctctgacttttctttctccactttgcatacatgtattttttgtttacaattagcatgattttgttttgaaaaaaatgtttttgatgttattctgggactagatgtcagtaaatattcttgtctgtaaattctggtctgtaaatattcttgcctttcttgtcctggtttctctcctccckgcccttgtcctgcccattaactaggaagatcttgctgaccaccaaggtcctccctactaccctctccccagagctcctgaaccatgagtgatacacacttcatatttgttctttaaaagatttttggccatgcacagtggatcacgcctgtaatccccacactttgggaggttgaggtgagcagatcacttaaggccaggagttcgagaccagactggccaatatggtgaaaccccacctgtactaaaaatacaaaattagctgggcgtggtggcgcatgcctgtagtcccagctgcttg

SEQ ID NO: 91228 - DNA, 601 bp, Human; identical to SEQ ID NO: 84607

SEQ ID NO: 91229 - DNA, 601 bp, Human; identical to SEQ ID NO: 84608

SEQ ID NO: 91230 - DNA, 601 bp, Human; identical to SEQ ID NO: 28896

SEQ ID NO: 91231 - DNA, 601 bp, Human; identical to SEQ ID NO: 28897

SEQ ID NO: 91232 - DNA, 601 bp, Human; identical to SEQ ID NO: 28898

SEQ ID NO: 91233 - DNA, 601 bp, Human; identical to SEQ ID NO: 28899

SEQ ID NO: 91234 - DNA, 601 bp, Human; identical to SEQ ID NO: 28900

SEQ ID NO: 91235 - DNA, 601 bp, Human; identical to SEQ ID NO: 28901

SEQ ID NO: 91236 - DNA, 601 bp, Human; identical to SEQ ID NO: 28902

SEQ ID NO: 91237 - DNA, 601 bp, Human; identical to SEQ ID NO: 28903

SEQ ID NO: 91238 - DNA, 601 bp, Human; identical to SEQ ID NO: 84607

SEQ ID NO: 91239 - DNA, 601 bp, Human; identical to SEQ ID NO: 84608

SEQ ID NO: 91240 - DNA, 601 bp, Human; identical to SEQ ID NO: 28896

SEQ ID NO: 91241 - DNA, 601 bp, Human; identical to SEQ ID NO: 28897

SEQ ID NO: 91242 - DNA, 601 bp, Human; identical to SEQ ID NO: 28898

SEQ ID NO: 91243 - DNA, 601 bp, Human; identical to SEQ ID NO: 28899

SEQ ID NO: 91244 - DNA, 601 bp, Human; identical to SEQ ID NO: 28900

SEQ ID NO: 91245 - DNA, 601 bp, Human; identical to SEQ ID NO: 28901

SEQ ID NO: 91246 - DNA, 601 bp, Human; identical to SEQ ID NO: 28902

SEQ ID NO: 91247 - DNA, 601 bp, Human; identical to SEQ ID NO: 28903

SEQ ID NO: 91248 - DNA, 601 bp, Human
acagtggctcgtgcctgtaatctcagtgactcaagagcctgaggcagaaggattacttgagcccaggattttgaggctgcagtgagctatgatcataccactgcattccagcctccagcgacagagcaaaactctgtctctaaaaataaaaaataataaataggctgggcgcagtggctcacgcctgtaatcccagcactttgggaggccaaggtgggtggagcacctgaggtcaggagttcaagaccagcctgaccgacatggtgaaaccccatctctactgtgaatacaaaattagccrggcatggtggcgggtgcctgtaatcccagctactcgggaggttgaggtaggagaattgcttggtatctggaggcggaggctgcagagagccgagatcgcaccactgcactccagcctgagcgacaaagtgagactttgtctcaaaaaaaaaaaaaaaagaataaatactatatgacttaaattaactcttttgttttagcaaagccacaacacttgagaaaacctatggacctgcatggatagcctatggacattcatttgcggtggagagtgagcacgaccaagcgatggctgcttact

SEQ ID NO: 91249 - DNA, 601 bp, Human
aggctggccgggcgcagtggctcacacctgtaatcccagcactttgggaggccagaggggtgtggatcacttgaggtcaggagttcaagaccagcctggccaatatggtgaaaccccatctctactaaaaatacaaaaattagccgggtgtggtggctcacgcctgtagtcccagctactcgggaggctgaggcaggagaagctcttgaacccagaggcagaggttccaatgagctgagatcgcaccactgcactccagcctgggcgacagagtgagactccatctcaaaaaaaaaaaaaagaaaaaaattattgaggcttttttatgagccattctatagattgttccagattatttgagaattctgctcttgttgggtgaagtgttccatagatacctgttacatctgattttatagtgttgttgaagtcttctctttcctcattgatcttctacttatttattctctgcattattgcaagtgaggtattaaagtctccagattttattgttgaattgtgtatttctccctccaattccggcacatttcacttcatatattctgagtctctgttgttaggtgtgtacatgtttataatt

SEQ ID NO: 91250 - DNA, 601 bp, Human
gtggttgggtgcggtggctcccgtctgtaatcccagcactttgggaggccgagatgggcatattgcttgaggccaggagtttgagaccagcatgtgcaacatggcgaaaccccatctctactaaaaatacagaaattagccagggatggtgttgtacacctgtaatcccagctgtgtcaggaggctgaggcacaagaatcacttaaacccgggaggcagaggctgcagtgagctgagatcgcaccactgcactccagcctaggtaacagagtgagactcttaaaaaaaaaaaaaaaaaaaaggaatataaatactgtatctcccaaaatcttgaaatcttgaactcttgatattaatgccgtaaaattaatcatttgtgacttaactttgaatttttataattatttccagcagtttaccccattgcattttagtactactagaaaggtaatcaaaaatttttttaaagtttatatttgctaatttcgaataatctgcaaccttttttcctttcattttagatggaaaacagccgaaaaatggtttcttgatgctttggaaaaaattaaagcaattgggaacgaggtattctttgtagtac

SEQ ID NO: 91251 - DNA, 601 bp, Human
atggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgktgctcgggctgctgctcaagaagctcaaggacgagggctgccgggcgttctacctggaaggtacgcgcccagggaactccgcgcgcggggcagggctaggggcgcagggctgcgggcggggcgcgtggattgaaaatacctctgctccgctcagctggagcttcggagccgcgctgcccgcctagggaccggcagccggcgaggtaggggccgcgaaccgcgcgttccgcaccagagaaccgggccggctcagaatccactcgcttccggctgcgggtaccggcggtttctttctaacgg

SEQ ID NO: 91252 - DNA, 601 bp, Human
caaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcataggtgagactaattaatagtcgtcgctctgacatttaaatgcaaaattcctagccattcatagagtttaagctgttaatcgttcttgctgcttgctaatttgtctgactgcaggtctctamtgttcctagagcgtccttaattctggtttatcttcttgctaaaggaagaaaacctgccttttgacatggctgcagatcacaggtgtatttgaaacgctgtttcttgaatctttgaattcagtcattgacagtcgttcataatcggacaacagatttttccccccagtctttggactcaggggaagggtcagatagaagtactcactatagacaggaattccagcattgctttataatttaaaaacatctaggagttattttaggacatcaagttagttgttggaaagcagtatgaatgct

SEQ ID NO: 91253 - DNA, 601 bp, Human
agcgtccttaattctggtttatcttcttgctaaaggaagaaaacctgccttttgacatggctgcagatcacaggtgtatttgaaacgctgtttcttgaatctttgaattcagtcattgacagtcgttcataatcggacaacagatttttccccccagtctttggactcaggggaagggtcagatagaagtactcactatagacaggaattccagcattgctttataatttaaaaacatctaggagttattttaggacatcaagttagttgttggaaagcagtatgaatgctgaatgttatscagttgaatgatgcggtgatactggtaacagtgagacagtgggtaacctgagcccagcaggaagaactgtgggctggaagcctgggagaagtgaatctccaggcattgtaatgcatttcctattacaaaggaactcattttcaggccgtgtcgacatcctgttcctcctaatgggccgtcccctgtgacttccctctctcttttaaaatgcctgaatacctccattgttagctgcacaacatttggagcataatttaatagacccttgcagtctggttgtctgtgtaaaaggcattcacg

SEQ ID NO: 91254 - DNA, 601 bp, Human
aaaggcgatgaaactgaactgagacttaaaaaaaagattacccacctggttgtgcacaagcctgcttatgtcccaatctccagtctagggtctgatgctccttgctgcagtaatatgctttgtggcatctggagcacgttttggggcctaaacagccacaaaccctgcagagatgagcaccagacttaagctggagacacactgattctcctgtttctgggggaggattctcagaaggtggctcatatgagtaaaaatcgtttttcctgggtagttgattcctaaaaactaaaaaagaatrcagagaaaagttttatcttcaaacaaaacagcaattcacatattttatcctctgcacgtaaaactgaaaatactcaacaacaacaaaaaagaaatgaaagtttttgctttcaggaataagcttttaaaatccagaaactagatttcgtccggtacacgcaactgagttgcctcctagaggtggtttgagttaatcaaattaataagactgatcgttaagaacgactgccaaaaatacgaaaaagctactgggatccatctttccaagacaatttctattatctgaattaacaccatacct

SEQ ID NO: 91255 - DNA, 601 bp, Human
cccttctgcgtgcccgacactgtgctaggcactcacactatcccgacccgagaaacagatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagyattatgtttaaccacttaatgaatgaagtcctgaaactgcttacccatgctccctataatctctgagtaatcttccttttccacaacctcaggcataatctcatcttctgtttctattacaatttcaaattctggaaaaaggaagttgtggtctggaattatatggtccagatgatctgaaacaaaaaggacagcactattagtaatcatttagttttgaagacagtctaataatttgctgtctctaaagtactatattccctatagttctggcattttagataaagggtcataaattaa

SEQ ID NO: 91256 - DNA, 601 bp, Human
caatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaacttttaaggggcccttctgcgtgcccgacactgtgctaggcactcacactatcccgacccgagaaacmgatctgcgacccagaggaacttaccaagcctccagcatcttgtgcagccctactcatgggaccatctggatacccacccttgtctttacagggagcagaacacacctcttatgtgtcagaaaacaaagtccaggaagtatatttttacctgaggcaatatctgaaaattgtatgctacagcctccaaagtgagtcttcctctcagtacctctcttctaggcacatggagccctttcttccaagcattatgtttaaccacttaatgaatgaagtcctgaaactgcttacccatgctcccta

SEQ ID NO: 91257 - DNA, 601 bp, Human
gccccttccaggcagtcttcagtgatgtcacgtgttcccatggcacctgtattgtactcttatcagtcattatatggactttaacttccccagatattatttgggctcctccataagactgtgagcatctgaccactggagtgttgcttcccattatatccctgttatcaagcacaaggtcaggcacagagtaagactcaaaacatgttttggaatgtatgactggtatgaactacaaaccagtaagctgatgttttcattttgagtctataaatctaattttgtggtggttttgtgtatkgctcaaggctcaaattgtaaaatttaatattatgtgaccaaagaaagttatacccagaacctcaatttcctcaccttcaaaatggggcagtttctcactcattggtctgctgtcacgattttaatgagctcatgcacaaacagccctttatataaggtaagtgctggataaatgttggctactataataaaataagcctctaagatacttggtcagcacaagtactacccaagagtatgcactgtaagtaaactgacaaaattgtgtatctaaaactggccagatgaaagagaaactttt

SEQ ID NO: 91258 - DNA, 601 bp, Human
agtataaccgttaggacactgtaaatgctgttccctcaggccctactgcctcctgccaagtctcaggtaagacacagctacctccaggaagcatttttctattcaattctccttttattttagaaaattttggacatacagaaaagtggaaatactataatgaaccgccacatatcattaatcagtttcaacactatcaagtccagtgtttcctttctctgccacttccacctccattactctgaagtaaattccacacatatcacttcattcataattaagttatgtacccctcgaaggyaaactctttccttttatttaccaatttgaaaatgagtctgttcccaagtatcctataaagatgattactgagtttttttaaagtatcattttgaacccattaaacatatctgatgcagttagcgtccttgtggatgttcaaactgtccatcttttgcaagcaggagccttttcatgttgcttgagttctgacatggccctagtaatccttatccttaatctttgatatgaccatgttcccacattatatgaacgtttcctgacctagttctggaatcaaccacctctccaaagagcctgg

SEQ ID NO: 91259 - DNA, 601 bp, Human
tgattacacactaaatggtccttatttaaggtcatacctggaattccaatattctcttggcaccacaggggcaatctggaatatccttttcttgaggaatattttcaccagaaatccagatgggggcaatacctctgccatatctaagaatctaaaatcaatgaagatcatgttcaaataatcaataccttacctataagttgccaatggtaacatgctatctactccatgaatgttcctactcttgatgtagcactgacccaaaaggcatgtcacagttcccccatcagacctggctgtrccagtgtgccactaatgccttctcaatcacctcaaagtgattatttcagtttatctgactcagagggcatcaaaatatatctcccagatgatgcttttactacctaatgttggcaacttaatcctatgaatatattgtgaagggactaagaatggcctctgctctaattgcagaattctgcccagagtctgtgcctaccttcatagttaaaaaattttaggagggacaaataccaagtgaaacatagtgttttgaaaactactacaaacataagtaaatttcactgtaataagcttccta

SEQ ID NO: 91260 - DNA, 601 bp, Human
aacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctgactcaaagagtgaataggcagaatagccaccctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaacaaatccacaaaccaagattaaacagtaaaga

SEQ ID NO: 91261 - DNA, 601 bp, Human
acattatacaattaacatgtttaacaatctaaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatcttagaagtagtctractcaaagagtgaataggcagaatagccaccctgatatggaatcactttatacaaatcctgtcacctcaatttggacattgagagctttggcactaagaaccaagcagagttttgtgtatggtcctcataattccttttttacccaaagaaacaaaccaatattagctatgactttggtaaggttagtgaatccatagctcaagagcatttccaccctacccaaatggattttgatgctaacaaatccttttgggcagggaaggacatttatctttaatgcttatatccattttttctaa

SEQ ID NO: 91262 - DNA, 601 bp, Human
ttaacatttttcaaggctttaagatgcctttacggtgtatctgttacatcctgcttccacacaaattcttctgtatagccagtacccaagctgcagctctcagcacaggtgaagacagccaggatgccccagtcaatgctcttgcccagtctgtcagccttcaggtagtttaggagctgaggcatgacctgagaagagggtgacacacagttagaaagctgcttcacagcagggagcacgagaccttctcagccaggatgattatagggatcttggtctttcaatcctcatactacaaagyaggattatagacattatacaattaacatgtttaacaatctaaaacttccttatgacttcaaagcccctctcaccttctgtttggtcttttccatttgagaaagaagttcacaagtggctgttaatgaattattttcattactaatatgccactcaaaagggctgaggcttctatttgggcaacttttactttgtatcattgcagatgttgttactcttgactcaagaaacactaattactagtaatgaatacagaaaggacatctatcaatgtagttatagagaccagagaggaatctta

SEQ ID NO: 91263 - DNA, 601 bp, Human
actcgcgcaaggtactactaatacagaacaactaaataccccatctgtgcccttgaggatcaggtatagacagtggtactacaacgcaagctctatgagtttagagaagatgagatttttttttcttgcttcatttctttatatccaagtccttatataacgcctatataatgcttatttctttatacccaatcccttatataatgacaaatagatggacaaacagtaaatttttccctctgtggctgtacaatttgacagcttatcaaagagacttacagtagaattccaaaagcagacygcctgggttctaattctggctttcccgtttcgcagatatgagactgtgggtaagttacttctcaaagcgtcaatttcatcatatatacaacagagatcactgcagttgctacctcattagggtgttcaaaggatcaaatatgtaagcccttatagcagtccctgacatgtaactggtcctctagtaagtgttagctataagtgctatggcactggagtatgactaagcacctgggctctggaattacatgagacagagacccactcttgctacttactaggtatgtgatcttggacaaat

SEQ ID NO: 91264 - DNA, 601 bp, Human
aattaattctccagggtggtaatcctatccctacaaatagaagaatgctccatagtacataatgggataaaatactctagatgtcaacaaaaacatgattcaaatgggaagaggaaagatgagcgggaagagaatgaacgcctggctacgagttgtctgggaaaaaaaaattattaataagcctaaatcagggcaaagtctccttggcaggagttaacagaaaagccaatgaattatcatcaccaacacattaaatacttactcgcgcaaggtactactaatacagaacaactaaataccmcatctgtgcccttgaggatcaggtatagacagtggtactacaacgcaagctctatgagtttagagaagatgagatttttttttcttgcttcatttctttatatccaagtccttatataacgcctatataatgcttatttctttatacccaatcccttatataatgacaaatagatggacaaacagtaaatttttccctctgtggctgtacaatttgacagcttatcaaagagacttacagtagaattccaaaagcagaccgcctgggttctaattctggctttcccgtttcgcagatatg

SEQ ID NO: 91265 - DNA, 601 bp, Human
attccagatgaattacaggtggatcaaagactttaaaaatgcgactatgaatggactaaataaatcatgggtgaattttttttactatcttgggctgaggaagatacgtaggtaggttaattgactgatttttgagacggagtttcgctcttgtcacccaggctggaatgcagtggcgcaatcttggctcactgcaacttccgcctcctgggttcaagcaattcccctgcctcagcctcccaagtatctgggattacaggcacccgccaccacacccagctgatttttgtatttttagtasagatggggtttcaccatgttggccaggctggtctcaaactcctgacctcaggtaatccacctgccttggcctccaaagtgctgggattacaggtgtgaaccactgcacccagcctcgtgaaggtagatttaaacaacacaatccaagggccacacagaaaaatttcataaatttgactacataaaattctacagggaaatttaagaatagctttttaaaaccctaagaaaatatattagtagcatctaaccccaaagtctaattttaattctataaaaattcttacaaataaggaaagca

SEQ ID NO: 91266 - DNA, 601 bp, Human
aaatgtaagtcactatggctttcaatgtaagtttctaaaaaagcattaacaattgataaatactgagtgaaatcctttctacacattcaaaaagcatgtgtcagttaaataaatatactatatactccagtaaccactcataagtgtaaataatctcaagtgttattcatgaataggcaaaacagaatgtgatcacccctgacttctggcagctggctatcaactgaagctggtcaggtgacagacgttaatggtgcatgttgtgcctcccatccaagctcccagcttattcattctttcrtatttctactcatgcatcctgccaactaagagcacagcactgtaaagaggaaaagcttgtcaactgatggtgatgcaaaccaagctcctgtgtcaaatctttcctgggctctctcctgccacagaaattgatttgctttgtttttgagggaagagtatcttcagaagaagaactcctcccaggctccttctaaaagggtagagaacccttcatatgatacaagactttaacaaatggaatgtgctgctgtttcacattatgctactttaatgaccctgcattaatgatatcatttcattt

SEQ ID NO: 91267 - DNA, 601 bp, Human
aggaatgcctttccaagataaaaactataaaaaattattcataggccgggcacagtggctcactgctggcctgtaatcccagcactttgggaggccgagatgggtggatcacctgaagtcaggggttcgagaccagcctggccaacatggtgaaaccccgtctctactaaaatacaaaaattagacaggggtggtgacaggtgcctgtaatctcagctactcgggaggctgtggcaggataatcacttgaacccaggaggcagaggttgcagtgagccaagatcatgccattgcactccascctgggcaacaagagtgaaactctgtctcaaaaaaaaaaaaaaaaatttcattccatttcatttcgaaaccaagcaccaacatttatttacttcaccacctaataaagtatgagagaaaaacttcaggaaggggtgtgtattatgtagaattcaccattccttgttttattaacaatatcatgtttacttttgtcttctaactcccatttataaaataagcattaggaattatcatataaatatgccaataaatgtaagtcactatggctttcaatgtaagtttctaaaaaagcattaac

SEQ ID NO: 91268 - DNA, 601 bp, Human
ctggtttagactctattttccataccacccttatctcaggtactgctaatccaagagctaatgtgtatgaaagggcacatgaagtggcctaaggaagatgggtttaaatccatctctctccctcactctgcatatagaccaggggtcaacaaactacccctgtagtttggctcaggggccaaatccagcctactccctattgctatgaatattgtccgtggctgctttttcactacagaagcagatcaaatgaggcccataaagctgtaaatatttactatctggtcctttacagaaaaaattacggcaatccctgatcaaacctagatgtaagtccctctctttgtggagcagatctctgtgagaacagaagacacagggcagcacccttactctgcatgattttaatacacagcagtggtcgtgatccttaaaacatctacagtagagaacacaagcatccaaaacagggtcttagcatgacaatacagtgactgcaaatcctagctttactatacctttgcgagccctacactacccactggtagagaaacttcacaaaaattataaacataaaatgaattcaagatcaccaattttt

SEQ ID NO: 91269 - DNA, 601 bp, Human
ttttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacattagcttcagtttcttcatcactttcattatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaaagtcacaggcatgtagaggcagaggccattatagactagaacaatcaacagtataaagtgaataaataaatgcataccacagtggaaggggaaagcatgcctatttccttcatgatcaaccaaca

SEQ ID NO: 91270 - DNA, 601 bp, Human
gttctgaaaacactggagtagatgcttattattaattaccccaaatgacttctagaaccgttaaagaacttttttgaagtgtatttgttaataaaaaaattttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacattagcttcagtttcttcatcactttcrttatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaaagtcacaggcatgtagaggcagaggc

SEQ ID NO: 91271 - DNA, 601 bp, Human
acaaaatcagagaggtgtttcaaaaagttctgaaaacactggagtagatgcttattattaattaccccaaatgacttctagaaccgttaaagaacttttttgaagtgtatttgttaataaaaaaattttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacaytagcttcagtttcttcatcactttcattatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaa

SEQ ID NO: 91272 - DNA, 601 bp, Human
gggcaatggaaaaaaaagatagaggactgctttattattcacacaaattcctctataaaataaaaattagtttaaagaacacttaaaagccaaccagacagacaagcttagaaagacagttctagagacacctgaggttgtcaccaaaactagcaacactgttacatggaaatcaaagaacagggctctgaagtgaaacaaaagccaaacctgaatcttaggtctgctgcttagtaggtatcagctttcccagattagactctctaactctcggaaaaactcaaaggatgctgtctggccygctgaaattcaatggcagctcagctatttttaatgttgctaaaatctgaatctattaatctgacattaaagccaggcataatgtaagtcaaaaaagacaccagaagcatccagcttgctaagttaggcaaattaatttgtagctagactctaattacccatgttaaaggtaattcatttctatttttactatttctacactttactttttctcttggttttcaagtaaggttgaaagccttaaaaagaaattgtgtcaacctaatttgtctacgcctaaaccatggcaggtaaaatgatc

SEQ ID NO: 91273 - DNA, 601 bp, Human
agagctaagaaccatcatctaccagaacaaaacaccaaaagatatctcaaaagagtgcagtacaaatacagagttttggaaaatggaggtaagtaccaggaaatacaggtaaaagagctgaaaactgtcttagggcaatggaaaaaaaagatagaggactgctttattattcacacaaattcctctataaaataaaaattagtttaaagaacacttaaaagccaaccagacagacaagcttagaaagacagttctagagacacctgaggttgtcaccaaaactagcaacactgttacatgraaatcaaagaacagggctctgaagtgaaacaaaagccaaacctgaatcttaggtctgctgcttagtaggtatcagctttcccagattagactctctaactctcggaaaaactcaaaggatgctgtctggcccgctgaaattcaatggcagctcagctatttttaatgttgctaaaatctgaatctattaatctgacattaaagccaggcataatgtaagtcaaaaaagacaccagaagcatccagcttgctaagttaggcaaattaatttgtagctagactctaattacccatgttaaag

SEQ ID NO: 91274 - DNA, 601 bp, Human
aattaatgacaccagaaataaaagcaatcagtaaaggatgaaaagctaaaattaaggaaatcttcataaagtagaacaaaaaagacagacatggataacatggggagtcaaaaataaagtaccgggtcataatccaggtggttgtggagaaggtgcagaggggtaggggaggaggagaggaaagaaggtggagaaagaggataaaacaaataagaaactctaggcaaggaacatcactatacaatttcagaacaccagggtaaagaaaagatcctaaaagcaaagtctcaaaaaggtcccrttttgtttttttcagaaatcttttaggaggtaagcctctaaaataaggaaataaatcaagaaagaggagaacacaggatgtgggggaatctcaggatggcagtggtccatcctggagcaaagggaaaagggatccacctagtatgtgaggtctgacaaccagatgaattgtactcagagaatgtacaaggaactgacaaaaagtttaaagaaatctgagccaattagagatagttaacttaagaaaaaaataaaaacgagttacacaagaaagaaaatattaatgcatgctacttggcgc

SEQ ID NO: 91275 - DNA, 601 bp, Human
aatttataaagtcaataaacatatgaaaacatgcccaagaatatatataaatgaaaataataaactgttcaataggcaaaaagatgtttcaaaatgtgttaattctaatactgggaaggttatataaaatcgggtactcagggtactggcgtatccttcagaaagagtatactcaacaaaatacaaaaaaaaatttatctgacccaatacttcaactactcgaagtttattctagcaagacaagcataattggggaagtacacaaaaatgtatgtacaaggatgttcatcatagtgtttayattaagaaaacaggaagccaaaatgccctttagaggactggttaggtaaatgatgctatgtattacagcagcaaaaacagaagacaaaaaaattttttgttaattaaatacaaaaatcattatgcatatagcttagatctccttgataatacataatgtatagttacagaaaaacagataccaaagtcctacttacataaaactacatgagtgtatgtataaacatgtactgattgttttcactacagaaaaactaaagccacttttaatttgggagaaaaatttttaaaaggcatgaga

SEQ ID NO: 91276 - DNA, 601 bp, Human
tgttgcacatgtgacagccagaacccagtcaccattgcacaggtgccacccagcagacagccccaatccccgtgttggtgtgttgttcaagggtaaactgtaggcttgggagttaaaatacaatattgagtaacacagaaagggtgggtaagagggagaaaggcatttttatgatcttcaggtaaagatgacaagagaattaaccactgcagatgtaaaacagttggaagccatgagaatacacaaaaataatccaagccatggtagtaggtaaggacccgtaagagagtagggagaacasagagagagatggtgaggtttctgtaggacacatcagccaaactcaaacagtcatttgtaagaaagtctttatttcttggctctcctaagctaacgaagaggagaacttgaaggaaagcacgacttatgtatatagacaggtccaagggacacatccgcaagacacagtaaaacgaagagaattctgtaacctgtaaaatacgatactgcttttgtttaaaagaataagaaaactatttgtacaagcacaaaaaagtctggaaagataagtaactgtggctggtcatctttgagctctgaa

SEQ ID NO: 91277 - DNA, 601 bp, Human
gacagatgattctccttgtaaacagatgatgtaaacttacagtatcaacaaatacagtattgtaaatgtattttctcttcctataattttcttaataacattctctttcctgtagtttatttatcataagaatacagcacataatacatatgtaaaatacgtgataatccacagtttacattattggcaaggcttccagtcaacagtaggcttatttgtaagttttcttggagtcgaaagttatatgtggattttccagtgctcggggaactggcgccccaatccccgtgttgttcaaggstcaactgtatgcttgggagttcaagtacagtattgggtaacacagaaagggggggtaagagggaaaaaggcatttttatgatcttcaggtaaagacagcaagagaattagccactacagacataaaagagttggaagccatgagaatacaggaaaacaatcaaaaccatgggagtaggtaaggacccacaagagagtaggcagaacacagagagagaccatgaggtttctgtaggacacgtctgccaaactcaaacagtaatttataagaaagtctttatatcttggctctcctaagcta

SEQ ID NO: 91278 - DNA, 601 bp, Human
gcaggaggaattagggaagtaaacttgtaggcagaaaggatgttaggaaataaatccaataatctaataatgtaggtctgaatttagccagcagtaatcacaaagagggacgaattagaaatacaggcggcctttgaataacaccgttttcaaccactcaggcccactgacacataaattttcagtaaacacactgagaagtttttggagactcgcaacactttgaaaaactcagatgagccaagtagcctaaaaataccttaaaaattaagagaaaggtatgccacaaatgtataaactrtatgtagatactagctattttatcatttactaccataaaatacacataaactgattataaaaagttaaagtgatctctcaatgttctcctttgtttttcattgtgtttagtgcgattattataaaccttaaataacaagtggcccaaacaaagcactattagtgatgctggaactgctccccaagaagcagggaaagttatgacatcacaagaaaaagctgaattgcttgatatgtactgtagattgaggtctgcagctgtggttgtccaccactccagacagatgattctccttgtaaa

SEQ ID NO: 91279 - DNA, 601 bp, Human
atctaaaataaccaaataaccagggttagaacagttccaacactatttatatagaacaaggacttgcaataaaaacaaaacaaaaataaaaacgacctacacaatgaaagccagatattatacattaaaaatgtagtagaagtattttttggtgagcagcaaggcatattccatcaatatttaggcatagaatgtgccattccaagcatggaccatgatctagtttcttgcagtagcagccaattggactaacacaatgctacttcttttactgttcaatcaaattcctccactgccttarggaatcaactaccccattttaccgtcagagataataagctttgttttcgtagcacagaacattcactccaattataatgtcctaccttttcttcctcatggaggaaatttgataaaaaattaagtttatcagaaacttctgataaactgataaactgataaatttattaaccttcaataaataattcataaagttcaaacaagtttcatgatcgctaacattcaaatccatttccaaaactggagttatacaatattacttctgtgcatgagattatacttattgttcactagatttatg

SEQ ID NO: 91280 - DNA, 601 bp, Human
aaaaatgataccattacataagatttcaaagtgttaatttgggttgaattaagtttatcagaaaggtaccctggctgggtgcagtagtgcacctgtagtcccagctacttgagaggctgtggtgggaggattgctcgagtccaggagttggaatccagcgcaggcaacatagcgagttcccatctttaaaggaaactgcatactgacattttcttcagttcactttctaataattgtcagatcaaaagtgaaagcaacgctgtatcttcatgctgaaaaatgattgctgttcctacttagygaaaatgttattcaatgactaaataacttttgtgatgtataacaatctcccattgatgtaaataaaacatctaaaataaccaaataaccagggttagaacagttccaacactatttatatagaacaaggacttgcaataaaaacaaaacaaaaataaaaacgacctacacaatgaaagccagatattatacattaaaaatgtagtagaagtattttttggtgagcagcaaggcatattccatcaatatttaggcatagaatgtgccattccaagcatggaccatgatctagtttcttgca

SEQ ID NO: 91281 - DNA, 601 bp, Human
acctgattaagagattattgggcatgtggataataggacccatgaatcttgcctctgtcactaatcagggcccaatttcttagcaaaagaataacataataccgtgaacatctttccacagttaggtgtcatgtttcttttatttatttatttatttatttatagatggagtttcgctcgttgcccaggctggagtgcaatggcgcgatcttggctcaccgcaacctccacctcccgggttcaagcaattctcctgcctcagcctcccaagcagctgggattacaggccatgtgccaccayacccggttaattttctatttttagtagagacggagtttctccatgttggtcaggctggtctcgaactcccgacctcaggtgaccgcccaccttggcctcccaaagtgctgggattacaggtgtgagccactgcgcccagccatattttatcttctattctctcttttctttttgaatagagatgagggtctcgctatgttgacgaggctggtctcaaactcctggcctcaagcgatcctcccaccttagcctcccaaagtgctgggattacaggtgtgagccaccatgcccggccagtat

SEQ ID NO: 91282 - DNA, 601 bp, Human
cactgcagcctcaacctcctgtgctcatcctcctgcctaagcctcccaagtagctgggaatgcaggaacatgccaccctgtccagctaagttgttaattttttgtaaaacaaagtctccctatgttgctcaggctggtcttgaactcctgggttcaagtgctcaggtaagcctcctgcctcagcctcccaaagtggtgggattataggcatgagccaccccacctagcctgagtaaactttatagtatataaattgtatgttaataaagctgttaaaaatatacccatttttaattttttwaaatttatatttatagaaattaattatacacacacacacacacacacacacacacacacacacacaatttgcagcaggcctgagacatgacgaagccctgtagcagccactagaggtagtttcctgatgacttcacctcataaatcagtgctctcatggcacaattgctaaattagctatgaatcaatcaaactctattacaagcagctcacatttctccactttgaaaaaaaaaaagatgaactttttcattgcctgaaaattgcacatattctatctataacataataatacatgaat

SEQ ID NO: 91283 - DNA, 601 bp, Human
agaccctgtctacattaaaaaaaaaaattacttgttctgttaattagtagcaatgtggacttggacatttaattctctgaaactgactcctgagacataaagtggttatcaacatctaataaattgaactaggattaagaggaacaatgcaacacaagtaaaggaatatacacacaagtatgtgaagatgtaggctgttcctcgcaacatcatttataacagcaaaagttgacaccagtccagatgttcatcagtggaggattgttcaagtaattcatagtacatttatataatatacatytaagtcaaaaagaatgatgcagttctttttttctgagatggagtttcgctcttgttccccaggctggagtgcaatggcacgatcttggctcactgcaacctctacctcccgggttcaagtgattctcctgcctcagcctcccgaatagctgggattacaggcatgcaccaccgtgcccagctaattttgtatttttagtagagacaggatttatccatgttggtcaggctggtctcggactcccgacctcaggtgatccacccacctcagcctcccaaagtgctgggattacaggcgtga

SEQ ID NO: 91284 - DNA, 601 bp, Human
tttttatttttttatttttattttttgagatggagtctcactctgtcacccagactggagtgcagtggcgcgatcttgcctcactgcaaactctgcctcctgggttcaagcaattctcctgcctcagcctccccaatagctgggattacaggcacccgccaccacgcccagctaactttttttgtatttttagtagagagggggtttcgccatgttggccaggctggtcttgaactcctgacctcatgatccacccacctcagcctcccaaagtgctgggattacaggtgtgagccaccgygcccagcctttttttttttgagacagaatcttgctctaccacccaggctagagtgcaggagtgtagtggtgcaaccttggctcactgcaacctccgcctctcaggttcaagtgattctcatgcctcagcatcccaagtagctgtgattacaggtgtctgccaccacgcccagctaatttttgtatcgtttagtagagatggggtttcactatgttggccaggctggtctcgaactcctggcctcaagtgattcacctgccttggcctcccaaagtgctgggattgcaggcttgagccact

SEQ ID NO: 91285 - DNA, 601 bp, Human
acttcctagcctataacctagatttacctcaaatcgtagctatgatgatttaaaaaaaaaaaaaaaagttccttagtaagcatactaagcatttatacaaatgccagggattattaagtgaacaataaaacaggtaacctcttattaacaacttcacctagaggatcaaattttaaattttacaaatcagacttcaagatttctttagaagggtattgttgctttaaatttatttttatttttttatttttattttttgagatggagtctcactctgtcacccagactggagtgcagtggygcgatcttgcctcactgcaaactctgcctcctgggttcaagcaattctcctgcctcagcctccccaatagctgggattacaggcacccgccaccacgcccagctaactttttttgtatttttagtagagagggggtttcgccatgttggccaggctggtcttgaactcctgacctcatgatccacccacctcagcctcccaaagtgctgggattacaggtgtgagccaccgtgcccagcctttttttttttgagacagaatcttgctctaccacccaggctagagtgcaggagtgtagtg

SEQ ID NO: 91286 - DNA, 601 bp, Human
aggaagtccccaggactgttaaaattctttacaatataaataattaactctgtaaaagaaagaaagaaaggaaagctataaagtggttaatacagcagtaccatgtattagaggaaaagtccattgatataggggttaagagattcaggttatagttctgactccattaaggattactccgggttcaggacaagttacttaatctctccatgcctacttcctagcctataacctagatttacctcaaatcgtagctatgatgatttaaaaaaaaaaaaaaaagttccttagtaagcatacyaagcatttatacaaatgccagggattattaagtgaacaataaaacaggtaacctcttattaacaacttcacctagaggatcaaattttaaattttacaaatcagacttcaagatttctttagaagggtattgttgctttaaatttatttttatttttttatttttattttttgagatggagtctcactctgtcacccagactggagtgcagtggcgcgatcttgcctcactgcaaactctgcctcctgggttcaagcaattctcctgcctcagcctccccaatagctgggattacaggca

SEQ ID NO: 91287 - DNA, 601 bp, Human
aagtgaaaatgatgcttcaaggaagtccccaggactgttaaaattctttacaatataaataattaactctgtaaaagaaagaaagaaaggaaagctataaagtggttaatacagcagtaccatgtattagaggaaaagtccattgatataggggttaagagattcaggttatagttctgactccattaaggattactccgggttcaggacaagttacttaatctctccatgcctacttcctagcctataacctagatttacctcaaatcgtagctatgatgatttaaaaaaaaaaaaaaaagttccttagtaagcatactaagcatttatacaaatgccagggattattaagtgaacaataaaacaggtaacctcttattaacaacttcacctagaggatcaaattttaaattttacaaatcagacttcaagatttctttagaagggtattgttgctttaaatttatttttatttttttatttttattttttgagatggagtctcactctgtcacccagactggagtgcagtggcgcgatcttgcctcactgcaaactctgcctcctgggttcaagcaattctcctgcctcagcctcccca

SEQ ID NO: 91288 - DNA, 601 bp, Human; identical to SEQ ID NO: 30873

SEQ ID NO: 91289 - DNA, 601 bp, Human
gagatcaagagtcactcctaggataagggaaggaggctgtttgtggcatgagaatgtgcaggataaagacatggaagcgaatggcttctcagttgtgtgagtttaaaattcatgacatttacaaattgtcagaaaaggtgttatatgtttgttatataacaatcactttggaatgttaatctgattctgtgccaaaatctgaattactcagggttctccagagaaacagaactaataggtggtacacatatacatatatatgtacgtacacatacatacatacactgtatacacatggatmcacacacacataggaagagatttacatatatgtatacaaaagagagagagagtagagatttattttaagaaattgactcacactattgggaggagtaacaagtcctaaatcttcagagccggccagcaggctggagacccagggaagagttgatgtcttagtcttgattccaagggcagactgtaggcagaattctttcctctttaggggacatctgaggctttttctcttaaggccttcaactgattggatgaagcccaccactatggagagtaatccactttactcaaggtctactga

SEQ ID NO: 91290 - DNA, 601 bp, Human
cgggaattctgagctccatcctagtcttaccctgtgctaattcagtctgggtcatttcttgaattttctggtaaattctcctttctaccctttctaactatatgtatttgtcaggttaagctagaagtgttaattttttttttttttgagatggagccttgctttgtcacctaggctgaagtgcagtggcatgatctcagctcactgcaagctccgcctcccgggttcatgccattctcctgcctcagcctcctgagtagctgggactacaggcacccgccaccatgcttggctaattttktgaattcttagtagagacggggtttcaccatgttagccaggatggtctcgatctcctgacctcgtgatccacccgcctcggccccctaaagtgctgggattacaggcgtgagccactgagcccggacgaaatgttaatttgttttttttgagacggagtctcactctgtcatccaagctggagtgcagtggcatgatcttggcttgttgcaacctctgcctctctggttcaagtgattttcctgcctcagcctccagcatgactgggattacaggcccgcaccaccatgcccagctaatt

SEQ ID NO: 91291 - DNA, 601 bp, Human
cattgccatttcagaggtgaggaaatagaggcacagggagttgagtggctccagttcaggcaacacaccaggtgggggtggggggctggggagagacctgggacgtgagcccagacagcttgagagctttcagagtctatgccaacagcaccaaccagtgctgggtaaacacctgcttttatcatcagaacaaagaggctgtgtcccctgccctatgaggtccatttctgagagttgtggctaatgggcaagaaggttggggctttagagatttgggataaagatatcaaacaccagaaargtagaaagaagtgatcagattagggttacttaggtgatgatatgaactcttcctagaactgagagaaaaagagagccttcctttactcatatgaaatcacaaataatttctatccaatttggaagtacactttggtgtagttgtgacagcttcctcaggactcagcataaattcaaacaaataattgtccttagaagagatgctatagaagagatagaaatatattcatattctgtagcttttttttttttgagatggagttttgctcttgtcacccaagctggagtgcagtgatgcaat

SEQ ID NO: 91292 - DNA, 601 bp, Human
gaaggttggggctttagagatttgggataaagatatcaaacaccagaaaggtagaaagaagtgatcagattagggttacttaggtgatgatatgaactcttcctagaactgagagaaaaagagagccttcctttactcatatgaaatcacaaataatttctatccaatttggaagtacactttggtgtagttgtgacagcttcctcaggactcagcataaattcaaacaaataattgtccttagaagagatgctatagaagagatagaaatatattcatattctgtagcttttttttttttgagatggagttttgctcttgtcacccaagctggagtgcagtgatgcaatctcagctcactgcaaactttgcctcctgggttcaagggattctcctgcctcagcctcccgataactgggactacaggctacaggcatgtgtcactactcctggttaatttttttttttttttttaagactgagtcttgctctgtctttcaggctgatgtacaatggctccatctcggctcactacaacttctgtcccccaggttcaagcgattctcctgcctcagcctcatgagtagctgggattacaggc

SEQ ID NO: 91293 - DNA, 601 bp, Human
ttctcaagcctcagcttcccgagtagatgggattacaggcgcccgccaccacgcccagctatgttttttttttttttgtatttttagtagaggcggagtttcaccatgttggccaggctgatttcgaactcctgacctcaggtgatccgcccgcctcggtctcccaaagtgctgggattacaggcgtgagccaccgcgccgggcctcacgttagctttatttggcggaatgcaccccccaagtggaatctaccaatgaaccagtcctgggagggagctggcgcccacccggcccgacgggrccccgctcctcacccgcctcccgccactggttaccatgacaaccggggactcgtctcctggcagtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctgga

SEQ ID NO: 91294 - DNA, 601 bp, Human
gccaggctgctctgaaactcctggcatcaggtgatctgcccacctcggcctcccaaagtgctgggactacaggcgtgagccgctgtgcccgacctaagatcttggactcccggatcccagagcaaaaccagagcgtctgaccccatggatccttccctcacctggtcagagcgactggacaggacggggcggctggctgcactgctgggggccactttgctctgttgtgtctcagccccaaactgtaaagcatccaaagcaatcaatcatcaggtctgacaaccccagccaacccctcttytctttcctcaccctcctctttccctctactgaccaagccaacgctgctgaggtcaaagaggctgaagggcttgctgaccacagcttccgtctggatgaaattcctcagcatctccgtggatgtggtctgtacatagccatagtcctagtggtaaaggaaggacagtctgagtgatcagtggagggaaggggtaaagagggggagtggggccaggcatggtgactcactcctgtactctcagcgctttggaaggccgagacgtaggagaatggcttgaggccatgagttcaagaccagcct

SEQ ID NO: 91295 - DNA, 601 bp, Human
gtttcccaagtcccatctgtcctcagctccaggtttgggagctcaaacttacattagatgctatcagtacagacaatctctcgaccacatccaaaaaaacttcattcttttggctctgagaaagagagagaatttgggtggttggaagcagaatagcctatgttctgaaatggacagacagggagaaagaacaggacagtcaaagctacagctctagggtgaggacatgggtgatggaagggatcatctcccacctccacccacatctgggggggtgggagatgtgccaagatctttttctttttttttttttttttttgcatttttagtagagacaggttttcaccatgttggccaggctgctctgaaactcctggcatcaggtgatctgcccacctcggcctcccaaagtgctgggactacaggcgtgagccgctgtgcccgacctaagatcttggactcccggatcccagagcaaaaccagagcgtctgaccccatggatccttccctcacctggtcagagcgactggacaggacggggcggctggctgcactgctgggggccactttgctctgttgtgtctcagccccaaactgtaa

SEQ ID NO: 91296 - DNA, 601 bp, Human
tcaaactcctggccccaagtaattctcccacctcggcctcccaaagcactgggattacaagcatgagccactgtgcccggccgttgctgggagtcttagccaccccaccatgtttcccaagtcccatctgtcctcagctccaggtttgggagctcaaacttacattagatgctatcagtacagacaatctctcgaccacatccaaaaaaacttcattcttttggctctgagaaagagagagaatttgggtggttggaagcagaatagcctatgttctgaaatggacagacagggagaaagracaggacagtcaaagctacagctctagggtgaggacatgggtgatggaagggatcatctcccacctccacccacatctgggggggtgggagatgtgccaagatctttttctttttttttttttttttttgcatttttagtagagacaggttttcaccatgttggccaggctgctctgaaactcctggcatcaggtgatctgcccacctcggcctcccaaagtgctgggactacaggcgtgagccgctgtgcccgacctaagatcttggactcccggatcccagagcaaaaccagagcgtc

SEQ ID NO: 91297 - DNA, 601 bp, Human
ctggcagctgcatctgaagggagaagcagcaggtgccctggccctgtcttccgtcccatagagctgaactcagccaggccagcctcactcttacctctttgagagcaggtcacatcgcaactttagataaacctggagcctggatgagagggtaaaacaccacgactcaggccatcttctactggcatctcaccattccccaccagggacctccatgtggggctgtgtgggtgtgggctgtactcccaagagggaaaagggctgaagcccagcccaactccattagccaaagctttttccttttttttttttcagagagatggggtctcactatgttgcccaggctggtctggaactcctgggctcaagtgatcctcccgcctcagcctcccaaagtgctaggattacaggtgtgagccaccggccgcaacccaagcctttttccaatttgcactccatcaccactaccaccacccccactctgcagtgagtcttgggaacatacaggtcttggcttgggttccaaggtagttctagaacccaggaaattgtctcaccggcctgagcctcggtcccactgcacagaggggaagagccggaa

SEQ ID NO: 91298 - DNA, 601 bp, Human
gaggaaggagggcaagaagctgaccacgctgggggaaccaggcagcagctgcttcgggagggtggggtgggggctgcaagtgaatgtgggaggagaggggctgggggtccacagcgaatacctggaaaaggcctgagagttgagagcctccttgcacccgaggcaggtcccagcgaagggctccctctgccagctcagccttctgctctgggctgctcagctcctgagacaggctggagtttggaaagggaaggtgctgggcttggcaccttcttgaggcagacccgtcatgctgagctcrctctctccccaggaatctccccgtggtgggtgcacacactcacctgaccacccctcgaggcagggggaggtgcagcctgacattgagggcttggctacagaggagacgggaacaaagtcagccccaggaaggcacagtcccttgtcctgttcctcttcaatgtcataacaggatttcagcacaggtgccccccaccttcccaaattctacagcctctaccttaactggcttctgaggctggcagctgcatctgaagggagaagcagcaggtgccctggccctgtcttccgtcccatagag

SEQ ID NO: 91299 - DNA, 601 bp, Human
cgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacggcgaaagtcgggcctgccccgccctgcggccccggaacaaaagaacgcgtgtgcgctggccctttaagagcgattctcctccgcccgcgccagctcggaccgcgggaaacccggcgcctgcactaccccgcccggagatwcccttccgacgcccgcaccgcctccccgtcactcattctaggcccgcacggtgattggcttgcggctagcgggaggtgaagaaggccgccttgtccgattggcccgcacgcagtggcgccggtcacgtggggggcgacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaagggtacgggtctacgagccc

SEQ ID NO: 91300 - DNA, 601 bp, Human
ggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtgagtggttagagaacaatggcaaacaaagggcgaggcgtttaagcttctgtagagaggctgctcagatactgatgttttctgagcaggcagaaaggaggggcacttctgcctggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcaacaagcctcgtgtgatccgggaagtgcgggctgactctg

SEQ ID NO: 91301 - DNA, 601 bp, Human
ggtgttctctgtgctctcctttccccatcctgttgctcttttttttttttttttttgttcttctcctttaggtggtaaataaagatgtcctggacgtttacattgagcatcggctaatgatggagcagcggagtcgggaccctgggatggtccgaagcccccagaaccagtaccctgctgaactcatgcgcagattgtgagtggtctctgtcgggaaagatgtagggattggttctccaggatcttgtttgtgactgttttctccccttagtgagctgtattttcaaggccctagcagcarcaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccggtacgtgtggagcaagaagcaggaaagcacttacccattagttgttttgtagagattaatttgatcctgtgatgcctattgttttatttggttgtaaaagttgcctgtgtgttcgcctttcattcttgggtatgtagtggtctttctac

SEQ ID NO: 91302 - DNA, 601 bp, Human
ctttgcactgcagaattttgaagcgccattagctttgaggagggttcatgctcagttgcccaggcaggagtgcagtggcgcgatcatacctcactgcagcctcaacctcctgggctcatgtgatcctcccgcctcagcgtcccgagtatctgggaccacagatgcgcaccaccaagcccagctaaggtttctattttttctttctctttttttttggagacacggtctagttctgttgccaggactggtctggaactcctgggctccagcgatcctccagtcttggtctcctgaagtgctrggattacaggtgtgagccaccgcgcctggtctttttttcttttgagacagtctcgccctgtcgcccaggctagagtgcaggggcaccatcatagctcgccccagtcttgaacccctggttctagcgatcctcctgcttcagcctcctggagtgctgggaatacaggcgtgcacgcccctctaaattttttttggttttttttgagacggagtcttgttctgtcgcccaggctagagtgcagtggcgtgatctcagctcactgcaacctccgcctcctgggttcaagcgattctcctgtct

SEQ ID NO: 91303 - DNA, 601 bp, Human
tttgaagcgccattagctttgaggagggttcatgctcagttgcccaggcaggagtgcagtggcgcgatcatacctcactgcagcctcaacctcctgggctcatgtgatcctcccgcctcagcgtcccgagtatctgggaccacagatgcgcaccaccaagcccagctaaggtttctattttttctttctctttttttttggagacacggtctagttctgttgccaggactggtctggaactcctgggctccagcgatcctccagtcttggtctcctgaagtgctaggattacaggtgtgakccaccgcgcctggtctttttttcttttgagacagtctcgccctgtcgcccaggctagagtgcaggggcaccatcatagctcgccccagtcttgaacccctggttctagcgatcctcctgcttcagcctcctggagtgctgggaatacaggcgtgcacgcccctctaaattttttttggttttttttgagacggagtcttgttctgtcgcccaggctagagtgcagtggcgtgatctcagctcactgcaacctccgcctcctgggttcaagcgattctcctgtctcagcctcccgagtaac

SEQ ID NO: 91304 - DNA, 601 bp, Human
caccaccaagcccagctaaggtttctattttttctttctctttttttttggagacacggtctagttctgttgccaggactggtctggaactcctgggctccagcgatcctccagtcttggtctcctgaagtgctaggattacaggtgtgagccaccgcgcctggtctttttttcttttgagacagtctcgccctgtcgcccaggctagagtgcaggggcaccatcatagctcgccccagtcttgaacccctggttctagcgatcctcctgcttcagcctcctggagtgctgggaatacagrcgtgcacgcccctctaaattttttttggttttttttgagacggagtcttgttctgtcgcccaggctagagtgcagtggcgtgatctcagctcactgcaacctccgcctcctgggttcaagcgattctcctgtctcagcctcccgagtaactgggattacaggcgcccaccaccatgcgtggcttttttttttgagacggagtctcgctctatcacccaggctggagtgcagtggcacgatcttggctcactgccagctccgcctcccgggttcccgccattcttctgcctcagcctcccg

SEQ ID NO: 91305 - DNA, 601 bp, Human
tttttctttctctttttttttggagacacggtctagttctgttgccaggactggtctggaactcctgggctccagcgatcctccagtcttggtctcctgaagtgctaggattacaggtgtgagccaccgcgcctggtctttttttcttttgagacagtctcgccctgtcgcccaggctagagtgcaggggcaccatcatagctcgccccagtcttgaacccctggttctagcgatcctcctgcttcagcctcctggagtgctgggaatacaggcgtgcacgcccctctaaattttttttgkttttttttgagacggagtcttgttctgtcgcccaggctagagtgcagtggcgtgatctcagctcactgcaacctccgcctcctgggttcaagcgattctcctgtctcagcctcccgagtaactgggattacaggcgcccaccaccatgcgtggcttttttttttgagacggagtctcgctctatcacccaggctggagtgcagtggcacgatcttggctcactgccagctccgcctcccgggttcccgccattcttctgcctcagcctcccgagtagctgggactgcaggcgcctgccac

SEQ ID NO: 91306 - DNA, 601 bp, Human
gggtgctgcctcatcgaccagctagctatgtgtgcccggctgttgtttgaaactttgggcccagctagtttttagaaaaaaagaaaaaagtttaatagcgatatagaaaattgagcacctataaaactatatggtgggctctgggttacattgagcttaagtagaccaagtatctatcccacctaaattatcagcaactccaggccatgacccagtgtcccattctccttcacggtttgctggtgtgtagcctcctggatacaggcaatgtatatagatcgcagagaatgtccgttctggyctcttccttggaagggtctaaaaacagaccttaaggagctaagtgacttccccaaagcccacagctccagtgccactgctgacttttgggtgggggtgggatcagttaaagaggaaagctttcagtactgtcagcacatacacctgccaattaaggggctggatagagttcatctctaggagcaggacctccacccccaccctccaccccagaagccatgtcatgctgtttcaccaggatcttgcctgaggttagatgggagagaacagctacaagcttgggtggagtcactcataaaca

SEQ ID NO: 91307 - DNA, 601 bp, Human
ggctttagagggctctccatgatcccttcccctcctgggggctcaaaggcaagggtcaaagatcttctcggtcaagtttggggtggcttcctgtcttggtcatcttgtctcccccttcctcttcctcctcttcctcctcctcctcctgctcttcctccccttctgttttctcttccccatctgtgatctcctttccagtccaagtttcctgtagacatgctagatcggatgacagaaaacaatttagatattagtcctggaggcaggggaggctatggcttggcaggagaggagttcaacmcttacgcttaccagtttcagcagctgggagcacatgaccttcacagagaaaattttgtaggggctgctcctgatggtggaagtaccagtctcccacaatgtcttcaaactcctccaacatggtctcacactggtcaagtagaagggccagaagagtatctgctctggagggatttgggatcccgcctgtcttctctccctgctcaacctgactgattttggagaggcaggtagccaggaagctaagtttggcctactagatgtgcaatcctcattcattcaacaaacatttaccagcacc

SEQ ID NO: 91308 - DNA, 601 bp, Human
gcaggggcctgtaatcccagctactcgggaggctgaagcaggagaatggcttgaacccgggaggcggaggtcgcggtgagccgagatggtgccggtgcactccagcctgggcaataagagtgaaactccgtcttgaaaaaaaaaattctttaaaattattattatttgtagagaagggggtctcttatgttgcacaagctggtctctaactctggtctcaaacagtccttctccctcagactcactaagtgctagcattacagttgtgagccactccacccggctcattatgatttctttktttttgtttttgtttttgtttttttttttaagatggagtcttgctctgtcgccctggctggagtgcaatggtgcgatcttggctcatggcaacctccacctcctggattcaagcaattctcttgcctcagcctcccaagtagctgggatcacaggcgtgcaccaccacgcccagctaacttttgtgtttttattaaagacggggttttgccttgttggccaggctggtctcgaacttatgacctcaggtgatccacctgcctcagcctcccaaattgctgggattacaggtgtgagccac

SEQ ID NO: 91309 - DNA, 601 bp, Human
ccctgtgcctgcatacccagctaatttttgtattttttgtacagatggggtctcactgtgttgtccaggctggtcgtgaactgctgggctcaagcgatcctcctaccttgggctcccagagtgttggaattacaggcatgagccactaggcccagtccagattttttttttttttttcctgagacggagtcaccctggctggagtgcagtggcgtgatctcggctcactgcaacctctgccctctggtttcaagtgattctcgtgccttagtctccctagtagctgggattacaggtgtgyactaccacgccctgctaatttttgtatttttagtagagatggggtttctccatgttggccaggctggtctcgaattcctgacctcaagtgatccgcccgcctcgtcctcccaaagtgctggtgggattacaggcgtgagccactgaacctggccccagcccagatttgtatctttctctgttacacctcagggctgactcacgtggggatggacataagacactcggagttcctcccctgtctccactgtcctccctttgttggccctctccctgtgtctcacgtttctttttcttctgc

SEQ ID NO: 91310 - DNA, 601 bp, Human
tggtggctgaatccatgggcatcgcccagattcaggaggagacctgccagctgctaacggatgaggtcagctaccgcatcaaagagatcgcacaggtgacccggcccttctgtccagctctacattgggtccatgtcacccagggccccgtccttaggattttgggctgatgtctgttctgtcaccgaccccaggatgccttgaagttcatgcacatggggaagcggcagaagctcaccaccagtgacattgactacgccttgaagctaaagaatgtcgaggtgatttggggagacaggcgggggggggtgagacgccatccttcagccaggtctcctccggctcccttcttacccatgcccctctctcctgccacagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaaggttgggggaggggagagcagggtggcagggaggagggaaaggaggacagatgtgtgtaggtgtgaggag

SEQ ID NO: 91311 - DNA, 601 bp, Human
gtgggggccgggagctttacttctatgaggagaaggaggttgatctgagcgacatcatcaatacccctctgccccgggtgcccctggacgtctgcctcaaaggttgggggaggggagagcagggtggcagggaggagggaaaggaggacagatgtgtgtaggtgtgaggagcctcacaatagaagaaaagctcagtgtgagatccctggtgagttgcaaggggagcaggagtggaaacacgcttccatagcatggggcaactccccaatgtccatgcgtggcaattcaccttgacacctgycttccttgcagctcattggctgagcatcgagggctgccagccagctatccccgagaacccgcccccaggtaacctccatgccccaccctctgggtctctgggtccctttccccttccttccaccttttttttttgagacagagtctcactctgttgcctgtgctggagtgcaggagtgctggagtgcagtggctcaatcttggctcactgcaaacctgtgcctcctgggttcacgcgattcttgtgtctcagcctcctgagtagctgggactacaagcacacaccaccacgcccggctaa

SEQ ID NO: 91312 - DNA, 601 bp, Human
ccagcaactttgggaggccgaagtgggaggattgcttgagctcaggagtttgaggacagcctgaggacagtagtgagactgctatctctacaaaaaaaattaaccaaaacaaaattagccaggcatggtggtgcacacctgtggccccagctacctgggaggctgagatgggagaattgcttgagcccgggagattgatgctgcagttagccatgattgtgtccctgcacaccagcctgggtgacagagcaagactttatctcaagcagacaaacaaaaccagaatcagctgtcccgcccyttctcccttaggtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaaggtgagccaggaaaacttgagcgtcatttgcttcatcactggccacctctggttgggggaagtcacactggaaacaagggggcagagggaagagggactggaacttg

SEQ ID NO: 91313 - DNA, 601 bp, Human
gacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaaggtgagccaggaaaacttgagcgtcatttgcttcatcactggccacctctggttgggggaagtcacactggaaacaagggggcagagggaagagggactggaacttgtgggggtctaagggtcttgaggcttgtctgtaataccttttttttttttttttgagatggagtctcgctcttgcccaggctggagtgcagtggtgcaatctctgctgaccgcaccctctgcctcctgggttcaagcgattcttctccctcagactcttgagtacttgggattacaggcacctgccaccacaactggctaatttttttgtttttgtttttttgagatggagtttcgctcttcttgcccaggctggagtgcaatggtgcaatcttggcttaccacaacctccgcctcctgggttccaatgattctcctgcctcagcctcccgagtagctg

SEQ ID NO: 91314 - DNA, 601 bp, Human
gttggtcaggctgctctagaactcccgacctcaggtgatctgcctgccttggcctcccaaagtgctgggattacgggtatgagccactgcacctggccacaactggctaatttttgtatttttagtagagacagagtttcaccatgttgactagggtggtctggaactcctgacctcaggtgatctgcctgcctcggcctcccaaagtgctgggattacaggtgtgagccaccacgtctggcctcattgtaatgtcttaatgatttacaaggaaagtgtctatgaaagacttaggtccctrtcaatcatcctttcagaccccttcatcttagtttatttccttccccttacagagctgggtggacgagaagacgccctggacgactcgttatggctccatcgcaggcttggctgagctgggacacgatgttaggcctctgggaggaagaaatgggggaggggacacagtcatgaggttatagagggcactgtacccccatctgggagaccctggtgaccctccggcttttgcttgtccttttcccttctaacaggttatcaagactctgattctgccccggctgcagcaggaaggggagcg

SEQ ID NO: 91315 - DNA, 601 bp, Human
tggcctcattgtaatgtcttaatgatttacaaggaaagtgtctatgaaagacttaggtccctatcaatcatcctttcagaccccttcatcttagtttatttccttccccttacagagctgggtggacgagaagacgccctggacgactcgttatggctccatcgcaggcttggctgagctgggacacgatgttaggcctctgggaggaagaaatgggggaggggacacagtcatgaggttatagagggcactgtacccccatctgggagaccctggtgaccctccggcttttgcttgtccytttcccttctaacaggttatcaagactctgattctgccccggctgcagcaggaaggggagcggatccgcagtgtgctggacggccctgtgctgagcaacattgaccggattggagcagaccatgtgcagagcctcctgctggtgactgaagcccctgtccccacacctgcccactgagacacaggcagtgtttagcaagcatatggcatattttattcacttactcccatctttgcctcatgttttcagaggacattgcagagtctgatactattttacagatggaaagactgagattag

SEQ ID NO: 91316 - DNA, 601 bp, Human
tgcaacctctgctcactgcagcctccaccacctgggttcaagcattctagtacctcaacctccccagtagctgggactacaggtgcgtgccaccatgcctggctagtttttgtatttttagtggagatgaggtttctccattttggccaggctcttgacctcaagtgatccacccacctcagcctcccaagtgctgggatacaggcctaagatgctgcacctggccccgtgcccatcttttcttatgagaaagcccacagtgttctgtacacacactaatagttcagcataatttggcctycaacaggggcactgagatgataaggaatgtccttttttaccccatccccaaggttcttctcaagagtgtcaccagccctccctctacctggcttttttccccagccctccctctacctggctttttttctgttctgcagaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactct

SEQ ID NO: 91317 - DNA, 601 bp, Human
ggctgtttttgccttcactatggcaaaaatcattttgaggcacctcatagagattccagtgcgttaccaggaagagtttgaagctcgaggtctagaagactgcaggctggatcatgctttatatgcactgcctgggccaaccatcgtggacctgaggaaaaccagggcagcgcagtctcctccagtggactcagcggcagagacgccaccccgagaaggcaaatcccactttcagatcctgctggacgtggtccagttcctccctgaagacatcatcattcagaccttcgaaggctggctrctgataaaagcacaacacggaaccagaatggatgagcacggttttatctcaagaagcttcacccgacagtacaaactaccagatggcgtggaaatcaaagatttgtctgcagtcctctgtcatgatggaattttggtggtggaagtaaaggatccagttgggactaagtgacatcgtatcggttcctgttcagatgacatggggaagatgatggttcagccactggtactacgagaatgtttgtattacccacatttgaaatgatttgctatgatttttatgaagattaaaaatatatac

SEQ ID NO: 91318 - DNA, 601 bp, Human
gtatgtagccaaggtggagaatcctacttcacagattcctttctacctggaaccttttcatcagcttttgagggagggaaaacactcctttgccgagagcaagctgatcaatgacctgtgtataggcagagcagcaaacacacggcttcagggccaggcaggtacatacatgggaaatgctggctgggtgagagggagcgtgaagagctgtgggaagccgaagtggccccatcagaagctgtgcacaggcaccttgtttttaatgacacgggtaggtcaaagcacaaacagctgccaactyatgacctttgtcttaaaagtttaaacggcaggagaactgctttggcttttacacatttaacatggtatcttggaggctccttagtgcagtagaaaggacatgaacttcaagagtcaggagacacagggtcttgcctgagcactgccatcagatggccccttacccttcttgaaatgtaatatgccagaggtcggcccagatattctctgagcacccttccaggcctaaaacactaggatactgtgagattaactcctacttctggtccttcactcctgcctgttggcagctcagtcaggt

SEQ ID NO: 91319 - DNA, 601 bp, Human
gtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacrgggttctcgctcaagtgagtttctacacccggtgtttctctttacctttctcatctttttctttctcatctttatttttaaaaataatcctatatataatttaaaaaattcccagatatattgattaaagaattgttctgcctctttctttccatgtgtgtgcagatgtctgagtgtgtgtgtgtctgtctgtaggtattacacctctgcctttcacattaaggaggagttttcacaacatctggcttcaggagggctgggaggtaggaggtgggactggctccctggtgaattgctcat

SEQ ID NO: 91320 - DNA, 601 bp, Human
gtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaagtgagtttctacacccggtgtttctctttacctttctcatctttttctttctcatctttatttttaaaaataatyctatatataatttaaaaaattcccagatatattgattaaagaattgttctgcctctttctttccatgtgtgtgcagatgtctgagtgtgtgtgtgtctgtctgtaggtattacacctctgcctttcacattaaggaggagttttcacaacatctggcttcaggagggctgggaggtaggaggtgggactggctccctggtgaattgctcatgagggctgacatacgcctgtggagatttggaaggttgatgcacatctgaaatgtcctgcggttactcagaaagaccagaatgaggccag

SEQ ID NO: 91321 - DNA, 601 bp, Human
ggtgaaggttctggatgaagcaacattaaaggtaggtttcctttgtaagcatctgcagtaaccaatggcttattatggctgtgtggccaccttagttgggccagaggggaagtagcttgagtagcctgctcacatcagacccaggttgcgtcctgtgatggtgggacactgtagcacttgaccacagtaagaccttccatttgaagagagccttttagcttgtgaaccactttcagtagattgacttcttgcatcttcttttgtcattttataaatgagaaaggtaaggctcaatcaaggytacagaacctgggttttctgtctccaagttcaagttcagtgctgtttccacattccatgtgctgctgtcctggcatgtgtctgttgtgggatgctgtccattgtaaacaatgtgggttacaagagctctcacctggagctttcattatttccactgtgcatggagaggtggctgatcccagggctcacaagtcccccacgcttcagtcaagtcattctgaaagtctcacttcccatatgttttctgagcatgacccaaaggggtgtggggaggaagtggccaggctgagctggggccagc

SEQ ID NO: 91322 - DNA, 601 bp, Human
gtgatgaaaaaaatattgaattctatacatgataaaacctgaattgaaacctggactttagggaagtgatctggtagcgctagttctgtatgcctacgtagagctgaccctttgagcagatgtactcgttggcgctctgcagttcctatcacacatctgcccatttggctcattttagggacctgcctgactcctataggcatctgagtttgagacccctgctctagactggaataggagtctctgactgtgtcctggctccatgggagtccccgtctaggctaggaagtaccgtagtaaggtgtgtgtgtgtgtgtgtgtgtgtgtgtcacacttgcacactgtgcattggggcaggatgttagctgggcttccttagtgctgctgctgtgacccatggagaagtagaagggaagaaggagcaaccaattcctgcagaacagcactgacccctgttttgttttttgttgttttttttttttgttttgttttacctgaagtcctacaacctgacttcatctcacactgtccaatatgctgatttctggctgacttcatggcactccccctgcccggctgtggacagggtgaatgagagagg

SEQ ID NO: 91323 - DNA, 601 bp, Human
acactaggccactgggcaggtcctgtccactcagcacatcccagagcctggggctgcgtggagagggtagcaggcctggccatgggcatcttttcctgtgggtcccactattctggctcatccaatctgatcagcattggctgctgccttcaggtcacctgtacctgacccagatggtttctggttctgccagttttgtggagccatgctgcggctgctcgctctctaaagccgagtgcattgctgtcatcccagggctgtgttgtctcagggtatcctttgtgtaggctgtgctgggctyatttgaatttccatgcccaactgaaaacaaatcctccagttcacagcatcagccagcattcaacataccacacccccttgcagtggcaatctggcatgttcctgcgtgtcacttcagagtcaatcatgtcagtggtgacttccttgatttcctgataagttttctatcacataaaaaacacttaaaacctgtaagtctctatttctctcactgagtgcagctgagtattacaaaaagattcctgaccgtgtagtttactttctacttgaagaggaggaaagagagcttgcctgtgggaat

SEQ ID NO: 91324 - DNA, 601 bp, Human
acctgacccagatggtttctggttctgccagttttgtggagccatgctgcggctgctcgctctctaaagccgagtgcattgctgtcatcccagggctgtgttgtctcagggtatcctttgtgtaggctgtgctgggctcatttgaatttccatgcccaactgaaaacaaatcctccagttcacagcatcagccagcattcaacataccacacccccttgcagtggcaatctggcatgttcctgcgtgtcacttcagagtcaatcatgtcagtggtgacttccttgatttcctgataagttytctatcacataaaaaacacttaaaacctgtaagtctctatttctctcactgagtgcagctgagtattacaaaaagattcctgaccgtgtagtttactttctacttgaagaggaggaaagagagcttgcctgtgggaatggcactttgggtatttttctctgtccatgagtagcaacttctgtccacgtcatctggccagtcacccttgagacactgcagacaacaggaaactaggaggaaggcgcacatgttggctgagcacatgcacaaaagcttctttctccttctgtgtttgagcat

SEQ ID NO: 91325 - DNA, 601 bp, Human
cataggattactgtcataaatgcaaaacattagcacaacgcctgttaaaataattgcccaatacactttagctatattttcattactatcattagtattatcttctactcttatcaggatttgtgaagatcactgtgtcaaatggatgggaaattttattttaatataaacagtaaaatagcattgttttcacttgcagctttgaaatagtgggggccatatatggttgtttccttttttatgtggacacagaggacttcgtgccagaggcaagatccctgtaaatattgttgcacaaaawtctcactagctctcttcccataccacccaatgctgatgtcctcaccacatgcggagaacaaatgtgaagggagtaggatattgggtcagtgtccaaagcagggtctgggcaggactcagctccccagagtcctctatgaactatggacggtgctccaggcaggctaaggcgtggagctgcctgatatttccctcccctggggacagcaagggctatccctttccaaaggccatggagagctggagcctggtgccctaacctctgagtcaccatcttaagagatgcctcattttagaacca

SEQ ID NO: 91326 - DNA, 601 bp, Human
tcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcwcaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcacc

SEQ ID NO: 91327 - DNA, 601 bp, Human
gcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctgkattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtgg

SEQ ID NO: 91328 - DNA, 601 bp, Human
gtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccaygtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatga

SEQ ID NO: 91329 - DNA, 601 bp, Human; identical to SEQ ID NO: 18398

SEQ ID NO: 91330 - DNA, 601 bp, Human; identical to SEQ ID NO: 18399

SEQ ID NO: 91331 - DNA, 601 bp, Human; identical to SEQ ID NO: 18400

SEQ ID NO: 91332 - DNA, 601 bp, Human; identical to SEQ ID NO: 18401

SEQ ID NO: 91333 - DNA, 601 bp, Human; identical to SEQ ID NO: 18402

SEQ ID NO: 91334 - DNA, 601 bp, Human
gactctgtctcagtaaaaaaaaaataaataaataaaaatgtttaattaaccatgatatttgctttggtaaaacctttgaggtttaatgagaattttaaaattcattatacttttcttatggcatataaaagttttaattttttttattgtctcaactaacatcataaatgtcttaatgttaaaatccatgggatattctatttaaaattttagctttatcacctttgtgctatcagagaatgtgctttgaactggtaaaatgagttaaagtattggaaaacacttatgtcagcagaggctyttaaaaatcattttcatccttcctcttctagtgatgatttttttttaacccatgttttcaccagtctaccaatccaatggcataaatgctcctacataggcaacttaagtgtttcttaagttgatgcaaggtattttgcatgaggctgaattcttgttgtcggagcagaggatttttgttccaactactgaattggcaaaatgttaaatataaaaacacctcaaaaagtcaaaggtagtctgaatgaaaaatttattttaaacacctcaagtaatctttacatttctacaaaatcataac

SEQ ID NO: 91335 - DNA, 601 bp, Human
ccgcctctactaaaaatacaaaaattagccaggcgtggtggcacgcacctgtaatcacagctacttaggaggctgaggtggcagaattgtttgaacccaggaggtggaggttgcagtgagccgagatcacaccactgcactcaagccttggcatcagagtgagactctgtctcagtaaaaaaaaaataaataaataaaaatgtttaattaaccatgatatttgctttggtaaaacctttgaggtttaatgagaattttaaaattcattatacttttcttatggcatataaaagttttaatattttttattgtctcaactaacatcataaatgtcttaatgttaaaatccatgggatattctatttaaaattttagctttatcacctttgtgctatcagagaatgtgctttgaactggtaaaatgagttaaagtattggaaaacacttatgtcagcagaggctcttaaaaatcattttcatccttcctcttctagtgatgatttttttttaacccatgttttcaccagtctaccaatccaatggcataaatgctcctacataggcaacttaagtgtttcttaagttgatgcaaggtattttg

SEQ ID NO: 91336 - DNA, 601 bp, Human; identical to SEQ ID NO: 21448

SEQ ID NO: 91337 - DNA, 601 bp, Human; identical to SEQ ID NO: 21449

SEQ ID NO: 91338 - DNA, 601 bp, Human; identical to SEQ ID NO: 21450

SEQ ID NO: 91339 - DNA, 601 bp, Human; identical to SEQ ID NO: 21451

SEQ ID NO: 91340 - DNA, 601 bp, Human; identical to SEQ ID NO: 21452

SEQ ID NO: 91341 - DNA, 601 bp, Human; identical to SEQ ID NO: 21453

SEQ ID NO: 91342 - DNA, 601 bp, Human; identical to SEQ ID NO: 21454

SEQ ID NO: 91343 - DNA, 601 bp, Human; identical to SEQ ID NO: 21455

SEQ ID NO: 91344 - DNA, 601 bp, Human; identical to SEQ ID NO: 21456

SEQ ID NO: 91345 - DNA, 601 bp, Human; identical to SEQ ID NO: 21457

SEQ ID NO: 91346 - DNA, 601 bp, Human; identical to SEQ ID NO: 21458

SEQ ID NO: 91347 - DNA, 601 bp, Human; identical to SEQ ID NO: 21459

SEQ ID NO: 91348 - DNA, 601 bp, Human; identical to SEQ ID NO: 21460

SEQ ID NO: 91349 - DNA, 601 bp, Human; identical to SEQ ID NO: 21461

SEQ ID NO: 91350 - DNA, 601 bp, Human; identical to SEQ ID NO: 21462

SEQ ID NO: 91351 - DNA, 601 bp, Human; identical to SEQ ID NO: 21463

SEQ ID NO: 91352 - DNA, 601 bp, Human; identical to SEQ ID NO: 21464

SEQ ID NO: 91353 - DNA, 601 bp, Human; identical to SEQ ID NO: 21465

SEQ ID NO: 91354 - DNA, 601 bp, Human; identical to SEQ ID NO: 21466

SEQ ID NO: 91355 - DNA, 601 bp, Human
caaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtaataagcttctgcttttacaaagagagcagtatttaaaatgagtcccttgttaaagcgtgtttaatatgaaccttgtctttggaatactgggttatggggtagctatgggaaacatgactytgtgtgtctcacagattgtatatttcatatcctaggtgtttttgaggtgagaaccaagtactaaaatgcagggatcttaaagcaaatctttgtattgtacttatgctcatatttgcccatattgcccatgatgaaaactttcatcattttcttcaggaggtttggccgtaaatttatatatatttaagattattttcttcagatcaatatttgtggtattttctggtggtgtgggactagaaactgaatgaaaatgatctttattacctaattattatcatgcatttctctataggggaa

SEQ ID NO: 91356 - DNA, 601 bp, Human
caaagtttacattgcaaaggagagagctagttttcatctagtccataaaatcaggtggcatacgtatgctatttatgtatttgtgttttttattgtgggaatcttcaaacattcaaaattaggacaaataaatgaatacaataaataaaatgaattcatttatcatcactagattcactagtcatcaatacatgccaatcttgttttacttattttctttccccatcccctagctatataaaatttaagcaggcagcacatgaataggtctctatttgaatttagtatatcataatattayagtaaactgtatagtgttcttaatttttaacctgtttttactacaacaaatcaaaacgtgacttggggagattttcataaatatttttgaggagacttttagagaaaatttaaagctacttggtagatttttgagaaacagtttcaggaatacctcatattttgttgtctctttatttatagattttcctagagcagggtgtcagcattagatagcaaattattggaccaactgctctctgaatagaagatctttgctgttttgtcagaactcagtagcagaacttttctgatattgttt

SEQ ID NO: 91357 - DNA, 601 bp, Human
tggccttgttacacatactcatattaaaatcattttttgagctcttcattcttgttttagtgaagaactgaaaagcttgggcttaagaggtagccaacacacatagatacatacctactttttattttgaatttatacttttcatctcaactgtattccctacttattaccttagagtattacaactgtcattagaacacttaaatttaagtgccttctatgccatgcacagtggtagatgcttttacttacaatgtttcacttagttctcacatttctccttaaagcagaggttattccmtgttacaggtcaagaaatgtttactcagactgaagaactcttcctaaaatcatgcagctagtagtaatgtagctaggatcccaacctagttctgagtcccagactccattgctggttactaccttcatggatgaatgtataccagagaatttaggccaggtgtggtggctcacgcctgtcatcccagcagtttgggaggctgaggagggtggatcacctgaggtcatttaaatgtgtatgtgcacacacacacacacacacacacacacacagaactgcttcattttctcaaagtgttta

SEQ ID NO: 91358 - DNA, 601 bp, Human
aattgagcttttgcatgaaaagtgccctgtaaagtgcttggcttatgggagctcataagtggtggctgctactgtaattatgaagtaggtattaggcagaggttaacattattgctacaatattaatttaaaaggttctgattcctttaatatttgtatggactatctgttccaagggaattaaacttgtcgtcagatgtggactttattagttcattattttgaaggtaaacctccatccagaataaggaaacattttagagctatagggaaatagcttttgtggttttttttacaaatrtcacaagtatatatttgcaagaaaatgtgtatctttttggtatatgacttgttttattgagatatgcacttttgaatgaatgatagtattctctagcttcgttactatggttttcttttttgctctcagaggcatttaggggtattcaaacctcagttaacttacgtatattagaatttgcaactccagagatgctcttgacagccccaccatatgtgctttgctttttgtttttatttattttaaaaatttactttttattttttgagagacctggtcttgctctgtcacccaggctgg

SEQ ID NO: 91359 - DNA, 601 bp, Human
taggtattaggcagaggttaacattattgctacaatattaatttaaaaggttctgattcctttaatatttgtatggactatctgttccaagggaattaaacttgtcgtcagatgtggactttattagttcattattttgaaggtaaacctccatccagaataaggaaacattttagagctatagggaaatagcttttgtggttttttttacaaatatcacaagtatatatttgcaagaaaatgtgtatctttttggtatatgacttgttttattgagatatgcacttttgaatgaatgatrgtattctctagcttcgttactatggttttcttttttgctctcagaggcatttaggggtattcaaacctcagttaacttacgtatattagaatttgcaactccagagatgctcttgacagccccaccatatgtgctttgctttttgtttttatttattttaaaaatttactttttattttttgagagacctggtcttgctctgtcacccaggctggtgtgcaatggcttgatcatagctcagtgcagcctcaaactcctgggctcaaacagtcttcccgagcaactggaactacaggcata

SEQ ID NO: 91360 - DNA, 601 bp, Human
tgtatggactatctgttccaagggaattaaacttgtcgtcagatgtggactttattagttcattattttgaaggtaaacctccatccagaataaggaaacattttagagctatagggaaatagcttttgtggttttttttacaaatatcacaagtatatatttgcaagaaaatgtgtatctttttggtatatgacttgttttattgagatatgcacttttgaatgaatgatagtattctctagcttcgttactatggttttcttttttgctctcagaggcatttaggggtattcaaacctyagttaacttacgtatattagaatttgcaactccagagatgctcttgacagccccaccatatgtgctttgctttttgtttttatttattttaaaaatttactttttattttttgagagacctggtcttgctctgtcacccaggctggtgtgcaatggcttgatcatagctcagtgcagcctcaaactcctgggctcaaacagtcttcccgagcaactggaactacaggcatatgctaccatgcccagctaatttattttattttattttttgtagagatggatcttgttttgttgcccagg

SEQ ID NO: 91361 - DNA, 601 bp, Human
tcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaragtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagag

SEQ ID NO: 91362 - DNA, 601 bp, Human
gaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaaycatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgct

SEQ ID NO: 91363 - DNA, 601 bp, Human
gcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccstaataataacaaacacatatccttttttttttcttaagagacaaagtcttgctctgtcgcgtaggctggagtgcagtggcacaatctcggctcactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcg

SEQ ID NO: 91364 - DNA, 601 bp, Human
gtcttgaattcctgacctcaagtgatccgcctgcctcagcctcccaaagtgctgggattacaggcgtgagtgagccaccatgcccagcagaaacatatattctatattgtacagtgattgtagtgccggatattaataattttagaagggttagtatttcagtggcaaaatttactttttaattttataagattaaaattttaaggttaagattaaaacttttaggatgaagaattttaaagattaaattttttaaagctctgagggcaacttacccacaaatgaagctaaatctaagagwactacttactacttttacaaggtaattattcaagggtgtacgtttaaagtagttctcaacagcaacttcctgaaagctggatctgttgtgtgttgttttggtggtttgccagtatatcaaggctcatttgtcactttaagatgacctcaaggctgtaatttggctggggaatactttactctcagaaatggggagatcataagtggtgtgataataagtgttttattttgttcaagttgcagcttgctttaatgaattttaggggccatggtccaaataactgtgatggttataggcatg

SEQ ID NO: 91365 - DNA, 601 bp, Human
ggtcaaatttattatcctcaactgctgcatataagacaggtatagatcataaatcatattttatagctaggtagtaaatctttccctccctaagtactgtaggatatgattatctctgaaatgtataaagtagaatacatttttctccttgtatataaatctacatgtcacctttgctggaaataatgtttggattatattatcctcccctactctgaatcttctttcccttcccttggttgaagttcacaagtcttggaagctctataaatgctggagaccaagtattagtactcagacrctggaatcagatgcagaccttgagttcagattcaagcaggaatccctttctggctgtgttgaccctaagcaagtcactgaacttctctaagtcagttttgttatctgtaataggtggcttttagtagcagctacttcagagttgttatgaggattaatagcacaaagtaaatattcaatacattttagctattccagtcttttatctctgtaaaactcattctattagtataatgtaagtaaaaatacaaattgcttatcattaaaaattcaggctgggtatggtggttcacacctgtaa

SEQ ID NO: 91366 - DNA, 601 bp, Human
agttttgttatctgtaataggtggcttttagtagcagctacttcagagttgttatgaggattaatagcacaaagtaaatattcaatacattttagctattccagtcttttatctctgtaaaactcattctattagtataatgtaagtaaaaatacaaattgcttatcattaaaaattcaggctgggtatggtggttcacacctgtaatattagcactttgggaggccaaggcaggaagattgcctgaggccaggagtttgagagaagcctgggcaacatagtgagaccctgtttctatttaaaaaaaaaaacaaaaacaaccagcagattccacaggtccataaggaaatatcatattgaagagaagtctgtaattaaggcagagaaagatttgtctaggattgagtatgattttacacatctacatgtgctgcttttatatatatgtttgtgtttaatatctatctctgtaaagtatacataattgggttagctctttgaggggatgtgaggggtggggaatgtttagtttcagtctccccaagaatagaatttaccataattgggaggcaagatgaataaaggattttttttagttttt

SEQ ID NO: 91367 - DNA, 601 bp, Human
aggcaagatgaataaaggattttttttagttttttattttacttttatctttttggagacagagtctcattctgttgtccaggctagagtgcaatggtgtgatcttggcttaccgcaacctctgcctcgcatgttcaagtgattctcgtgcctcagcctcccgagtagctgggattacaggtatgcaccaccatgcctggctaatttttggtattttaattagagacagggtttcaccatgttggccaggctgatcccaagcttctggcctcaagtgatccacctgtttcagcctcccaamgtgctgggattacaggcgtgaaccaccgtgctcggccaaggatttatttttttaatgctgcaaatgtgtccctttgtcacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggc

SEQ ID NO: 91368 - DNA, 601 bp, Human
tcgtgcctcagcctcccgagtagctgggattacaggtatgcaccaccatgcctggctaatttttggtattttaattagagacagggtttcaccatgttggccaggctgatcccaagcttctggcctcaagtgatccacctgtttcagcctcccaaagtgctgggattacaggcgtgaaccaccgtgctcggccaaggatttatttttttaatgctgcaaatgtgtccctttgtcacctggatgccaactttttataaatcaacttgtgctgaggaagctctcttaagaaaccctatttgtrggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattatgccactacactgtagcctgggtgacgggcaagaccctgtctcttaaaaccaaccaaccaaacaaaccccaaggaaatcctatttaaaaattc

SEQ ID NO: 91369 - DNA, 601 bp, Human
ttaatgctgcaaatgtgtccctttgtcacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattrtgccactacactgtagcctgggtgacgggcaagaccctgtctcttaaaaccaaccaaccaaacaaaccccaaggaaatcctatttaaaaattcatttttaaagcgaaactttctctagaaacccccctttttggctgggtatggtgactcacatctgtaatcccagcactttgggaggccaaactgggaggattatttgagaccaggagttcaagaccagcctgggcaatatagccagccccatctctaaaaatttaattaagaaacttgactgggtgtggtggtacaagcctgtagtcc

SEQ ID NO: 91370 - DNA, 601 bp, Human
cacctggatgccaactttttataaatcaacttgtgctgaggaagctctcttaagaaaccctatttgtaggccaggtaccttatggtggctcacacctgtaatctcagcaccttaggaggccaagatgggaggactgcatgaggccaggaatttgagaccagcctggacaacatagtgagacccctgtctctaccaaaaaaaaaaattagccaggcatggtggcatgcactgtggtcccatctgctagttcaagattacagtgaactatatgattatgccactacactgtagcctgggtgaygggcaagaccctgtctcttaaaaccaaccaaccaaacaaaccccaaggaaatcctatttaaaaattcatttttaaagcgaaactttctctagaaacccccctttttggctgggtatggtgactcacatctgtaatcccagcactttgggaggccaaactgggaggattatttgagaccaggagttcaagaccagcctgggcaatatagccagccccatctctaaaaatttaattaagaaacttgactgggtgtggtggtacaagcctgtagtcctggctactcaggaggctgaggtggaa

SEQ ID NO: 91371 - DNA, 601 bp, Human
gtactctctagccacccagttgctgtctcaaagttagtctttttctttaagatactttagattcagtgcgactgatttattttaagttttcattgaagagtgagagaaactcggcttacggaccaggaaaactgagagtgctgcctggtgagcctgcctcagtatgttgctaaaaatgtaacagtctgactgtggagattaggagatgaaagtgtagagataggatggaaggaacttcaagaaattttagagaaacattagagttttggtatagaggggtaggatagcatctcctctggayggtcaccatttggcagtgatctctcttatttgtgcaggctttgctaaacaatcatctaatctgatctttctggatccttaagttagacttacttttctccatttcatttcttgttttaatgtcatgataagtggcaattgcctatttaaacatcagaccatacacttcattaggtgcattatacacttggtttaatttccagttgcctataataacagaggatttctaattgctcattctgtttagcattcttctggtctttttctccccattgctgtttttaattctcccccttctctc

SEQ ID NO: 91372 - DNA, 601 bp, Human
agatgaaagtgtagagataggatggaaggaacttcaagaaattttagagaaacattagagttttggtatagaggggtaggatagcatctcctctggacggtcaccatttggcagtgatctctcttatttgtgcaggctttgctaaacaatcatctaatctgatctttctggatccttaagttagacttacttttctccatttcatttcttgttttaatgtcatgataagtggcaattgcctatttaaacatcagaccatacacttcattaggtgcattatacacttggtttaatttccagwtgcctataataacagaggatttctaattgctcattctgtttagcattcttctggtctttttctccccattgctgtttttaattctcccccttctctcgttttctttgtctatatttcctattactagaccttatatttaatctttttgtttttttaaacatgaaaagggtttcactgacagaagtggtaatttatttcagacaactggtaaccaagactgggcatgtgttggcaacaataaatcaaaacaggcatttggccttctgatatgatattttgattctttagactataataagg

SEQ ID NO: 91373 - DNA, 601 bp, Human; identical to SEQ ID NO: 21467

SEQ ID NO: 91374 - DNA, 601 bp, Human; identical to SEQ ID NO: 21468

SEQ ID NO: 91375 - DNA, 601 bp, Human; identical to SEQ ID NO: 21469

SEQ ID NO: 91376 - DNA, 601 bp, Human; identical to SEQ ID NO: 21470

SEQ ID NO: 91377 - DNA, 601 bp, Human; identical to SEQ ID NO: 21471

SEQ ID NO: 91378 - DNA, 601 bp, Human; identical to SEQ ID NO: 21472

SEQ ID NO: 91379 - DNA, 601 bp, Human; identical to SEQ ID NO: 21473

SEQ ID NO: 91380 - DNA, 601 bp, Human; identical to SEQ ID NO: 21474

SEQ ID NO: 91381 - DNA, 601 bp, Human; identical to SEQ ID NO: 21475

SEQ ID NO: 91382 - DNA, 601 bp, Human; identical to SEQ ID NO: 21476

SEQ ID NO: 91383 - DNA, 601 bp, Human; identical to SEQ ID NO: 21477

SEQ ID NO: 91384 - DNA, 601 bp, Human; identical to SEQ ID NO: 21478

SEQ ID NO: 91385 - DNA, 601 bp, Human; identical to SEQ ID NO: 21479

SEQ ID NO: 91386 - DNA, 601 bp, Human; identical to SEQ ID NO: 21480

SEQ ID NO: 91387 - DNA, 601 bp, Human; identical to SEQ ID NO: 21481

SEQ ID NO: 91388 - DNA, 601 bp, Human; identical to SEQ ID NO: 21482

SEQ ID NO: 91389 - DNA, 601 bp, Human; identical to SEQ ID NO: 21483

SEQ ID NO: 91390 - DNA, 601 bp, Human; identical to SEQ ID NO: 21484

SEQ ID NO: 91391 - DNA, 601 bp, Human; identical to SEQ ID NO: 21485

SEQ ID NO: 91392 - DNA, 601 bp, Human; identical to SEQ ID NO: 21486

SEQ ID NO: 91393 - DNA, 601 bp, Human; identical to SEQ ID NO: 21487

SEQ ID NO: 91394 - DNA, 601 bp, Human; identical to SEQ ID NO: 21488

SEQ ID NO: 91395 - DNA, 601 bp, Human; identical to SEQ ID NO: 21489

SEQ ID NO: 91396 - DNA, 601 bp, Human; identical to SEQ ID NO: 21490

SEQ ID NO: 91397 - DNA, 601 bp, Human; identical to SEQ ID NO: 21491

SEQ ID NO: 91398 - DNA, 601 bp, Human; identical to SEQ ID NO: 21492

SEQ ID NO: 91399 - DNA, 601 bp, Human; identical to SEQ ID NO: 21493

SEQ ID NO: 91400 - DNA, 601 bp, Human; identical to SEQ ID NO: 21494

SEQ ID NO: 91401 - DNA, 601 bp, Human; identical to SEQ ID NO: 21495

SEQ ID NO: 91402 - DNA, 601 bp, Human; identical to SEQ ID NO: 21496

SEQ ID NO: 91403 - DNA, 601 bp, Human
atgtctgcaagtgtatgggattatttcattgtcctgcctctaaatagaacttttgacatttaaccatcctattgttcagcaattttaatgtttagtatcttttccagagtttattattgttcctagctcttaactctggatagcccacataaattctccttttgacctgaacggcattaaagtgacctcacacaaatcatcctattttgaggctttcaaacctttgcctttttaatattttatttacttatgccctaattctgaaaggttttgaggcagcctttttttttcttcttcttcttttttttttttttaagtaaaatgtacctttattacagttgggaagggctgcttgattggttctttttttcccttcttccccacctactccattctatcatacttccaatttaattagcttccaggattctaatactaaaaggctccaaagtccagaatacctgcgaacatttgccaccaatgggaaccaaaattattttttgtttctgtacaagataaatgaattttaagggtgaccatcaatctatgaagagaaggccagaaaaataacaagtctattacaagactgcctacatagtag

SEQ ID NO: 91404 - DNA, 601 bp, Human
ttaacatttcctgactttgggatctaaaatggtatccttggtgttacagccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttaygcaaattacctaaagagaagattaatcctcaaagccattttttgaatgcatccttgccttacagagtgcttctcaaaataaattatataccttgaatctcctaaagattttgtacaagagagggtttgttttgttttgtttagtttgtggaaatgggttctcactatgttgcgtaggctcatcttgaactcctgggctcaagcaatccccctgccttggcctctggaagtgctgggattacaggtgtgtgagccagcacactgagcctgcaagagatgatttagttggtctggagtgaga

SEQ ID NO: 91405 - DNA, 601 bp, Human
ttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcrcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctg

SEQ ID NO: 91406 - DNA, 601 bp, Human
gaatgcctcttcatctcaagacttggataaaaatggatttctacctattctttttagtctccttactgaaacatccttatttttttatcgcatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagycatgtatgtggagttttttgggtttgggtttgtttttttttttttttttttatgactctggtacttaatctaagaaactgctcgttctgagtagtgtgatttttctcaccgtgcagatccttctggtttggtgtagtgtgggaggtgacctgatgcccatgtgtataactcttgcatatgtgttatgtgctcatgagtctgacatctgcgaggatcactgaagtaataattgaatctcaattattttcttgcctttacttccaatctgtcagcagaggccttggctaaattacagccttt

SEQ ID NO: 91407 - DNA, 601 bp, Human
caatgacttaaaagtttagtttttagagtttgtgttatgtggaaagatctttgtaagttgttgcctgttaaatttctcagtgaggcttccataaccaccatctttgtatcagtgcatacgtttagtcaaggctggcctcagacagttttgagaataattactaatttctgagttctagtccctgtgctagaatttttataatttctaatcctcagaacaactcaagaagataattggtattggaccccattttacagaaaactgaaggtcatacagtaagttgcagagttgggatttgaacccagggcttctttaaaacttcaaagtttgtacactttatactgtcctatgattttccagtttgtttgttattgtcatcttgcagaatagaatacagtttcacctaactggtccttctcaaactgggaaatgcagtctctggagtacacagcagagtgcagggtgcatttgaagctgcagaataaatatggctcattgtcttgcagtgtcagtcttacttgatggtaaataatgtaaacagaatatacactggtgtgttaccacttagaatgtaaaattgcatgactttaagataaaaaat

SEQ ID NO: 91408 - DNA, 601 bp, Human
atctcttcaccagtgagctgtaataaagcagtagtactttgagggcagttaaatgatgtgcaggcattcttcttctgaaaatttcctatcaaaaccactcaaacaatacatttcctccctagaatgagttttgacccggctgggagatgtttgtttatttatttttttgagacaaggtctcgctttgtcacccaagctacagtacagtggtgtgatcatagctcactgcagcctcaaactcctgagctcaagtgatcctctaacctcagcctcccaagtagctgggactacaggcacatgctgcacacatggctaatgggtgttcattttttttcctcagttggttctattcatatgtttgtcaatgttgatgcagatattgtgctctaagtaaacaattttgtcaggcttttgtccttttggtgataattttccctaataaaatgattcacttcaagattgtctcccaggaaatactgccagtagccatatatatattactgccagtagccataaatttatatttacgaaacattcattcattcaataagtaaatatttgagtgcctagtattcaggctctattctgtgtactaggcata

SEQ ID NO: 91409 - DNA, 601 bp, Human
atgaatctcttttctcaatgccttttattgaatttagcaaaactgctgtttcctttccaatgtgtttttctttcttgctgttctgtgccaagcaggttcataaagaattctatctctttgaatcttggattataagcctagccagaagaggggagaataagttgcggtgagagggggtaagcccatcagaaagtcgaaaaccacctcagagtatcaggacaaatgaaacatttttcgtaggatcctttccatgggttttcctcgctgctcaaattttttttttttttttttttttgagacrgagtcttggtctgttgcccaggctgtagtgcaatggcatgatctcggctcactgcaacctctgcctcccaggtttaagcaattctcctgtatcagccttctgagtagctgggactacaggttcccgtcaccaggcccagctaatttttgtatttttagtagagacgggtttcaccatattggtcaggctggtcttgaactcctgacctcaggtgatcaaccggcctcagcttcccaaagtgctgggattacaggtgtgagccaccacgcccggcctctctgctcaaatcctgacttcctt

SEQ ID NO: 91410 - DNA, 601 bp, Human
tttttttttttccgagatggagtcttgctcttgttgccgaggatgaagtgcaatggcatgatctcagctcaccgcaacctccgtctcttgggttcaagggatgctcctgcctcagtctcccgagtagctgggattacaggcgcctgccaccacagcctgctaatttttgtatttttagtagagacaggatttcaccatgttggccagggtggtctcaaactcctgacctcatgatccgctcaccttggcctcccaaagtgctgggattacaggcatgagccaccacgcccagccaaggatratctttttatttatttaagtatgtgattttcatcccctgtgcaaccattaagtagtcttcaggaatcagattctggaaatgttagctctggtttggaatgcttatagtttacaacagagcatgcttgctaatgccagttatgaagcacctaccagggttattttctttcatggtttaaacagaactttgttgtagtcgtcactatttttcaatatttaagattaatttttagatttttgagaatgccattttatgtactactctctgttcattgagaagataaatcctctttccccaatc

SEQ ID NO: 91411 - DNA, 601 bp, Human
ctcaatactagtttggctcttactttttcagtggggcagcaggttttgtaaattaaaacacattaattgttttgttttttggcttttccttttccaacacctccccaccctttccgtccgccccccactataagtttccttttaaagaaaaaataaagcatattcgaaatattgccgcttggggatagagcgtcttagaatatgcaaactctttaaatcttgtttgggtttgtgcctgtgtaccccagtgcaaagattggatctgaaacatccctgagatgtcccagctccgtcttctttmcaagttttctccaaactgatacaccatcactaccaccacttagttcccctagtacatatttctttgtaatctagaatttttttaggctttgggagacaagttgaatggcatgtatttccagcaacttggtagagcaatttacagattctatatgggcatctagtatttagctaaatgaactctacctctctctcctctctctcctttctctctttcagcttggcagtgaccttggcgggggcattggaggaagtccggcagtaagtgccatctgtttttttcaccatgagaagcactgcc

SEQ ID NO: 91412 - DNA, 601 bp, Human
ttcaggggtgtgaatgtccatctccctgaggagagcttcctactaggtatttatgcctaaatgggaaaggaaataagactttgctgaacccaggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttcttatcaatgaygaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcac

SEQ ID NO: 91413 - DNA, 601 bp, Human
caggtggaaatggaactgctgtttaagttggatacttctccctctttctataaaaacaaactcctttcttagggtacccgtaggccttttgcacagaatcatggaagctaaaattggaaacaaatacaaaatcttggatcactgtgttcctgtatcctactgagtactctcttgataaagcttctaaagaatgtgtgttcttatcaatgatgaaaaaataactgtcatgattaaaaagatgaagaatatactaatttgactcctaagaatattgtaattatggtgttttcttattgatttrtcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttca

SEQ ID NO: 91414 - DNA, 601 bp, Human; identical to SEQ ID NO: 21497

SEQ ID NO: 91415 - DNA, 601 bp, Human; identical to SEQ ID NO: 21498

SEQ ID NO: 91416 - DNA, 601 bp, Human; identical to SEQ ID NO: 21499

SEQ ID NO: 91417 - DNA, 601 bp, Human; identical to SEQ ID NO: 21500

SEQ ID NO: 91418 - DNA, 601 bp, Human; identical to SEQ ID NO: 21501

SEQ ID NO: 91419 - DNA, 601 bp, Human; identical to SEQ ID NO: 21502

SEQ ID NO: 91420 - DNA, 601 bp, Human; identical to SEQ ID NO: 21503

SEQ ID NO: 91421 - DNA, 601 bp, Human; identical to SEQ ID NO: 21504

SEQ ID NO: 91422 - DNA, 601 bp, Human; identical to SEQ ID NO: 21505

SEQ ID NO: 91423 - DNA, 601 bp, Human; identical to SEQ ID NO: 21506

SEQ ID NO: 91424 - DNA, 601 bp, Human; identical to SEQ ID NO: 21507

SEQ ID NO: 91425 - DNA, 601 bp, Human; identical to SEQ ID NO: 21508

SEQ ID NO: 91426 - DNA, 601 bp, Human; identical to SEQ ID NO: 21509

SEQ ID NO: 91427 - DNA, 601 bp, Human; identical to SEQ ID NO: 21510

SEQ ID NO: 91428 - DNA, 601 bp, Human
atattccaaatttacactacttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatasaacagtctgaatgagactatgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagt

SEQ ID NO: 91429 - DNA, 601 bp, Human
cttatgtaggtgtagtaacctccaaatcaataaattaatataaaattggcccaggactggtgaaacctagagtcctgtcagaagcaaatacaaagcagccctttaacaacagttttaaatttagggccttcaagacccccagctgaaaagaaagtctctactgaaagtgagctcacaatttaacaggagagagagagaaagatacactgtgaaggatagtcaaaagacattgcaaagaggaggactggtactgtccccacccccactaagagcttaagatagaacagtctgaatgagactmtgaaatatatttaaaatgatgaaagaaaaatgtcagctttcctctttccagtcaagacaggtgggatcccattgtttaatctagaaatacctgtgtgagatactagtattgatggtgagacgtcaatagtaaaatatcttggaggtaaaactaaacattcttcagtcatttaaataccagcacagcaggcctgtttgccagttcactaactaccttgttgccacagtagttgactgcctttttttcagcaaagggaataatgatttagagggtagacgagtgagtcacaatgtaacttgg

SEQ ID NO: 91430 - DNA, 601 bp, Human
cttaataagtgtctaaatgtgtttcctctaaatgagttttctctgactcttgatgtccttgtttctcatttcgtgtgttagttgtgcttagaaacattttcccagtgaacttcttcaaacttggactgctttttcaagtcagtgtctgcaaggagacagtggaattatgatttaacgtgttcatctccagggtaatgctcatggtctttatgtagatgctgcagggttcccacagctgcttggcctcctttttccagggccataaactcttttgagaacattgatagcatcattctttcamgttttcaggatgataaaagcacagtttaaagagccaactaattctacaattatttaagaaaaactggccgggcatggtggctcacgcctgtaatcccagcactttgggaggctgaggtgggcggatcacgaggtcaggagatcgagaccatcctggctaacacggtgaaaccccgtctctactaaaaatgcaaaaaaaattagtcaggcatggtggcaggtgcctgtagtcccagctaattgggaggctgaggcaggagaatggcgtgagaatggcgtgaacccgggaggcggagcttgc

SEQ ID NO: 91431 - DNA, 601 bp, Human
tttccagtggtttcctgagaataggtatgtagactattccataggtttgagcctttacatgtttttaaatgtctgttttagtctgtcttcatactaggttaggaatcattttcctcctaatcagaagccgttctgattcttgatacttgctttagccctgtttttttctcagtgaaagcttgtactttgtccccagtgttttaaatttcagtgatgtgcctcattgtgactctgtcttttcacccatcatgctgggtactcattgggttctttaaaaccggaaactcatgtccttcaattytaggaatttgtctttaacttctttgctgctgctctccccttcattttctctatttcttatcagacgtcttgctatttggatgttgattctcctggactgactctgttttcccctcctattttccatccctttttccttttgctctactttttaaaaccttgtttatgggaacaggcacagtggctcacacgtgtaactccagcactttgggaggccaaggagggcggatcacttaaggccaggagtccaagaccagcctggccaacttgacgaaaccctatctctactaaaaatacaaaa

SEQ ID NO: 91432 - DNA, 601 bp, Human
tcaattctaggaatttgtctttaacttctttgctgctgctctccccttcattttctctatttcttatcagacgtcttgctatttggatgttgattctcctggactgactctgttttcccctcctattttccatccctttttccttttgctctactttttaaaaccttgtttatgggaacaggcacagtggctcacacgtgtaactccagcactttgggaggccaaggagggcggatcacttaaggccaggagtccaagaccagcctggccaacttgacgaaaccctatctctactaaaaayacaaaaattagccaggcatggtggcacacgcctatagtcccagctaatcgggaagctgaagtaggagaattgcttgagccagggaggcagaggttgcagtgagttgagattacgccactgcactccagcctgcgtgacagaacgagccacaagcctttatctcaaaaagaaaagaaaaacacttttttatgaaacatttttaacattgcagaagtaaacagaatagtataacgagcccctgtgtacccatcatccagcttcaataattatccatggttaatatcatttatacccctttcc

SEQ ID NO: 91433 - DNA, 601 bp, Human
aatcagtaaagtgcacatattatggtgggttgatagctcttaagtctctttagctacactgtttaatatgatagccactagccacatgtggctatgtacattgaaattaaatcaaacaaattcagtttcatcattgcatcagccacatttcaagtacatgtgtggctaatggttactagatgggacagtgcagaagtaaaacatttacattactttagaaagttctgttggcagtgccaatctgtaggctcctcttccatatttcttttacctttggttttcagcagtttggctattatgyatgtagttgtttttcttgtatttctctggcttggagctcactgagcttggatctgcaagttgatagttttccccaattttggaaatgttttgtcattcttcagattttttttctgcctcattatgtctcttctctccttctagaactccagttacatatgtgttagactactggatatcatccctcagatcactgaggctgctttttttaaatttaatctttttttctctccgttcttcagactggataattcctattgatctgtcttcatgtacactgcttctttcttctataggcaac

SEQ ID NO: 91434 - DNA, 601 bp, Human
tctttttttctctccgttcttcagactggataattcctattgatctgtcttcatgtacactgcttctttcttctataggcaacaaccttctgttaaactaatccagagcattttcatttcagatattgtactttttaattctaggatttccatttgattttttgctgaattttcctcactgggctggctcaattctttccaaagttatctttaagtctctgtctacgatagaaaggctttctgcaagccttgtggggagctaaattgggaaagagggctggagagtcttagcattcagtakgcattaattcatttaattcaccacccctcagccatgtctggcttttacttctaagtgccatctattttatcctctctaaaagaatcaatcttcagttttgtgcagggcctagagacctaagagctgtccagcagtatagaatcggggttggtatctagaaatcctattgacatcttaatcctctcgtttttaacactcccctcctctccccaccatacagttccagaggtgctaccagtcctaagcctttgagaattctgtggtggtattgctaatccatctgttttccaggtaccaagt

SEQ ID NO: 91435 - DNA, 601 bp, Human
tgtccgttcacactcagaaagcccacagctatagctattgtaccagaaaaactggtagacgcttccaagcggaagaccttttcagcgctcccatcaaatgaagcaaaccagcttggcatttgctgacgtttcttgactgttgtgcaagccaaaccagtcagtgttgaagccttctttggtcttccaagatccacaattgaggactgcacactctgattgcatttgtgggaccacgatgctccttgaatagataatgagtccttgaagtggtggatctttcggaaactatatagcgattccyacgtcagacagttggatccagcgttggatctactatccaaatgatccctgtagacctaaaaatattccacctaaaatattccataagcagtatgtaggtactggagtcttcattatgaaagattaaaacattttgctgtcaaaaaataaaatagaaaattacttactgtgattgctacttccagtttgacatattcttcatgtcccatcaggactataaacatattatttaatctcatctgagaaattcaatatattatgtattagatattccttttttgctagattgtccttagtgaga

SEQ ID NO: 91436 - DNA, 601 bp, Human
agtatatctattaataataactgtcttctttgaatggccacacataagcaatcggcaagagttccatattctgataagcaaaggtgtctgatggatcagaaatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttartgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagatttttcctcagctggattgaatttgagagccataccctgctctcattcatgtttactctcttatattttgctatagcatgatgtttaatgagatggggaagaaagt

SEQ ID NO: 91437 - DNA, 601 bp, Human
aatctgtcctcaaagtcaggagacagttaaacacccaaacttgggtcacattacccaagtaatagaaatctatgctgatatcctgagaaaggataatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagagkactttgaattctggacgtaaaatagctacctctttctcgtcccagctgataaaaacctatattataggttgaaattacagagaactcactcagatttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgt

SEQ ID NO: 91438 - DNA, 601 bp, Human
aatgaatttcacacagtagttctaaaatagtaataaaagtgatttgtgggcttttatttgttaaattcacaggcatctttttatcatgattataagctaggagttaatgatggataatggcattagttttatgtttctaatttaataaatgattagaaatagatttaaccttgtggtctttagatttagcttgtagtgcagtagaggactttgaattctggacgtaaaatagctacctctttctcgtcccagctgataaaaacctatattataggttgaaattacagagaactcactcagwtttttcctcagctggattgaatttgagagccataccctgctctcattcatgtttactctcttatattttgctatagcatgatgtttaatgagatggggaagaaagtacattattcatactttttaatgaaggggttatgcataggctttgtagtattaaggcccatacatatttgaataaaactgcaggaaagctttgagccatgtgaccatgtacacataaggaatgtaaaatctcatagttggaagggatggtctttaattttgtctgtttcaaaccctatctgtttttgatggaatt

SEQ ID NO: 91439 - DNA, 601 bp, Human
gaggcaggaaaatcacaaactcaggaggcagaggctgcagtgagccgagatcccaccactgcactccagcctgggtgacagagcaagactccgtctcaaaagctagggcaaaaaagttgtcttttagcaatagatattcattatttctctttacttttaagaaaacaattttttcaggtattcaaaacagtcttttgcctttaaatggaaaaaaaagtttttaaaaaagggtagtcatctagcacttttcaatatcaggtttttctttacttgctattagaaagtttactttggtgggaartcggtgtgataaggagtgaaaagactgagacacataaactgaaattcaactttggaaatgaatttttttcactcagtgagacttaaaaaatgaaccacccagctgcactggattttgtgttggaactttgagggtgtttttttttgttttgttttgttttttggagacagcattctcacactgtctcccaggcaggagtgcagtggcgtgatcacagcttactgcagccttgacctcccagactcaagcaattgtctcacctcaacctgaccagtagctgggactgtaggtgtgcaccac

SEQ ID NO: 91440 - DNA, 601 bp, Human
gaactgtttaaatatggaaacttcaaacgctgaagtgcgtattagggacatggaaccactgcctaatctgtcaaattttccctataaagggttccactgttcacatactcttaacgaacaatgtcctaatgtctcctgagaataaatcagtatggctttatactcaggatgaacagcagtttggtaccatttgaggcctcctcagctatcatgtaatacccctgatctattgggtggactgagaaagaatatgggaagagagttcttgtttgaatcctagccttggaagtgaactaaagaygctgtccagtttaaaatggaattagcactggaaggaaagtcaattgacatttcctgtggttcattactctttctgctatgtttttaactctatcagatactgtctaatatcataaataggcctttctgttttgtcagggtctctgagaattcccagataattcattggtcaatagagtttgaaatgctatttaaactttgggtcaccaagcacagtggctcatgcctgtgtaatcccagcactttgggaggtcaaggtgggaggatcgcttggggtccaggagtttgagactagcctggg

SEQ ID NO: 91441 - DNA, 601 bp, Human
agtacttttgagtatactggtacaaggttagaatattaatttagcctgttcatctccagctgtcccaccataaagagattgtagctcctgcagcaggctttctatactatggaaagaaactaattgctggttacaggcttaagctgacaggttgttctttccttagcagcctcttaaagtaactttaaacaatcattgttattattaagcatttatagcctgcttttgtgttttcaaagtgccttataatttctgtttgctttcctattgatgtccctaaaaagcaagttaatattgttayggtcacatgttgcacatgacataccaaagaaacagagggttaggtaatcttcttggtaccatctgtgatctgctttgggcattctcaaagcagaagctgaggtgtgcattctcttccttcactcattgaacccattttctcactgcttgctttagtgtgtgtgtattgtggcttttatacttttttgactgcaacttacagtaagaaatgtattttacatagtgtatacacacacaatatgtaaaactgaacagtttcaggaaatattacttactcttcatgagatgcactgtgatattt

SEQ ID NO: 91442 - DNA, 601 bp, Human
tgttttcaaagtgccttataatttctgtttgctttcctattgatgtccctaaaaagcaagttaatattgttatggtcacatgttgcacatgacataccaaagaaacagagggttaggtaatcttcttggtaccatctgtgatctgctttgggcattctcaaagcagaagctgaggtgtgcattctcttccttcactcattgaacccattttctcactgcttgctttagtgtgtgtgtattgtggcttttatacttttttgactgcaacttacagtaagaaatgtattttacatagtgtatccacacacaatatgtaaaactgaacagtttcaggaaatattacttactcttcatgagatgcactgtgatatttttcattttatttttttaatgccagtttgaacccacttagttaattttaagaactaccggttggtcatgacccaccaagctagggatacttgaagctaaaggatacacaatagcacattttcctagagcatcagttttattgaaaggtaaagagagaaacacatattaaaacatatatgggtacattatgggatttagcatggaacttcaaagatattttgttcttatg

SEQ ID NO: 91443 - DNA, 601 bp, Human
gagaagtactgtgcttttgggacttgtttgttcgtttgtgagacaggatctcactctgttgcccaggctggagtacagtggtgcagtcatagttcactgtaaccttgaactcctggacccctatcctcctatcctcttatcctcgtgcttcagcctcctgagtaactgggaccaaaggctcatgccactgcagtcagctttttttgttttgttttgatagagacaaggtctcacttaggttgcccaagcttgtctcgaactcctggccttaagtgatcctccttccgcctttggtctcccrtagtgctgggattacaggagtgagccactgtaccaagccccatagaacttttaagttcattattgtgtaaacccaagtgaggtcagaaactttgtatagtttattttacaactgttattcttactcagcacctattctgtgccagtcactattctagaaactgagaatattgtgacaaatagaagacaggaattctttccctcatggaatttatattctaccacaagtggggtatgtggcatggggacaggcaataaaccggcaaatcagtacaatacatagtatatcagatggtaggga

SEQ ID NO: 91444 - DNA, 601 bp, Human
actcagcacctattctgtgccagtcactattctagaaactgagaatattgtgacaaatagaagacaggaattctttccctcatggaatttatattctaccacaagtggggtatgtggcatggggacaggcaataaaccggcaaatcagtacaatacatagtatatcagatggtagggaggacagtggaaaaatataaaagaagtattgggacagtggaaaaatataaactggagttggaggttgggtggtacagttttacaaaaatatgttggtcatggaagacctatctgaaaagataayatttggttaaagcaaagactcaaaggagacagggaaagaatcatggatttctggaggaagagcattgtagacagaagaaacagcaaatgcaaaaagccatgaagtaggagtgtacctgctatgtgcaaggaaggaacaacaggctcctgcagctggattagagctagcaaggaggagagtattagcacgacctcagagaggttggaggagttggattataggcaattgcaacttggtttttattctgagtgagatggaaaggtttgagcagagaaatatttatgagctgacctacatttt

SEQ ID NO: 91445 - DNA, 601 bp, Human
ggaagtaagccattattatatgctatcatagaattgtatgcgttgggtgctgtggggaggtgttagagctttctgggaagtgttaatcttgaactgaaccttaaggttaaataggtattttccagacagtgctaagcttaaggagaagaaaatattaagcagaaagaacaacatataggctgggtgcggtggctcacgcctgtaattccagccctttgggaggctgaggtgggcagatcacgaggtcaggaattcgagaccagcctgaccaacatggtgaaaccccgtctctactaaaaayacaaaaattaggtggacgtggtggcacacgcctgtaatcccagctactcaggaggctgaggcaggagaatcgcttgaacccggggggcggaggttgcagtgagccgagatcgcgccattgcactccagcttgggtgacagagccagactctgtctcaaaaaaagaaaaaagaaagaacaacatataaaaaaggtacaaagctgtgactttcagtgtttggggaataagaagtaattttgatgtggttgaagttaaggaaataggctggagaggtagtctggagtcagatctggggaagcc

SEQ ID NO: 91446 - DNA, 601 bp, Human
gggggcggaggttgcagtgagccgagatcgcgccattgcactccagcttgggtgacagagccagactctgtctcaaaaaaagaaaaaagaaagaacaacatataaaaaaggtacaaagctgtgactttcagtgtttggggaataagaagtaattttgatgtggttgaagttaaggaaataggctggagaggtagtctggagtcagatctggggaagcctatgttactgaaatgaacccagttctagcctagagtgaaaatatgagagctgcaaaatacagattttgaaaagctaatgtaaragagatgaactgcttcccccaatgaatgacctgtgtagttgatcctataaagagatgacaatttaccaaggcagtagcaaaaggaatcattaagctaacaatctgccgataagccttttaaaaagtctcttctaatctcttttttaacataatagtagtactacatctgagcatatgtaagatttcagataagtctaatgtggttatccttaattaggatgctgagtaaaaaaggtaaaacaggagatggtgaaagcagagtgaaattttttttttttatttgagatggagccttgctct

SEQ ID NO: 91447 - DNA, 601 bp, Human
ctcaggtaatccgcctgcctcagcttcccaaggctcacatggtggctcacgcctgctgggattacaggcgtgagccactgtgcccagccgaatttttcttttttgaacagacactttctacagtacttatgagtcaaggctgttcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgcygcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttaga

SEQ ID NO: 91448 - DNA, 601 bp, Human
ttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtcccagattcagagattgtaattatttcatgtagggtagggcctggcatctgttttgaaaagcctttccagatgattctgatacaggtcttcagttaagaaccactaatattatcctctagag

SEQ ID NO: 91449 - DNA, 601 bp, Human
ttgttttttgttgttgagacggagtcttgctctgtcaccaggctggagtgcagtgacacgatttcggctcactgcagccttgcctcccaggttcaagcgattcttctgcctcagcctcctgagtagctgggactccaggcatgtgccaccacacctggctaattttttgtattttagtagagacagggtttcaccatgttggccaggatggtctcggtctcctgacctcgtgatctgcctgccttggcctcccaaagtgctgggattacaggcgtgagccaccgtgcccggcttcccccctttttttttttttttgacagagtcttgctttgtcacccaggctggagtgcggtggcgctatctcagctcactgcagcctccacctcccaagttcaagctattctcccacctcagcctcctgagtagctgggactacagccacgcgcctccacgcccagctaatttttgtatttttggtagagacggggtttcttcacgttggctaggctgatcttgaactcctgacctcaagtggtctgcctgcctcatcctcccaaagtgctgggattacaggcgtgagccactgcacccacccatgctc

SEQ ID NO: 91450 - DNA, 601 bp, Human; identical to SEQ ID NO: 21511

SEQ ID NO: 91451 - DNA, 601 bp, Human; identical to SEQ ID NO: 21512

SEQ ID NO: 91452 - DNA, 601 bp, Human; identical to SEQ ID NO: 21513

SEQ ID NO: 91453 - DNA, 601 bp, Human; identical to SEQ ID NO: 21514

SEQ ID NO: 91454 - DNA, 601 bp, Human; identical to SEQ ID NO: 21515

SEQ ID NO: 91455 - DNA, 601 bp, Human; identical to SEQ ID NO: 21516

SEQ ID NO: 91456 - DNA, 601 bp, Human; identical to SEQ ID NO: 21517

SEQ ID NO: 91457 - DNA, 601 bp, Human; identical to SEQ ID NO: 21518

SEQ ID NO: 91458 - DNA, 601 bp, Human; identical to SEQ ID NO: 21519

SEQ ID NO: 91459 - DNA, 601 bp, Human; identical to SEQ ID NO: 21520

SEQ ID NO: 91460 - DNA, 601 bp, Human; identical to SEQ ID NO: 21521

SEQ ID NO: 91461 - DNA, 601 bp, Human; identical to SEQ ID NO: 21522

SEQ ID NO: 91462 - DNA, 601 bp, Human; identical to SEQ ID NO: 21523

SEQ ID NO: 91463 - DNA, 601 bp, Human; identical to SEQ ID NO: 21524

SEQ ID NO: 91464 - DNA, 601 bp, Human; identical to SEQ ID NO: 21525

SEQ ID NO: 91465 - DNA, 601 bp, Human; identical to SEQ ID NO: 21526

SEQ ID NO: 91466 - DNA, 601 bp, Human; identical to SEQ ID NO: 21527

SEQ ID NO: 91467 - DNA, 601 bp, Human
tgcaggcaggggcaggccaatgaccagcttccccaaacccctccttcaacacctgattcagaatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggyagcccagagcttccctagccttccccagaactgctgtgtcagggatttgccccctgtccggctgtgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgtt

SEQ ID NO: 91468 - DNA, 601 bp, Human
aatcagacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagcccagagcttccctagccttccccagaactgctgtgtcagggatttgccccctgtccgkctgtgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccagg

SEQ ID NO: 91469 - DNA, 601 bp, Human
agacctcaaattgccttaaaaatgggtgagtcccagcctcttattaccaaactagaaactgaggcccagagaggttaccagatagtgttgggaacaaagctggaatgtgaacctaggtctcctgcctcctgatgcagccttcttcacccttctgggtcctgaagcacttaaggcccaggatctggaagaccccgggtgatttcaaacctaatgatccagtcctttcctgcaggggtagcccagagcttccctagccttccccagaactgctgtgtcagggatttgccccctgtccggctgkgaagactttcctcatttaagggtaggttttggggaactggcctccttttgttcctgtacccccaatcactacctgtccagtcttctgtcctgtcccagactcaggtggggctgggcagctttttcatataaaaccctcatcccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccaggctgc

SEQ ID NO: 91470 - DNA, 601 bp, Human
ccaaagatctaccagttctcttctgacaaagccatgccatcctgaaatgatggtcctctggggctggaggcagggctcgagccaggcctctgttggggcagggaggtgcctgattgagtctgctctgacctctcactctccccttcttctccaggctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactattctggctctgggcacctcatttgtcactgggtatatggcacttggttccagttggattgtaggaaacccagattgtggggcatttcagagaggggaccatggcagtgggggtctgggtgcaaggttcctgcaatcctgcctggccttggctctcctttgtgaactatggcaaactagggggtttattctaccaccctctagcaacggt

SEQ ID NO: 91471 - DNA, 601 bp, Human
ttttaacaaagatgagtgattggaaggagaggaggtctagtctctggtctctcatagtcatttacagaatgaaaataataaggaaagaataaattataatttaagaaccagaagttacgaacatgctatgtggctcaatcagggtgtaacttcccccttggtgtgataaatttatatggggtcctgaaacttttttttatagttggtaggttctccacactattgatcccacaacaatttttcgaggtagatgctgctatccacattttttttttttttgagacagtgtcttgctctgtcrtccaagctggagtacagtggcatgatctcagctcactgcaacctctgcttcctgggttcaagcaattctccagactcagcctcccaactagctgggattaaaggtgcccacaaccatgcctggctaatttttgtatttttcataaagaccaggtttcaccttgttggccaggctggtctcgaacacctgacctcagatgatctacccgcctcagcctcccaaagtgctgggattacaggcatgagccactgcgcccagcccacattttagaaaagggattctaaggcacagagagttcaa

SEQ ID NO: 91472 - DNA, 601 bp, Human
tttatccagaattttcctgttggttgtggtaaaccatggtttgttcttttgagacaggggcaagctctgttgcccaggcttctggtgtgcagtggcacaaacaccagcctcaacctcttgggcccagacaatccatttcagcctcccaaagcgctgggattacaggaatgagccatcatgcccggcctcacactatattttaatgctttttttgaaaatggaaacttttacaggcaattcacttccttcaaactaatgataaggaaatgatgctgttctgttttgttttgtttttacatgttttttttgtttgtttgtttcttttttgagacagggtcttgctctgttgcccaggctggagtgtggtggtgcaatcatggctcacttcagccttgacctcccaggctcaagcaatcccttccccctcagcctcccaagtagctgggactgcaagtgcatgctaccacacttggctaatttttgtattttttgtagagacaggttttcaccatgttgccgaggctggtctcaaactcctgggctcagctatcctctaccctcggcctcccaaagtgctgggattacaggcgtgagccactgt

SEQ ID NO: 91473 - DNA, 601 bp, Human
cggcctcacactatattttaatgctttttttgaaaatggaaacttttacaggcaattcacttccttcaaactaatgataaggaaatgatgctgttctgttttgttttgtttttacatgttttttttgtttgtttgtttcttttttgagacagggtcttgctctgttgcccaggctggagtgtggtggtgcaatcatggctcacttcagccttgacctcccaggctcaagcaatcccttccccctcagcctcccaagtagctgggactgcaagtgcatgctaccacacttggctaatttttrtattttttgtagagacaggttttcaccatgttgccgaggctggtctcaaactcctgggctcagctatcctctaccctcggcctcccaaagtgctgggattacaggcgtgagccactgtgcctggctgatgctgttcttttcaaatgcatttgttggttttttatgtgtttttttttttttttttttgagatggggtctctgtctcccaggctggagtgcagtggtgcaatctctgctcacagcaggctggtctcaaactcctgacgtcagatgttcttcccacctcaatatcccaaagtg

SEQ ID NO: 91474 - DNA, 601 bp, Human
gctgcttaggtgtcatggtgtgacagctggctttcccaagtgagtaatcaaagagtgaacaaggaggaagccacagtaccttttatgatgtagtttgcaaagttgcaaaccatcacttttgctttttcctatctgtcagaagggaatcagttaacccagcccccactcaaggggatagggactgggctccaccttttgaagagaatatcaaagaatttgtggacatattttaaactaccatgctatgtttaattatggcaagtatggtcactgtagaaaaactggaaaatagggacaagcaaaaaaaaaaaaagtcacttataattccatgactcaatggatgacattactagttgggtatatataattccaatattcaaaatatatatttactttctcaaactataaacacactgtgtactattgtgtaatcttctctttcacacaatgtattgtatgtattgtaaaaatacctttcacgtcaaatattctttcctaacttttttttttcttgagacggagtttccttcttgtcgcccaggctggagtgcagtggtgcaatctctactcactgcaacctccgcctcccgggttcaagcaa

SEQ ID NO: 91475 - DNA, 601 bp, Human
atcaaagagtgaacaaggaggaagccacagtaccttttatgatgtagtttgcaaagttgcaaaccatcacttttgctttttcctatctgtcagaagggaatcagttaacccagcccccactcaaggggatagggactgggctccaccttttgaagagaatatcaaagaatttgtggacatattttaaactaccatgctatgtttaattatggcaagtatggtcactgtagaaaaactggaaaatagggacaagcaaaaaaaaaaaaagtcacttataattccatgactcaatggatgacaktactagttgggtatatataattccaatattcaaaatatatatttactttctcaaactataaacacactgtgtactattgtgtaatcttctctttcacacaatgtattgtatgtattgtaaaaatacctttcacgtcaaatattctttcctaacttttttttttcttgagacggagtttccttcttgtcgcccaggctggagtgcagtggtgcaatctctactcactgcaacctccgcctcccgggttcaagcaattctcctgtctcagcctcccaagtagctgggattacaagcatgagc

SEQ ID NO: 91476 - DNA, 601 bp, Human
aaaaaaaaaaaaagtcacttataattccatgactcaatggatgacattactagttgggtatatataattccaatattcaaaatatatatttactttctcaaactataaacacactgtgtactattgtgtaatcttctctttcacacaatgtattgtatgtattgtaaaaatacctttcacgtcaaatattctttcctaacttttttttttcttgagacggagtttccttcttgtcgcccaggctggagtgcagtggtgcaatctctactcactgcaacctccgcctcccgggttcaagcarttctcctgtctcagcctcccaagtagctgggattacaagcatgagccacccacacccagataattttttgtatttttagtagagatggggtttcaccatgttggccaggctggtctcaaactcctgacctcaagtgatccacccacctcagctccccaaagtgctgggattacaggtttgatccaccgtgcccagcccctcataatattttttaatggctgcatacatttcatcatatgtatgtatcataacttatttaacgaattctattataggacacttaggttgtttacaagtttt

SEQ ID NO: 91477 - DNA, 601 bp, Human
tggtgcacacctgtaatcccagctacttgcgaggctgaggcaggagaattgcttcaacctgtgaggcggaggttgcagcgagccaagattgcgcctgggcaacaagagcgaaactctgtctcaaaaaaacagagtgaacttcacacatctgtcccagcaaactataaatggtatatagcagaattctggtattttccattctgagttttttgttctttgttttaattaactttttcttaatttgttttttggatagaatagattaactgcttcaaaatccaaaagctactgactgcccccygcaccacagacacccagtcccactgcctgaaggcaaccagtgttatcaacttcagatattttatgcatatccaatatggtcttttctgttttacacaaataatagcacactgtactcaattctaccccttccttttttttatcacttgtagtttattttggaaatcatttcacatcaatatacagagaagattcctcattctttttttatagttgcatattatgtgaatgtgtcttttttttttttttttttttttgagatggagtcttgctgtcgcccaggctggaatgcagtggtgca

SEQ ID NO: 91478 - DNA, 601 bp, Human
cttaatttgttttttggatagaatagattaactgcttcaaaatccaaaagctactgactgccccccgcaccacagacacccagtcccactgcctgaaggcaaccagtgttatcaacttcagatattttatgcatatccaatatggtcttttctgttttacacaaataatagcacactgtactcaattctaccccttccttttttttatcacttgtagtttattttggaaatcatttcacatcaatatacagagaagattcctcattctttttttatagttgcatattatgtgaatgtgtcttttttttttttttttttttttgagatggagtcttgctgtcgcccaggctggaatgcagtggtgcaatcttggctcactgcaacctctgcctcctgggatcacgccattctcctgcctcagcctcccgagtagctgggactacaggcacgtgccacctcacccggctaatttttgtatttttactagagacagggtttcaccatgttagccaggatggtctcaatctgctgaccttgtgatctgcccacctcggcctcccaaagtgctggaattacaggcgtgagccaccacgcccagcct

SEQ ID NO: 91479 - DNA, 601 bp, Human
atccaaaagctactgactgccccccgcaccacagacacccagtcccactgcctgaaggcaaccagtgttatcaacttcagatattttatgcatatccaatatggtcttttctgttttacacaaataatagcacactgtactcaattctaccccttccttttttttatcacttgtagtttattttggaaatcatttcacatcaatatacagagaagattcctcattctttttttatagttgcatattatgtgaatgtgtcttttttttttttttttttttttgagatggagtcttgctgtcrcccaggctggaatgcagtggtgcaatcttggctcactgcaacctctgcctcctgggatcacgccattctcctgcctcagcctcccgagtagctgggactacaggcacgtgccacctcacccggctaatttttgtatttttactagagacagggtttcaccatgttagccaggatggtctcaatctgctgaccttgtgatctgcccacctcggcctcccaaagtgctggaattacaggcgtgagccaccacgcccagcctgccattatttttttaaccaatattctattggcaggaattta

SEQ ID NO: 91480 - DNA, 601 bp, Human
taaaaagtcttattatttgtaaagcattcattcttttaagaagttatgtaaaaataaagctttgttttttacaaaagatttttatataattcaccctttttattgtttgaaatctttttatttcaatacttttgggggaacaggtggtgtttggttacatggaaaagttctttagtggtgatttctgaggttttgatgcacccatcacccgagcaatgtacaccgtactcaacagtgtagtcttttatcccttacccacctagcacatccctccaaatccccagagcccattatatcattsttttgcctttgcatcctcatagcttagctgccacattattcaccctttagttccaagtacattctgctgttgctgggacacaggaaggctgttttaaactctacttcctctgatggaagggagaaatttctgattgacatcaagcagaaatggttccatgtgtgcttcctctcctcaataaacctcactccaaccgcaagggactttcccatgagccccttatgaaatgccactagccaaatttccccttattttagcgatgtttaatgtaactgttgaaagcatttcaggctgggcctg

SEQ ID NO: 91481 - DNA, 601 bp, Human
ttcttttaagaagttatgtaaaaataaagctttgttttttacaaaagatttttatataattcaccctttttattgtttgaaatctttttatttcaatacttttgggggaacaggtggtgtttggttacatggaaaagttctttagtggtgatttctgaggttttgatgcacccatcacccgagcaatgtacaccgtactcaacagtgtagtcttttatcccttacccacctagcacatccctccaaatccccagagcccattatatcattcttttgcctttgcatcctcatagcttagctsccacattattcaccctttagttccaagtacattctgctgttgctgggacacaggaaggctgttttaaactctacttcctctgatggaagggagaaatttctgattgacatcaagcagaaatggttccatgtgtgcttcctctcctcaataaacctcactccaaccgcaagggactttcccatgagccccttatgaaatgccactagccaaatttccccttattttagcgatgtttaatgtaactgttgaaagcatttcaggctgggcctggtggcttatgcctgtaatcccagcccttgc

SEQ ID NO: 91482 - DNA, 601 bp, Human
gttttgatgcacccatcacccgagcaatgtacaccgtactcaacagtgtagtcttttatcccttacccacctagcacatccctccaaatccccagagcccattatatcattcttttgcctttgcatcctcatagcttagctgccacattattcaccctttagttccaagtacattctgctgttgctgggacacaggaaggctgttttaaactctacttcctctgatggaagggagaaatttctgattgacatcaagcagaaatggttccatgtgtgcttcctctcctcaataaacctcackccaaccgcaagggactttcccatgagccccttatgaaatgccactagccaaatttccccttattttagcgatgtttaatgtaactgttgaaagcatttcaggctgggcctggtggcttatgcctgtaatcccagcccttgcaggccgaggtagatggatcacctgaggtcaagagctcaagaccagcctgaccaacatggcgaaaccctgtttctactaaaataaaaaattagccaggcgggttgacgtgcgcctgtaatcccaactactcggaaggctgaggcaggagaatcgcttgaa

SEQ ID NO: 91483 - DNA, 601 bp, Human
taggcgtttgtgtctcccctccttgaaacttaacttcgtgaaggtagaatcttatctgatttggtgcagtatctccataacccagttagacagtaaatttttgttgaatttaccagtgtatggttactgtcccaattctggacacaaattctataatacatatgaaaaggagctgaaaatatatagtaatacataaatgtaaaacattattgctgcctgaatttaacttttgctgactggatccacagacaagaaagagaaataccaaatacaactaattcaactctgtttatttttgacraaaccgatttctttcattcagttcatactacgcgtccacactgtgcctccaaaaatatttgcccttataactgaatgctcagaaaggctaagaaatctgcccaaggtcccctggcaatccagccagagatgtgagtcactcttaaggttggatttaatacaaatgtttgaaggacggagcgacaggccagctgccctagggaagcaaaatgctaagtgctctgatgcgaggaccggaggacaaggttcgcggatgaaccacaggaacttccgggttttaaagatcctggcgccaagttca

SEQ ID NO: 91484 - DNA, 601 bp, Human
actggatccacagacaagaaagagaaataccaaatacaactaattcaactctgtttatttttgacgaaaccgatttctttcattcagttcatactacgcgtccacactgtgcctccaaaaatatttgcccttataactgaatgctcagaaaggctaagaaatctgcccaaggtcccctggcaatccagccagagatgtgagtcactcttaaggttggatttaatacaaatgtttgaaggacggagcgacaggccagctgccctagggaagcaaaatgctaagtgctctgatgcgaggacccgaggacaaggttcgcggatgaaccacaggaacttccgggttttaaagatcctggcgccaagttcagggcgttgaccgcgaaggacgaggcgtccccgtgacgtcctgctcttccaatgaacttcaggcctgcggagacgacggagaacggaagttctctgcctgtgtgctggttggttgcgcgttgaggccagccccgcctcccatcttccggtctcctcagaagtcgcttagctcttcggtggttgtcacacgtccggaggcctagccgtcgcgtacctaggatgccgcgtggaagccg

SEQ ID NO: 91485 - DNA, 601 bp, Human
tgagattggatcgtgacactgcactccagtctgggcatcagagtgaggccctgtctcaaaaaaaaaaaaaaaattaggccgtgcgtggtggttcacacctgtaatcccagcactttgggagtccgaggcgggtggatcacctgaggtcaggagctggagaccagccatggtcaccatagtgaaacctcgtctcaactaaaaatacaaaaaattagccggaggtggtcgcgggtgcctgtaatcccagctactcggaaggctgaggcaagagaatcgcttgagtctgggaggtggaggttgyagtgagctgagattgcgccattgcactccagcctgggcaacaagagcgaagctccatctcaaaaaaaaaaaaattgaagagagaaaatgatgtaaataatttgaaatgaaaatcttgaggtccattttaatatgtaagttattttaagttgacaatttccaaaactggttggaattgggaacttgatgtttttttcttttctttcacagccgggcccctcagatgagagctgcacccaggccagcaccagtcgctcagccaccagcagcggcacccccatctgcagttggctcttctgct

SEQ ID NO: 91486 - DNA, 601 bp, Human
actgcactccagtctgggcatcagagtgaggccctgtctcaaaaaaaaaaaaaaaattaggccgtgcgtggtggttcacacctgtaatcccagcactttgggagtccgaggcgggtggatcacctgaggtcaggagctggagaccagccatggtcaccatagtgaaacctcgtctcaactaaaaatacaaaaaattagccggaggtggtcgcgggtgcctgtaatcccagctactcggaaggctgaggcaagagaatcgcttgagtctgggaggtggaggttgcagtgagctgagattgcrccattgcactccagcctgggcaacaagagcgaagctccatctcaaaaaaaaaaaaattgaagagagaaaatgatgtaaataatttgaaatgaaaatcttgaggtccattttaatatgtaagttattttaagttgacaatttccaaaactggttggaattgggaacttgatgtttttttcttttctttcacagccgggcccctcagatgagagctgcacccaggccagcaccagtcgctcagccaccagcagcggcacccccatctgcagttggctcttctgctgctgcgccccggcagcc

SEQ ID NO: 91487 - DNA, 601 bp, Human
ctctcctgtcattcctagcttccttgcttcagaattgaaatggaagtgggggtgtccctactctgtagaatctgggactgggcaaatgtttgtgtggcctccttaaactagctgttatgttatgattttattctttgtgagttaattagaataaagtcattttcttccaaggtatggttcatttagtctatagtctctggttatgaaattagcatcctcccagatctgacagctccctgaggggttatataaggagtagctcacttgcaaacataacatgctgctcaattcaaaggttctrgctgctgtgggtctggagttatgtaagctgagcagtagcaggaaactctgcttaaaatattgtttaaagctgtgcgtgctggcatgtgcctgtaatcccagctacttgggagactgaggcgggagaatcacttgaacccaggaggtggaggttgcagtgaactgagaccatgccactgcactcactgacagagcaagactctgtctcaaaaaaaaaaaaaaaatacattgttttaatcaggtgaatgataaaggaaacaggaataggtctatttggggtgggttccctgtggctaggtca

SEQ ID NO: 91488 - DNA, 601 bp, Human
attgttttaatcaggtgaatgataaaggaaacaggaataggtctatttggggtgggttccctgtggctaggtcagcactgcgtatcactattcctctactgtttccaagcaagcttgtgcaacccaccttttgttctgttttcttttgctttaggcttttagcagcctggagttatagtttgtctctagtgataagtggaaaagagcgatgaggaaggggttttactggcctaaccataaactgtaactaaacccatgactgcattctctcccttggacgcccctgattgaagataaaaarccattcttaatatatgcagttcccctgaaggtgcttttgctctgtttaaggtgttgtagcctcctcttcctaaaacactcaggctaactgccatcccccactccgtgctagggaagaactttaaggggatggaattcaatttggagtaggccacttttttcatgtcagatgggtagtgtgtcaatgcaaccagttttgagggaggcacacttcatgagtgtgaaaaccctgtcatcacacttaactacaaaaggatcagcaggtcttttttttttttttttgaagtgagcagcagagatg

SEQ ID NO: 91489 - DNA, 601 bp, Human
tggaattcaatttggagtaggccacttttttcatgtcagatgggtagtgtgtcaatgcaaccagttttgagggaggcacacttcatgagtgtgaaaaccctgtcatcacacttaactacaaaaggatcagcaggtcttttttttttttttttgaagtgagcagcagagatggtttcactatgttgatcaggctggtatagaactcctgacctcaggtgatcccccagcctcggcatcccaaagtgctgggattgtaggcatgagccaccacacctggcctccgtaggttctgttttctgattttttttctgagtttcagagccctgcatcactgccaggtgagtgaaatgctggtgattgagggaattagccagttgctgtctcgcctcctatcagctgtgttcctggagtgcctaaacattcagttcctgaaagaggctccctttcagaaagagggtctcagcacagttcactcctggccagttccccggcatattccctcctgggtttatagaagacacttttgctaattttcctggaggctcgggacctctgtgagtctgtagtgttaatgctcagatgtccctcgtgtccaggtgta

SEQ ID NO: 91490 - DNA, 601 bp, Human
aggctggtatagaactcctgacctcaggtgatcccccagcctcggcatcccaaagtgctgggattgtaggcatgagccaccacacctggcctccgtaggttctgttttctgattttttttctgagtttcagagccctgcatcactgccaggtgagtgaaatgctggtgattgagggaattagccagttgctgtctcgcctcctatcagctgtgttcctggagtgcctaaacattcagttcctgaaagaggctccctttcagaaagagggtctcagcacagttcactcctggccagttcccyggcatattccctcctgggtttatagaagacacttttgctaattttcctggaggctcgggacctctgtgagtctgtagtgttaatgctcagatgtccctcgtgtccaggtgtagtggtgattcaaataaattgaatcaaagaaaaatgacgaaatgtaagcgtgactggccaggcctactccctggtaggagtcattgctacaaggagaaaggtgtggaataatcctctaggtgcactggccttttgccctaaagtcagaaaggattttgtgatgcattcattgattgtccagttggcgct

SEQ ID NO: 91491 - DNA, 601 bp, Human
cctcgtgtccaggtgtagtggtgattcaaataaattgaatcaaagaaaaatgacgaaatgtaagcgtgactggccaggcctactccctggtaggagtcattgctacaaggagaaaggtgtggaataatcctctaggtgcactggccttttgccctaaagtcagaaaggattttgtgatgcattcattgattgtccagttggcgctccaattccctgagtttggtgtccatggattcagccaatcgaggattgagaatatttgaagtctgtgcaataaagtgagatccctacaaaaaataamtcagccaggtgcagtagcatgcacctgtagtcccagccactagggaggccgaggtgggatcacagaagcccagttcaaggttgcagtgatctatgatcacaccactgaactccagcccagagtgagaccctgtctcaaaataattttttggaaaaattcatggtcatttttgtaggaaacatgtagactattttccttgtcattccctaaacaatacagtgtaacaactttacatcctgtttatgttatactaggtattataagtaatctagagatgatttaaagtatacagcaggaaat

SEQ ID NO: 91492 - DNA, 601 bp, Human
atacagtgtaacaactttacatcctgtttatgttatactaggtattataagtaatctagagatgatttaaagtatacagcaggaaatgcataggttatatgcaaataatgtggcattttatgtaagggatgtgagcatccgtggatttttgttatccataggagccttggaaccaatcttggaagataccttagaaaccagcaagagtcaaatctgtagcttagaaatgtgagggagaaaataggtttttaatggtaaattaggcagggcgcagtggctcatgcctgtaatcccagcacgytgggaggctgaggagggcggatcacctgagttcaggagtttgagaccagcctagctaacatggtgaaatctcatctctactaaaaacacaaaaattagcaaggcatggtggtgggtgcctgtaatcccagctacttgggaggctgaggcaggggaattgattgaacctgggaagcagaggttgcagtgagatgagattgtgccactgcactccagcctgggcaacagagcaggactgtctcaaaaaaaaaaaaaaaaaaaaattagccaggcctggtggcacacacttgtagtctcagct

SEQ ID NO: 91493 - DNA, 601 bp, Human
gtgagcatccgtggatttttgttatccataggagccttggaaccaatcttggaagataccttagaaaccagcaagagtcaaatctgtagcttagaaatgtgagggagaaaataggtttttaatggtaaattaggcagggcgcagtggctcatgcctgtaatcccagcacgttgggaggctgaggagggcggatcacctgagttcaggagtttgagaccagcctagctaacatggtgaaatctcatctctactaaaaacacaaaaattagcaaggcatggtggtgggtgcctgtaatcccarctacttgggaggctgaggcaggggaattgattgaacctgggaagcagaggttgcagtgagatgagattgtgccactgcactccagcctgggcaacagagcaggactgtctcaaaaaaaaaaaaaaaaaaaaattagccaggcctggtggcacacacttgtagtctcagctactcaggctgaggcaaggagaattgcttgaaccctggatgcagtgagccaggatcgtgctactacactccagcctgggtgacagagtgagactcttctctcaaaaaaaaaaaaaaaaaaaaaaagcaaat

SEQ ID NO: 91494 - DNA, 601 bp, Human
aaacacaaaaattagcaaggcatggtggtgggtgcctgtaatcccagctacttgggaggctgaggcaggggaattgattgaacctgggaagcagaggttgcagtgagatgagattgtgccactgcactccagcctgggcaacagagcaggactgtctcaaaaaaaaaaaaaaaaaaaaattagccaggcctggtggcacacacttgtagtctcagctactcaggctgaggcaaggagaattgcttgaaccctggatgcagtgagccaggatcgtgctactacactccagcctgggtgacasagtgagactcttctctcaaaaaaaaaaaaaaaaaaaaaaagcaaattagacctggcacagtggctcatgcctgtgatcccagcactttgggaggccgaggtgggtagataacctgaggtcaggagttcaagaccagcctggctaacatggtgaaaccccatctctactaaaaataaaaataaattagccaggtgtggtgacgtacgcctgtaatcctagctactcaggaggctgaggcaggagaatcgcttgaacccgggaggcagaggttacagtgggccaagattgtgccattgcact

SEQ ID NO: 91495 - DNA, 601 bp, Human
ggcatggtggtgggtgcctgtaatcccagctacttgggaggctgaggcaggggaattgattgaacctgggaagcagaggttgcagtgagatgagattgtgccactgcactccagcctgggcaacagagcaggactgtctcaaaaaaaaaaaaaaaaaaaaattagccaggcctggtggcacacacttgtagtctcagctactcaggctgaggcaaggagaattgcttgaaccctggatgcagtgagccaggatcgtgctactacactccagcctgggtgacagagtgagactcttctctcaaaaaaaaaaaaaaaaaaaaaaagcaaattagacctggcacagtggctcatgcctgtgatcccagcactttgggaggccgaggtgggtagataacctgaggtcaggagttcaagaccagcctggctaacatggtgaaaccccatctctactaaaaataaaaataaattagccaggtgtggtgacgtacgcctgtaatcctagctactcaggaggctgaggcaggagaatcgcttgaacccgggaggcagaggttacagtgggccaagattgtgccattgcactccagcctgggctacaaga

SEQ ID NO: 91496 - DNA, 601 bp, Human
tcattccctgaagtatttttcagctcttttgtatgtaaacaattcaacaaaaattttccccaaagtgaaagaaatagatggtcagcattattattattatttttttatttttgggacagagtctagcattattattattattattattattgagaccgagtctagctctgtcaccaggctggagttcagtggtgtgatctcggctcactgcagtgcctcccgggttcaaacaattcacctgcctcagcctcctgagtagttgggattacaggcatgtgccactgtgcccagttaatttttrtatttttagtagggacggtttcaccatgttggacaggatggtctcaatctcctgacctcatgatccgcccacctcagcctcccaaaatgctgggattacagatgtgagccaccgcacccagccagatggtcagcattataaggaactgctggcgcccacaacatctggggttaatctaggctctctgactcacctacttggcaaccttgaccaagtcacaatctctctaaaattggcttaataccagggtttcgttgtccaagtgaaactgtatgaagtgctttgtaaaatgtgtatcaa

SEQ ID NO: 91497 - DNA, 601 bp, Human
aattaggtatctgtggtcaagtgtggtttctcacacctgtaatcccagcactttgggaggaccaaaacaggaggattgcttaagcccagaattttgagaccagtctaggcaacatcgtgagacccctatctcttgttattttattttttattttttttgaggcagagtctcgctctgtcacccaggctggagtgcagtggcacgatctcggctcactgcaacctctgcctcccgggttcaagcaattctcctgcttcaacgtccagagtacctgggactacaggcacccaccaccacgccrgactaatttttgttttgtttgtttgtttgtttgtttcttgagacggagtctcactgtattgcccaggctggagtgcagtggcgcaatctcggctcactgcaagcttcacctcctgggttcacgccattctcctgactcagcctcctgagtagctgggactacaggcatctgccaccatgcccggctactttttgtattttcagtagagacggggtttcaccatgttagccaggattgtctcgatatcctgacctcgtgatccacctgcctcggcctcccaaagtgctgggattacaggcg

SEQ ID NO: 91498 - DNA, 601 bp, Human
tgggaggaccaaaacaggaggattgcttaagcccagaattttgagaccagtctaggcaacatcgtgagacccctatctcttgttattttattttttattttttttgaggcagagtctcgctctgtcacccaggctggagtgcagtggcacgatctcggctcactgcaacctctgcctcccgggttcaagcaattctcctgcttcaacgtccagagtacctgggactacaggcacccaccaccacgccggactaatttttgttttgtttgtttgtttgtttgtttcttgagacggagtctcrctgtattgcccaggctggagtgcagtggcgcaatctcggctcactgcaagcttcacctcctgggttcacgccattctcctgactcagcctcctgagtagctgggactacaggcatctgccaccatgcccggctactttttgtattttcagtagagacggggtttcaccatgttagccaggattgtctcgatatcctgacctcgtgatccacctgcctcggcctcccaaagtgctgggattacaggcgtgagccaccacgcccagcctaatttttgtatttttagtagagatgtggtttca

SEQ ID NO: 91499 - DNA, 601 bp, Human
gctggagtgcagtggcgcaatctcggctcactgcaagcttcacctcctgggttcacgccattctcctgactcagcctcctgagtagctgggactacaggcatctgccaccatgcccggctactttttgtattttcagtagagacggggtttcaccatgttagccaggattgtctcgatatcctgacctcgtgatccacctgcctcggcctcccaaagtgctgggattacaggcgtgagccaccacgcccagcctaatttttgtatttttagtagagatgtggtttcaccatgttggccagrctggcctcgaactcctgacctcaggtgatccgcccacctcagcctcccgaagtgctgggattgcagatgtgagccaccgcacgcagctcccatctctattttaaaaattaaaaatacatacaaaattaaaaacagccaggtgccatggcacgcgcctgtagtgccaactactcgggaggctgaggcaggggaatcacttgaacttgggaggcggaggttgcagtgagacaagatctcaccactgcactccaccctggcaacagagggagactccacctcaaaaaaaaaaaaaagaaaaaa

SEQ ID NO: 91500 - DNA, 601 bp, Human
ccgagatcatgccactgccctccagcccaggcaacagagcaagactccgtctcaataaaataaaataaataaaacacataaataattttaaaaacccacacatctgatgtaagattaaaggaaggtttttttgttttgagacagggtctccctttgtcacccctggctggagtgcagtggcatgacttcggctcactgcaacttccgctttccaggtttaagtgattctcctgtctcagcctcctgagtagctgggattacaggtgtgcactaccacggctggctaatttttgtattcttsgtagagatagggtttcatcatgttgtccaggctagtctcgaactcctgacttcaggtgatccacccgccttggcctcccaaagtgctgggattacaggcatgagccaccgtgcctggccttaaaggaaggctttttagatgaaattatggagggtagatcagaggtggattcctgcaggggaaggtcccttattgattgattgattgattcagactgagtctctgttgctcaggctggagtgcagtggcatgatcatagctcactgaagccttgacctcccaggctcaagtgatcctccc

SEQ ID NO: 91501 - DNA, 601 bp, Human
ttgacctcccaggctcaagtgatcctccccactaagcctcttgagtagctgggaccacaggtgtgtgccactacacctggctaattttttaatttttttgtagagccagggtctcactttgttgcccaggctgctgtcaaactcttggacttaaacaatcctcccgcctcggtctcccaaagcgctgggtgtgagccactgcacccggcctccctaacctgtacaggtctgcattatgtagggtgatcatgcacactgtccctgcgacagcccgggcagtcagctgctgcagtcatgcatygagaaagcctccagggcagtgctctcagcatacgtggaaatcaaaattgctcccagagaagcaagtgccctccgcacaaggctggatttacgttctctgggcctggaggccaagggagctccagaggggagactgatcactcttacatcctgtctggcctggtctcaggccacacaagcttccctcaccctccaccagaggtcccccaccttccgcccggagactgggctccatgccctgtccctgcggagccttggcctgcctcccgggtttgcagttgtgatttatttttggcacgtt

SEQ ID NO: 91502 - DNA, 601 bp, Human
ccaggctcaagtgatcctccccactaagcctcttgagtagctgggaccacaggtgtgtgccactacacctggctaattttttaatttttttgtagagccagggtctcactttgttgcccaggctgctgtcaaactcttggacttaaacaatcctcccgcctcggtctcccaaagcgctgggtgtgagccactgcacccggcctccctaacctgtacaggtctgcattatgtagggtgatcatgcacactgtccctgcgacagcccgggcagtcagctgctgcagtcatgcattgagaaagyctccagggcagtgctctcagcatacgtggaaatcaaaattgctcccagagaagcaagtgccctccgcacaaggctggatttacgttctctgggcctggaggccaagggagctccagaggggagactgatcactcttacatcctgtctggcctggtctcaggccacacaagcttccctcaccctccaccagaggtcccccaccttccgcccggagactgggctccatgccctgtccctgcggagccttggcctgcctcccgggtttgcagttgtgatttatttttggcacgttagcctccg

SEQ ID NO: 91503 - DNA, 601 bp, Human
cctaacctgtacaggtctgcattatgtagggtgatcatgcacactgtccctgcgacagcccgggcagtcagctgctgcagtcatgcattgagaaagcctccagggcagtgctctcagcatacgtggaaatcaaaattgctcccagagaagcaagtgccctccgcacaaggctggatttacgttctctgggcctggaggccaagggagctccagaggggagactgatcactcttacatcctgtctggcctggtctcaggccacacaagcttccctcaccctccaccagaggtcccccacctyccgcccggagactgggctccatgccctgtccctgcggagccttggcctgcctcccgggtttgcagttgtgatttatttttggcacgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccgtgagtagctagcccagtgatggacaaaagccaggtgataggcagggagcggggag

SEQ ID NO: 91504 - DNA, 601 bp, Human
taggctggagtgcactggtgcactctcagctcactgcaaccccacctcctgggttcaagtgatcctcctgcctcagccttccaagtagctgggaccacaggcccgagagccatcatgcctggctaatttttgtattttttgcagagatggggtctcgccatgtagcccaggctggtctcgaactcctgacctcaagtgatctgcccacctcagcctcccaaagtgctgggatgacaggtgtgagccatcacgccacgcctaaatcctacatctgaagcaggagttgagttccctggtaggrgcctccatgttcctgacacaaagcggggtagctcagcgcctctgtgtacaggcctgagtgtcctggctctctactgcctctatcctgcagcaggacccctcagggctcactggccattgttaagtaggacatggggcattcttccagcaggaccctgagccaaaggggtacctgcccaacccttgactcacattcaaggtatagcccctgccggacacctgcactgggtatggggggcagagatggctaggacatcctagagatgataatctagtgggggaggtgacagcatacactgac

SEQ ID NO: 91505 - DNA, 601 bp, Human
ctcagccttccaagtagctgggaccacaggcccgagagccatcatgcctggctaatttttgtattttttgcagagatggggtctcgccatgtagcccaggctggtctcgaactcctgacctcaagtgatctgcccacctcagcctcccaaagtgctgggatgacaggtgtgagccatcacgccacgcctaaatcctacatctgaagcaggagttgagttccctggtaggagcctccatgttcctgacacaaagcggggtagctcagcgcctctgtgtacaggcctgagtgtcctggctctstactgcctctatcctgcagcaggacccctcagggctcactggccattgttaagtaggacatggggcattcttccagcaggaccctgagccaaaggggtacctgcccaacccttgactcacattcaaggtatagcccctgccggacacctgcactgggtatggggggcagagatggctaggacatcctagagatgataatctagtgggggaggtgacagcatacactgacaagtgacaccagaggcagggaccaggatggacccacccagctctccatccctcagagcacccagcatggtg

SEQ ID NO: 91506 - DNA, 475 bp, Human
atgaccccatctctacaaagatttttttttttttgagccggagtctggctgtgtcgcccaggctggagggcagtgatgcgatctcggctcactgcaacctctgcctcctgggttcaagcgattctcctgcctcagcctcccaagtagctgagactacaagcgtgtgccaccacayccggctaatttttgtatagtagagatgaggtttcaccatgttggccaggctggtctcgaaatcctggcctcaagtgatctatctgcctcagcctcccaaagtctgggattataggtgtgagccaccacgaacggcctcaattcacaaacatttatttggaacattcactataggccagtgtagtgccaggagatgtaaggatgagtgagaaacagttccagaccccaaggagaacagcccctgggtcaggaaggctgacagcttctttcttttcccctctcagagccacccagagttccc

SEQ ID NO: 91507 - DNA, 601 bp, Human
ggcaggcgcaatggctcacacctgtaatcccagcactttgggaggctgaggtgggaggattgcttgaggccaagagttcaagatcagcctgggcaacatagcaagaccccgtatctttttttttttttttttaagatagggtcttgccctgtcatccaggttggagtacagtggcatgatcttgactcactacgatctctgcctcctaggctcaagtgatcctcccacctcagcctccctagtagctgggacaacaggtatgtgccaccaggtctggctaaccatctctattttttttttwaaaagggggggccaggcacagtggctcatgcctgcaatagcagcacttcctgcaataccagggaggccaaggcaggaggatcacctgagatcaggagtttgagaccagcctggccaacatgttgaaaccccatctccagtaaaaatacaaaaattagctgctgtgtggtggcaggtacctgtagtcccagctactcaggaggctgaggcaagagaattgcttgaacccgggaggtggaggttgcagtgagctaagattgtgccactgcactccagcctggcaatagagcgagactccgtc

SEQ ID NO: 91508 - DNA, 601 bp, Human
gcaggcgcaatggctcacacctgtaatcccagcactttgggaggctgaggtgggaggattgcttgaggccaagagttcaagatcagcctgggcaacatagcaagaccccgtatctttttttttttttttttaagatagggtcttgccctgtcatccaggttggagtacagtggcatgatcttgactcactacgatctctgcctcctaggctcaagtgatcctcccacctcagcctccctagtagctgggacaacaggtatgtgccaccaggtctggctaaccatctctatttttttttttaaaagggggggccaggcacagtggctcatgcctgcaatagcagcacttcctgcaataccagggaggccaaggcaggaggatcacctgagatcaggagtttgagaccagcctggccaacatgttgaaaccccatctccagtaaaaatacaaaaattagctgctgtgtggtggcaggtacctgtagtcccagctactcaggaggctgaggcaagagaattgcttgaacccgggaggtggaggttgcagtgagctaagattgtgccactgcactccagcctggcaatagagcgagactccgtct

SEQ ID NO: 91509 - DNA, 601 bp, Human
tggctcacacctgtaatcccagcactttgggaggctgaggtgggaggattgcttgaggccaagagttcaagatcagcctgggcaacatagcaagaccccgtatctttttttttttttttttaagatagggtcttgccctgtcatccaggttggagtacagtggcatgatcttgactcactacgatctctgcctcctaggctcaagtgatcctcccacctcagcctccctagtagctgggacaacaggtatgtgccaccaggtctggctaaccatctctatttttttttttaaaaggggggrccaggcacagtggctcatgcctgcaatagcagcacttcctgcaataccagggaggccaaggcaggaggatcacctgagatcaggagtttgagaccagcctggccaacatgttgaaaccccatctccagtaaaaatacaaaaattagctgctgtgtggtggcaggtacctgtagtcccagctactcaggaggctgaggcaagagaattgcttgaacccgggaggtggaggttgcagtgagctaagattgtgccactgcactccagcctggcaatagagcgagactccgtctcaaaaaaaaa

SEQ ID NO: 91510 - DNA, 601 bp, Human
ccccatggggtgaggggccccccgaggccatctgtcctctgcactcccaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagtgagtgatggccccaagccacacggcagggtgcccccctgtgattctgccctgacagcccaagccagggartgtggccccaccgcacagccaactagaaccacccaggctcaaggctcccagctccaccctcactgctctgatagaaggggtcccaggcagggatggatgcaggcaggggaatgggggtttgatgtccctgggctgaattagccaggcatgctggtgcatgcctgtaatcccagccactcgggaggctgaagcaggagcatcactcaagcccagtagtttgaggctgcagtgagttatgattgcactattacactccagcctgggtgagacagtgagatcctgtctctaataataataata

SEQ ID NO: 91511 - DNA, 601 bp, Human
attatgggagtgataatagcacagtgactggcatagtgtgaatactaataattattagctacaggcgggcgcagtggctcacaaccgtaatcccagcagtttgggaggctgaggccccagctacgcgggaggctgaggcaggagaatcgcttgaacccaggaggcggaggttgaagtgagccgagatcacgccgttgaactccagcctgggctacgagagcgaaactccatctcaaaaacaaaaacaaaacaaaacaaaaaaaaccccaaaactcttggcctcacgtgattctcccacctyggcctcccaaagtgctgggattacaggcataagccaccgtgcctggcacagtatagtgatataattgttctattttattattggttgttagtctctgactgtgcctaacttataaacttcatcttaggtatgtacatataggaaaaacatagtaagtataggcttcagtgctatccatggtttcaggcatccactgggggtcttggaacatatcctatgcagataaagagggatgactgtagacatatataaagtagaacaaggggttagcaagagacaggggcttccttagaccgagtg

SEQ ID NO: 91512 - DNA, 601 bp, Human
atagtaagtataggcttcagtgctatccatggtttcaggcatccactgggggtcttggaacatatcctatgcagataaagagggatgactgtagacatatataaagtagaacaaggggttagcaagagacaggggcttccttagaccgagtggtcaggaaagcatgtccaggaagtgacccaagcagagggtggcaggatgtaaggtcggtcagcaccaaagaccaggtcctgcaggcattttagccatagtaaggagtttggagggtcaagactgggagggtgacatgatctgatttacttttttttttttttttgagacagagttttgctattgtcgcccaggctggagtatagtggtgcgatctcggctcactgcaacctccgtctcctgggttcaagtgattctcctgcctcagtctcccaagtagctgggattacaggcacccaccaccatgcccagcaaattttttatgtgtgtactgttttagtagagacagggttttgccatgttggccagtctggtctcgaactcctgacctcaagtgatccactcgcctcggcctcccaaagtgctgggattacaggcgtgagccactgcg

SEQ ID NO: 91513 - DNA, 601 bp, Human
cagttagctgagatcgtgccactgcactccagcctgggcaacagaggaagactttctcggacccctccagactcaccagctgcagctgtctcgactgctctgtggcactgtcctgtatagcccttggggacagctcaaatgtctttaacctttgaagaagttgctgggggaagctatttttaatgctgccctgaggagccctccagggtataactagattgttctagcagagtcctttctagatcatcccaggaggtaagaagattgaacctcaattcttaatcctgtaattggcaaactwtgctcctgcaactcttgcacagccgattcttcccatttgtttcctgggaaaaaatcgggatactcggccaggcgtggtggctcacgcctgtaatcccaacactttgggaggctgagacgggtgatcacctgaggtcaggagttgaagaccagcctgggcaacatgatgaaacgctgtctctactaaaaatacaaaaattagctgggtgtggtagtgggcacctgtaatcccagctactcgggaggctgaggtaggagaattgcttgaacctgggaggcagaggttgcagtgagccgagat

SEQ ID NO: 91514 - DNA, 601 bp, Human
ccagcctgggtgatgagcaaaaactccatctcaaaaaaaaaaaaaaaaaaaaatcgggatactcacgtccttctgatctgggtctggggtcctgggccagtggttcatagtcccctctttcagcctccagccatcatttaggccccgatacatcccagtccacactgtcacttccacagatgggaagacactgatacaatggagatggaacagaaatggtgcttgggctgggactctcccaagtccaccaacttcagggcccagggcagggcaaggtactgctcacagggccaccagctcsgggcccattgcttccctggtcacttctagccatcctggcctggaactagggtaatgggaacctggggaggggacttagctgaagaaatgcctacctcatgaaatggtgggaaaaatttttccaggggaaaaattcagtcaggggagaaacctaggcctattcctcggagggttgatgagagcctgagcccctgatgtgggccacctctccagcctcctctgcttttctcccagttcttccagaacacttctcacttccccggctcctctccccagactgtggttctccacggagagtggc

SEQ ID NO: 91515 - DNA, 601 bp, Human
cagggcagggcaaggtactgctcacagggccaccagctcggggcccattgcttccctggtcacttctagccatcctggcctggaactagggtaatgggaacctggggaggggacttagctgaagaaatgcctacctcatgaaatggtgggaaaaatttttccaggggaaaaattcagtcaggggagaaacctaggcctattcctcggagggttgatgagagcctgagcccctgatgtgggccacctctccagcctcctctgcttttctcccagttcttccagaacacttctcacttccccrgctcctctccccagactgtggttctccacggagagtggcccacttagcttctagaggtatcagggtggaaggcagctctctgggagcagggtaagggcagtggtggtcttgggaccgatccagctatcaaccctctgtttccacaggatgaagagaggggagctctttgactacctcactgagaaggtcaccttgagtgagaaggaaaccaggtgagggtccctttgcccttctctccgctccctcccacgtggcttagggccacaggcactggggtctcaggggaggcagggcgtgcac

SEQ ID NO: 91516 - DNA, 601 bp, Human
gtgggcagtatcccgccctgccctgggccctgaagttggtggatgttgggggagtcccagcccgagcgccatttctgttccatcatctccattgtctctttggacttcctctcttttttttttgaaacagagtctcactctgtcaccaggctggagtgaagtggggcgatctcagctcactgcaaactccacctcccaggttcaagcgattctcctgtctcagcctcctgagtagctgggactacaggcacatgccaccacgcccagctaatttttgtatttttagtagagatggagtttygccatgttggccaggctggtctcgaactcctggcctcagatgagccacctgcctcggcctcccaaagtgctaggattatagaaatgagccactgcggccagcctggacttcctcttctgagtgccctgctgacctgccctgatgatgactgttcctgcagaggtctgtgggacccccagttacctggcccctgagattatcgagtgctccatgaatgaggaccacccgggctacgggaaagaggtggacatgtgagtgcgccgggaaaggaggagcacccagctaggctgggcaagggag

SEQ ID NO: 91517 - DNA, 601 bp, Human
cccagcccgagcgccatttctgttccatcatctccattgtctctttggacttcctctcttttttttttgaaacagagtctcactctgtcaccaggctggagtgaagtggggcgatctcagctcactgcaaactccacctcccaggttcaagcgattctcctgtctcagcctcctgagtagctgggactacaggcacatgccaccacgcccagctaatttttgtatttttagtagagatggagtttcgccatgttggccaggctggtctcgaactcctggcctcagatgagccacctgcctyggcctcccaaagtgctaggattatagaaatgagccactgcggccagcctggacttcctcttctgagtgccctgctgacctgccctgatgatgactgttcctgcagaggtctgtgggacccccagttacctggcccctgagattatcgagtgctccatgaatgaggaccacccgggctacgggaaagaggtggacatgtgagtgcgccgggaaaggaggagcacccagctaggctgggcaagggaggaagtaggcagggctgggccggtgcccctggcgctgggtaagtggccctgggccc

SEQ ID NO: 91518 - DNA, 601 bp, Human
atctcagctcactgcaaactccacctcccaggttcaagcgattctcctgtctcagcctcctgagtagctgggactacaggcacatgccaccacgcccagctaatttttgtatttttagtagagatggagtttcgccatgttggccaggctggtctcgaactcctggcctcagatgagccacctgcctcggcctcccaaagtgctaggattatagaaatgagccactgcggccagcctggacttcctcttctgagtgccctgctgacctgccctgatgatgactgttcctgcagaggtctgygggacccccagttacctggcccctgagattatcgagtgctccatgaatgaggaccacccgggctacgggaaagaggtggacatgtgagtgcgccgggaaaggaggagcacccagctaggctgggcaagggaggaagtaggcagggctgggccggtgcccctggcgctgggtaagtggccctgggccctcgcatgtccaggtggagcactggcgtcatcatgtacacgctgctggccggctccccgcccttctggcaccggaagcagatgctgatgctgaggatgatcatgagcggcaact

SEQ ID NO: 91519 - DNA, 601 bp, Human
accccagaaccgctacacagcggaagaggccttggcacaccccttcttccagcagtacttggtggaggaagtgcggcacttcagcccccgggggaagttcaaggtactaagcgtcctgatccaggcccgccagctccctaagtgcaaacctctaagccccctcctctcccaggagtccttacaccccgtgaatttccagagtacccatccctcccctcccagctgccctgtgatggcttcaaagacggcaggtgtcagcccactggctcggtccctgaggatgctggccaagtgggaagtrggggacactaggaagagccccgcagaagccacccaaggcttcgtggcaaacgagcccagagcgtccctgtgctggaggggcagggcctggcagggcgggggctgcagcccagcttctccgcctggccctgcaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggg

SEQ ID NO: 91520 - DNA, 601 bp, Human
cagtacttggtggaggaagtgcggcacttcagcccccgggggaagttcaaggtactaagcgtcctgatccaggcccgccagctccctaagtgcaaacctctaagccccctcctctcccaggagtccttacaccccgtgaatttccagagtacccatccctcccctcccagctgccctgtgatggcttcaaagacggcaggtgtcagcccactggctcggtccctgaggatgctggccaagtgggaagtgggggacactaggaagagccccgcagaagccacccaaggcttcgtggcaaacragcccagagcgtccctgtgctggaggggcagggcctggcagggcgggggctgcagcccagcttctccgcctggccctgcaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctc

SEQ ID NO: 91521 - DNA, 601 bp, Human
aggttgtctgaggctgaatctggagtgttgcccatcctgccagcagagaaggggagagaggacagacacgtcctgagaaaaaggcctagggcttacccatcttgcctgcctcatccgcagggccggccatgatcagggagcatgagggctggggagagcatggtctggaaagaagcctggtgtgaggacaggtcctgagcctgtgccagtcctgggagaaaggggacaagaaggggctttgggacaaaaggagtcttgcaagagtagggggagggacagtggccccaagagacagcactgragagcagaaaagacagtgactaacttctatgttagcagttgacaacagctcagtagagaaaacctgtccacaagcaatgagaatatcacggccgggtgcagtggctcacacctgtaatcctagcattctgggaggccaaggcgggctgattgcttgagtccaggagtatgagacaaacctaggcagcatggcaaaaactcatctctacaaaaattagctgcacctgtagtcccagatacttgaggagctgaggtggaagaatcgctagagcctggcagtttgaggctgtagtgagctgag

SEQ ID NO: 91522 - DNA, 601 bp, Human
ctcaaaaaaaaaaaagatttttcgtgtgcccaccagtttgaagagtcagtaagtccatgaccaccagtaatgacctactggtgtggtcattctacttccctccctttgcccacctagtggtaaggacaagaggagaaaccccataattaagatgccacacacagtctccctgggtaccaagagctggcaggagagtcacaaggtgtcctgggtccctttgcttttcatagcaagtgctgctggctttcttttttgtacccacaactgggcacaggctcagggaggtgctgggaccagctcrtcacacacagacggttggtggtgtgaaggtagggacactctgggaccgggattcagacatcagcccccagctacaaggccccgtgttgcctgggaccaagccccttacctggtggtgacccgggcccggtgattggcagagccatcagctgtgtcgatccaggatgccccccggaggacgcgcatgtcctgctcagcagcctggtacggtgatgctgtccactcccacacgttccccaggaggtcatagagccctgcagccccaccggcgggtcaggccaggctgggacccgccgaccac

SEQ ID NO: 91523 - DNA, 601 bp, Human
gaccagctcatcacacacagacggttggtggtgtgaaggtagggacactctgggaccgggattcagacatcagcccccagctacaaggccccgtgttgcctgggaccaagccccttacctggtggtgacccgggcccggtgattggcagagccatcagctgtgtcgatccaggatgccccccggaggacgcgcatgtcctgctcagcagcctggtacggtgatgctgtccactcccacacgttccccaggaggtcatagagccctgcagccccaccggcgggtcaggccaggctgggaccygccgaccaccccgcctaccctctgaggtcctgggggccaaatggcagaagggaggtgcttccctctgcctcctctctcagacatgatggtcccaacagccagttcatgggcacagccgcaagcccaagacagctcttaccgtagttgttctgggcggggaaagcattcactggggagactccatggaagccatcctcagctttgtctcccttggggaactttccctgatgggagaaaggaagggtaaaggatttaccacctgtcccaaagcaggtcctcatgcctatccagaggaaaacc

SEQ ID NO: 91524 - DNA, 601 bp, Human
cacagacggttggtggtgtgaaggtagggacactctgggaccgggattcagacatcagcccccagctacaaggccccgtgttgcctgggaccaagccccttacctggtggtgacccgggcccggtgattggcagagccatcagctgtgtcgatccaggatgccccccggaggacgcgcatgtcctgctcagcagcctggtacggtgatgctgtccactcccacacgttccccaggaggtcatagagccctgcagccccaccggcgggtcaggccaggctgggacccgccgaccaccccgcytaccctctgaggtcctgggggccaaatggcagaagggaggtgcttccctctgcctcctctctcagacatgatggtcccaacagccagttcatgggcacagccgcaagcccaagacagctcttaccgtagttgttctgggcggggaaagcattcactggggagactccatggaagccatcctcagctttgtctcccttggggaactttccctgatgggagaaaggaagggtaaaggatttaccacctgtcccaaagcaggtcctcatgcctatccagaggaaaaccaaggtcgtcttgctg

SEQ ID NO: 91525 - DNA, 601 bp, Human
gcctccacctctcaggtctgattctccactgtgtcccaggtaacccatgtcccacaggattccctgtccaggtcccactcctatcccctcagctgcaagaccaggttctctcaccttcattggctgggtggctttgtttctcagctcatcagagacaaagtcctcaaagacaaagctccatccaaacatctcagcttctgtccgatactttttctccctgacaaaatccctataaagacatagttcagctggttcagctggtgaggttctgtgcccaccccatcttctcctgctccaggamacttcagatatccctgtcctgtaagttatacaccacagagtgttcatgattgccaaggaattaacctgaagcctgagtgattttcttttaaattagaatacaacgaattcacatacagtaaaattcactctcttcagtgtttagttctgtgaggttaattaattttttattttatttgtttgtttatttgtgtatttatttagagatggagtctcactctgtcgcccaggctggagtgcaatggtgtgatctcggctcactgcaagctccgcctcccggtttcacgccattctcctgcct

SEQ ID NO: 91526 - DNA, 601 bp, Human
ttatttatttttttgagacaaagtctcactctgttgcccaggctggagtgcagtgacacaatctcagctcactgcaacctccacctcccaggttcaagtgattctctagcctcagtctcttaagtagctgggattacagacgcataccaccacgcccagctaatttttgtattttttgtaaagatagggtttcgcaatgttagccaggctggtctcgaactcctaacttcaggtgatccacccaaagtggcctcccaaagtgttgggattacaggtgtgaggcacaacacttggccaatattttttttttttttttttgagacagagtcttgctctgtctcaaaaagactgttgcccaggctggagtgcagtggtgcaatctcagctcactgcaacctccacctcctgggttcaagcgattctcttgcctcagcttccccagtagctgggattacaggtgcacaccaccatgcccactaatttttgtctttttagtagagacgggtttcaccatgttggccaggctggtctcaaactcctgacttcatgatctgcccgcctcggcctcccaaagtgctgggattgcaggcatgagccactg

SEQ ID NO: 91527 - DNA, 557 bp, Human
ctttattttgtccctaattcagccagcaaacgttaaaaaccatttatgagataatagatgaatctgaacagactgaatatattattaagaagcactgtcaattttttaggtgagaaacggtttgactattcaagcttaataaatccctagaataaaatgggataatgtctggacccacttccaaatggctccaggagagggggagtgtgcgattccgcaggagcaggactggccacaaactggcagctatttaagcyggccgagtacgtgggggcgggggtcgttcctcgttatattctcctttttccttttttttttttttttttttttgagacggagtctcgctgtcgcccaggctggagtgcagtggcgctatctccgctcactgcaggctccaccccccggggttcacgccattctcctgcctcagcctccctagtagctgggactacaagcgcccgccatcacgcccagctaattttttgaatttttagtagagacggggtttcactgtgttagccaggatggtctcgatttcctgacctcgtgatccgccc

SEQ ID NO: 91528 - DNA, 601 bp, Human
acccacttccaaatggctccaggagagggggagtgtgcgattccgcaggagcaggactggccacaaactggcagctatttaagctggccgagtacgtgggggcgggggtcgttcctcgttatattctcctttttccttttttttttttttttttttttgagacggagtctcgctgtcgcccaggctggagtgcagtggcgctatctccgctcactgcaggctccaccccccggggttcacgccattctcctgcctcagcctccctagtagctgggactacaagcgcccgccatcacgcccrgctaattttttgaatttttagtagagacggggtttcactgtgttagccaggatggtctcgatttcctgacctcgtgatccgcccgcctcggcctcccaaagtgctgggattacaggcgtgagccaccgcgtccggcctttttttttttttttttttttttttttttgagataaagtatcgatctgtcgcccaggctggaatgcaatggcacgatctcggctcactgcaacctccgcctcctgggttcaagcgagtctcctgtctcagcctcccgagtagctgggattacaggcacccgcc

SEQ ID NO: 91529 - DNA, 601 bp, Human
acgtgggggcgggggtcgttcctcgttatattctcctttttccttttttttttttttttttttttgagacggagtctcgctgtcgcccaggctggagtgcagtggcgctatctccgctcactgcaggctccaccccccggggttcacgccattctcctgcctcagcctccctagtagctgggactacaagcgcccgccatcacgcccagctaattttttgaatttttagtagagacggggtttcactgtgttagccaggatggtctcgatttcctgacctcgtgatccgcccgcctcggcytcccaaagtgctgggattacaggcgtgagccaccgcgtccggcctttttttttttttttttttttttttttttgagataaagtatcgatctgtcgcccaggctggaatgcaatggcacgatctcggctcactgcaacctccgcctcctgggttcaagcgagtctcctgtctcagcctcccgagtagctgggattacaggcacccgccgccacgcccggatagttgggtttttttgtttttgtatttttgtagagacagggtttcacgttggccaggctggtctccaactcctgacctcaa

SEQ ID NO: 91530 - DNA, 489 bp, Human
acaaaactgtctcaaaaaaaaaaaaaaaaaaaactcattgcataaagacagaacatttatgttcccttcagagaataccagacacaagttactgatcaactctctcaactaccccaaacccagcagcaatacaccagtcataaattatatatcaaaactggtatataatagaaaacaatgatatcagtytaaaacaaaagcaaaaagcaagtttgtactcaagtataacccctaatactgcaaatattaaactacaggttatctcttgccatctgcaatgtcagctattcaggcttcccagagaaaccaaatatatctggatgatgaggaatacctgttctagagtcagaaagaaaactgatcaaacttgcttatccaaaatccactttatgaataaatcctacattatcagaaaggtttgatcagctgaatcttttggaagattgactgttaaaagcatgcacaccttgggaataatgagcaatgcat

SEQ ID NO: 91531 - DNA, 601 bp, Human
caagagtcagcctgaaatagcattttaagggagatggataagcaacgttaccagtgaatttcaaagataagaccagtaatttttaggaaggaatttttcagaattacacacaaaattaaattttaaaatgtactttaagcctttccatttgccatcaaccagctaaaaactagtcttttctcttaaccctccatttaaaccactctccccaagttagcaaatgaaatctaaaaggtggacaagagctctttattagccaggcatggtggctcacacctgtaatcccaacactttgggaggytgaggtgggtggatcacttgaggccaggagtttgagaccagcctagctaacatggcaaaaccccatctctactaaaaaaacacaaagcaattcagtgggcatggtggcagacacccgtaatcccaactactcgggaggctgagaatcctatgaacccaggaagtggtagtcgcaatgaaccaagatcatgccactgcacgaaagagcaagactgtctcaaaaaataataataaaaaattttttaaaaaagctttttattgtggggagctctttggaaaaaagtatattgaattcagaaac

SEQ ID NO: 91532 - DNA, 601 bp, Human
ttgaattcagaaacaaaaagtaaaataatgtttacaaggggcaagggggagggagaaatggggagtaactatttaatgggtatacagtttcagtttgtgatgatgaaaaaagtcctagagatggacagtgctgacggggtgcacaatgtgaatatagttaatgccaattaactatacagttgaaaaacccaaaaataaagtataaggaaaaagaaataatcccaattcacttgcaaaatgagtaaaagtcaaattactcggatacctctccatatttctccttttagctctgcgcagagcractatgccttcttttgaaagagcatctaaggaaaaggggtcaattccctgtaacaaaaataaaaattaatttcaacatctttcaccttaaaagtaaaaaggatgatacgtactatttagtttatacattgagttttcattctcaccttttgattaataacaacaaatcctttatctgaatcgccacagactttccttttcagttctattatttttttaaccctatcttcaatgaattttctttcagctttcacgagtttttctctctcttctgcactcttgtaaaaaaagccagaattca

SEQ ID NO: 91533 - DNA, 601 bp, Human
tctctattaagaaaaaaaaaagttacagaaagcagggaaacattaagaaagcagcttctgaaactggattagtcctaagatttaacagttcactgagctccaatcctgccccttatgcatcttcagagactgtttcctatagctcccccaaaccaatttgagcattattgtccttacagtgggaaacaaagtttcacaaaaaagtaactcgcctaaaatacgaagcttctccatttcactgttaaggggctataaacttacgttttctcatactctaatgacacgttacaagtgaggatgyatgcatcctccacccttttcttcatatcaggatgccgtgctccgtggtccaaaacaagccctctgattaagctgtttaaacacacacaaaattatggttattgattttcagatgggtatttaatatattaaacactgaaatgagaaggtattgatatttcacgcagtcacatttttcttttttgagatgaagtctcgctctgttgcccaggatggagtgtagtggtgccatcttggctcaccgcaagctccacctcctgggttcacaccattctcctacctcagcctctcaagcagctgg

SEQ ID NO: 91534 - DNA, 601 bp, Human
tcagatgggtatttaatatattaaacactgaaatgagaaggtattgatatttcacgcagtcacatttttcttttttgagatgaagtctcgctctgttgcccaggatggagtgtagtggtgccatcttggctcaccgcaagctccacctcctgggttcacaccattctcctacctcagcctctcaagcagctgggactacaggcacccacaaccatgcccagctaattcttttgtatttttagtagagacggggtttcaccgtgttagccaggatggtttcgatctcctgatctcgtgatcygcccgccttggcctcccaaagtgctgggattacaggcatgagccactgcgcccggcctatttcttaaattacctgaagatcctacgctgtacagaaaagtctgcagagatggtctcactggtaggctgtcaaactgtgatgacgtcctttaaaaacatgttttctaccaagcacctgtaatcccagcacttacggaggcagaagtgagaggacaccttaatcccaggaatttaaaaccagcctgggcaacatagggagactccattctccacacagacacacacacacacacaccccaaa

SEQ ID NO: 91535 - DNA, 601 bp, Human
tctcgtgatccgcccgccttggcctcccaaagtgctgggattacaggcatgagccactgcgcccggcctatttcttaaattacctgaagatcctacgctgtacagaaaagtctgcagagatggtctcactggtaggctgtcaaactgtgatgacgtcctttaaaaacatgttttctaccaagcacctgtaatcccagcacttacggaggcagaagtgagaggacaccttaatcccaggaatttaaaaccagcctgggcaacatagggagactccattctccacacagacacacacacacamacaccccaaagggaaaacaaacatgttttctaactaactctttgaaaaaaatatttttttaaattcctctactacttctcattatgctttgtacctagcaattcaataaatgccaaatgactgatgttgttcacttttcagaatcattctaaccataaacataacattcaccttatttcaggagaaaatattactaaaaacaatattctcctagcagtttatccaacttatatcttcaagtaaatatataacattttatatccaaagatatttttaaaattgccatctcacgcctgtaat

SEQ ID NO: 91536 - DNA, 601 bp, Human
actccaggctgggcgacagagcaagactccatctcaaaaaaaaaaaaagccaactatctatattgtacaaagcacccctaaatttctaaacacagtttattttttgtttttgttttttttttaatgggacggggtttcgctcttgtcacccaggctggagtgcaatggtgtggtctcagctcactgcaacctccgcctcccaggttcaagctattctgctgcctcagcctcccgagtagctgggattacagtcatgcccggcacgcctggttaatttttgtaattttaatagagacggggyttccccatgttggccaggctggtctggaactcctgacctgaggtgatttgcccaccacagcctcccaaagtgctgggattacaggtgtgagcctccatgcccattagtatttcacagtcttctaccacctaccttgtatcagtttcagatttatgtttcatctccatgatctcaatcatgaagagatcaataggttcatcttgctttttaatggccaaaatggagtccactacagcctgcaattggaggagcataaccgttaagtaaattcaatttgcagcagaaacatgttgcttttca

SEQ ID NO: 91537 - DNA, 601 bp, Human
gcaaccatagttcatgataaagttcaggtaattattgaaggagtgttctggatcatcatacctttgaacacgaggtaatataatgtgctggctttctgaatacatttaaaaggacaaatattcctttcaatgcagagcagatgaacaggtaatgaatgctctagcacagggtcaaagccaagggaactataaagcacacttgggtgttcactgtgcaaaccactctgaatcatttcaaaaccaacactgtgtcccaacaactcacagatggtagcattatcctatctttattttctttcattttttttgagatggagtttcgcacttgttacccaggctggagtacaatggcacaatctcgactcaccacaacctccgcctcctgggttcaagcaattctcctgcctcagcttcccaagtagctgggattacaggcatgcaccaccacgcctggctaatttttgtatttttagtagacacggggtttctccatgttggtcagactggtctcgaactcccaacctcaggtgatccgcccacctcggcctctcaaagtgctgggattatgggcgtgagccactgcgcctggactattctatcc

SEQ ID NO: 91538 - DNA, 601 bp, Human
ggtaatataatgtgctggctttctgaatacatttaaaaggacaaatattcctttcaatgcagagcagatgaacaggtaatgaatgctctagcacagggtcaaagccaagggaactataaagcacacttgggtgttcactgtgcaaaccactctgaatcatttcaaaaccaacactgtgtcccaacaactcacagatggtagcattatcctatctttattttctttcattttttttgagatggagtttcgcacttgttacccaggctggagtacaatggcacaatctcgactcaccacaacstccgcctcctgggttcaagcaattctcctgcctcagcttcccaagtagctgggattacaggcatgcaccaccacgcctggctaatttttgtatttttagtagacacggggtttctccatgttggtcagactggtctcgaactcccaacctcaggtgatccgcccacctcggcctctcaaagtgctgggattatgggcgtgagccactgcgcctggactattctatcctttctataggtaatctcaaactaactcacatcatttactaataaaaataaagactgttctctttctccaggaa

SEQ ID NO: 91539 - DNA, 601 bp, Human
ggattatgggcgtgagccactgcgcctggactattctatcctttctataggtaatctcaaactaactcacatcatttactaataaaaataaagactgttctctttctccaggaaattctgacaatacattcatattcactgaggtttgctttaaccttggaactagtcagggctaaaaaagtggaatttatccaaatataagcttttggttgcctttttcctaacaaatatgcctagtcctaaacattccatttttagatctcaattattaatctacactaaagacagatgcaaatcacayaggcaatgcaacttgattacaaaattattttcaggccaagaaaggttctataacctgtccaaggtcacaatttgttttagaccaggataaagacccagatttaagccccctaattctactgtatgacctcagctactattaacagcacatcaatttgtataaatatcagacacttcctatatacaaaaaaaaattacagaaacaagagttgtgcatacttcagaaatgtagagatccgcctgtttcagcagctctccaatgattaggacattagaagtcgtaccatcaccagttatatca

SEQ ID NO: 91540 - DNA, 601 bp, Human
taagccaccacacctagcccccaaacaattctgaagtcaagtttaactgtggctccacttttcaaacacgggccaccactgagcccactaaaaacaaaaactacacctcctaggttagcaagtccttactaaagatatttcatctggatgttgatggcatggtataccactagcaaaaccctacatattattctgaactcaaatcagcaggaaataatttccttttcttggatttgaactgctaagttttgggaatttagggatgagtaaaaagcatactcccctcaataatctaatattytccatccctaagacttgcaaagagacagatttatctcccctccagttggagatagagatgagacctaacagagaaactgctgttttaaaaagagaaaacccagctgggcacgggcctggtaatcccagcactttgggaggctgatgcggggggatcgcctgaagtcaggcgttcaagaccagcctggccaacacggtgaaatcctgtctctactaaaaatacaaaaatcaactgggcgtagtggcgcgagcctgtaatcctagctacttgggagactgagacagaagaatcgcttgaacc

SEQ ID NO: 91541 - DNA, 601 bp, Human
tatccgggtcttctggaaaagtcggcccgtctggccggcccccagcgtgcccgcgcgccgccgccattgggccacaggtcgtccggcgcccgctcattggtccgcggctgcacggctcctgcggtcccacccttcgcgcctcggccttgtcgtcatcgcgcacgggaggagcttgttcccggcattccgtgctccttggttccggcgttggagctctttggggcccagctttgcggacccgggagctcgggacgcaggcggggcttgtgctccgcgggggcagggcgtagggtgggcctcytacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcaccct

SEQ ID NO: 91542 - DNA, 601 bp, Human
gggtttaagcgattctccttgcctcaacctcctgagtagctgggactataggcatgcaccaccacacccagctaatttttgtatttttagtagaggtggggtttcaccatgttggccaggatggtctcgatatcctgacctcatgatccacctgcctcggcctcccaaagtcctgggattacaggcctggagccaccgcgcctggccaggagtcttctttcttaggccacatccataaaacaagcaagagactaacgtattagtttgtaagtagggtaaagtcaaatctcagacctaaccrtttgcaagtggtaattttctattaattttttcttttatatatttttaagagatagagtctcactctggtgcccaggctggagtgcagtggcgcaatcactgcttactgcaacctcgaccttctgggctcaagtgatccaccatcatgcctggctaatttttttgcagagacaagttctctgaaaagctatgttgctcaggctggtcttgaactcctggcctcaagtgatcctcccactttggcctaccaaattgctaggattacaggagtgagccactgcacctggccaattttctgctt

SEQ ID NO: 91543 - DNA, 601 bp, Human
caccatcatgcctggctaatttttttgcagagacaagttctctgaaaagctatgttgctcaggctggtcttgaactcctggcctcaagtgatcctcccactttggcctaccaaattgctaggattacaggagtgagccactgcacctggccaattttctgctttcatcattcattatacatttattggttgaaattctgctgtaaggaagaactttcccttctcctccatgaatgactgactgaatgaatgaatttgtatcagtatggattcaagaattctatttttttttttttttttttgaggcagagtttcactcttgttgcccaggctggagtgcaatggcacgatctcagctcactgcaatctccacctcccgagttcaagcgattgtcctgcctcagcctcccgagtagctgggattacaggcatgcaccagcatgcccagctaattttgtatttttagtagagatggggtttctccatgttggtcaggctggtctcaaactcctaacctcaagtgatctgcctgcctggattacaagcatgagccaccacacctggccctttttttttccagtctcactgtgtcacctaggcta

SEQ ID NO: 91544 - DNA, 601 bp, Human
ttcatcattcattatacatttattggttgaaattctgctgtaaggaagaactttcccttctcctccatgaatgactgactgaatgaatgaatttgtatcagtatggattcaagaattctatttttttttttttttttttgaggcagagtttcactcttgttgcccaggctggagtgcaatggcacgatctcagctcactgcaatctccacctcccgagttcaagcgattgtcctgcctcagcctcccgagtagctgggattacaggcatgcaccagcatgcccagctaattttgtatttttagtagagatggggtttctccatgttggtcaggctggtctcaaactcctaacctcaagtgatctgcctgcctggattacaagcatgagccaccacacctggccctttttttttccagtctcactgtgtcacctaggctaaataaagtgcagcggcacaatcattagctcactgcagcttttaactcctgggctcaagtgatcctcccacctcagcctcccaagtagctagcctcaagcgatcctcctgcctcagcctcccaaagtgctgggattacaggtgtcagccaccatgattgacct

SEQ ID NO: 91545 - DNA, 601 bp, Human
ccaccacacctggccctttttttttccagtctcactgtgtcacctaggctaaataaagtgcagcggcacaatcattagctcactgcagcttttaactcctgggctcaagtgatcctcccacctcagcctcccaagtagctagcctcaagcgatcctcctgcctcagcctcccaaagtgctgggattacaggtgtcagccaccatgattgacctattatctgatttcagccagcaatattgtttttcttaatattattcttacactgttaattaaatgtgatttaaataatcttttaactcycggttattatagatgaaacagcctgcaaaaactcaccctacttcatttattccataatctttgtcctcctaatttttctattgcatcatttctgtattgtcagagtaggtaacgtttacattctgttttttctcccccaaacctgggtttatttagtcttagttttgcaatgatgtacactcaatgctcttgcttgtccctttgctgaagttccctttgctatccattggtgagtaatgtttattcattagcagtgtcctcaagaaaaatattcccatgcaagaccaggcacagtggctc

SEQ ID NO: 91546 - DNA, 601 bp, Human
atagatgaaacagcctgcaaaaactcaccctacttcatttattccataatctttgtcctcctaatttttctattgcatcatttctgtattgtcagagtaggtaacgtttacattctgttttttctcccccaaacctgggtttatttagtcttagttttgcaatgatgtacactcaatgctcttgcttgtccctttgctgaagttccctttgctatccattggtgagtaatgtttattcattagcagtgtcctcaagaaaaatattcccatgcaagaccaggcacagtggctcatgcctgtratcccagcactttgtgaggccaaggtggacagaccacctgaggtcaggagttcaagaccagccttaccaacatggagaaaccccgtctctactaaaaatacaaaattagccaggcgtgtattcccagctacacgggaggctgaggcaggagaatcacttgaacctacgaggctacagttgcggtgcaccaagatcgcgccattgcacttcagcctgggcaacaagacgaaactccatctcaaaaaaaaaatattctcatgggaaaaatatccccagaattcctgtatgttcaaaactatc

SEQ ID NO: 91547 - DNA, 601 bp, Human
ctaggagggtgagctgggtgttgggaccttaactctgcccataagatgttcaggccaggagagatgccctttaccccttgggttacaagggtttccactccctttctgcttgattgaggcttgccctcagttctttgtatccctgctctgctctgcttgtttcaaacaacacatttttgcactgtgtcatgaacagctcatcttcagagagtctgtttttgctggtgttttccgggatctgcatgtgcctcttcccatgtaactttggtaggccttgtgcaggtcttggagtttccagtgwctttttgtcttctagtttcgttgaatatgggatttctgcctcattccccccctcaccaccatatctccctatcactttgcataatttctaggaggaggaaggggacaattcagtcaaatattgccacagttcttatactataatcatatcgctttgtaatataaatttctcccactttttccattataagattaaaaatagctcacaccaaaatcccatcgcttgaacccagaaggcagagattgtagtgtgttgagattacaccacggaactccagcctggacagagacagagccagac

SEQ ID NO: 91548 - DNA, 601 bp, Human
aataaatgaataatgtttccttttttatatagatatatagacatagatatataaccatatatcatacctggatatagacacacatagagatttctttgttcaaaaatggctcaaacgatatatacgttcttcaacttcctttattcatgtgaacatatcatgggcatatttccatggtatgacttattttgaatgccaatgtttatattaaatcacatttcaaactgtgttcactgtgttctttcaagacatttatattattttaatgtattggtatttttttttttttgatggagtcttkctctgtcacccaggctggagtgcagtggcacgatctcagctcactgcaagctctgcctcccaggttcacgccattctcctgcctcagcctcccaagtagctgggactacaggcgcccgccaccacgcccagctaatttttttgtatttttagtagatacggggtttcaccatgttagcgaggatggtctcgatctcctgacctcgtgatccgcccacctcggcctcccaaagtgctgggattacaggcgtgagctactgcgcccagccatatattgtttttttttttttaattttttttt

SEQ ID NO: 91549 - DNA, 601 bp, Human
tgcacttcagcctgggttacagtgagaccctgcctcaaaagaaaaaaaaaaaaaggaaagaaaacctttccggaacagtagtatgacctgtattacttttgactaaccaattgtgattaaaactttgcaaaataatttgctaatatttttattacaccttcattatgctgtattgtatttggttcttatgtgctattattccagtaattatgcctttgtcttcattatgctatattgtatttggttcacatgtcctatcattccactaagaacagctatgaagctttttttttttttttttgagacagagtctggctttgtcacacaggctggagtgcagtggtgtaatctcggttcactgcaacctctgcctcccgggttcaagtgattctcctgcttcagcctcctcagtagctgagattacaggcgcctgccatcaggcctggctactttttgtatttttagttgagatggggtttcgccatgttggccaggctggtctcaaactcctgacctcaggtgatcctcccgcctcagcctccctaagtgctgggattacaggcatgagccactgtgcccggcctgatgaagcatattttaa

SEQ ID NO: 91550 - DNA, 601 bp, Human
gctggagtgcagtggtgtaatctcggttcactgcaacctctgcctcccgggttcaagtgattctcctgcttcagcctcctcagtagctgagattacaggcgcctgccatcaggcctggctactttttgtatttttagttgagatggggtttcgccatgttggccaggctggtctcaaactcctgacctcaggtgatcctcccgcctcagcctccctaagtgctgggattacaggcatgagccactgtgcccggcctgatgaagcatattttaatctgtttcacagttttgccttgtctggmaagattacctcctggttgttacacttgtatgtgaccactcattagtgtcttctaggcaactatatatatatattttaatgtgatgtgctctagcaaaacaatgtctacaatacagccatctcatgctcacaagtatcaatataggtgtgaatatgaggtggattccaggaccatgaagaggtggcagattttaattaattaactaattaatttttcagagacaagggcttgctctgttacccagactggagtacagtggcatgatcacggctcactgtaacctcgaaatcctgggctcaa

SEQ ID NO: 91551 - DNA, 601 bp, Human
cgccatgttggccaggctggtctcaaactcctgacctcaggtgatcctcccgcctcagcctccctaagtgctgggattacaggcatgagccactgtgcccggcctgatgaagcatattttaatctgtttcacagttttgccttgtctggcaagattacctcctggttgttacacttgtatgtgaccactcattagtgtcttctaggcaactatatatatatattttaatgtgatgtgctctagcaaaacaatgtctacaatacagccatctcatgctcacaagtatcaatataggtgtgartatgaggtggattccaggaccatgaagaggtggcagattttaattaattaactaattaatttttcagagacaagggcttgctctgttacccagactggagtacagtggcatgatcacggctcactgtaacctcgaaatcctgggctcaaatgatcctcccgcctcagcctcccaagtagctgggactataggcatgcaccaccacacccagccagattttagtaaatataaatattttatctgaaatttttaagaatatttaatattttaaagaatacttaatattaaacatttatgaaa

SEQ ID NO: 91552 - DNA, 601 bp, Human
caggctggagtacaatggtgtgatctcggctcactgcaacctccacctccaaggttcaagtgattctcctgcctcagcctcctgagtagctgggattacaggtgcccaccaccatgcctggctaatttttgtatatttaatagggacagcatttcaccatgttggccaggctggtcttgaactcttgatctcaagtgagttgcccgccttggcctcccaaagtgctgggattacagctgtgagccaccgcacctggccatcactgtgtgtttttcccgtctttgtatcctcatgtacccastttagctcccacttataagtgagaacatgtggtatttggttttctgttcctgcgctaattcacttaggataacggcctccagctgcatctgtgttgcagcaaaggacatgttttcattcttttttatggctgtgctggcttttttttttaggccgggcatggtggctcacaccttgggaggccgaggtgagctcccagcactttgggaggccgaggtgagcagaactcctgaggtcaggagttcaagactagcctgtccaacatggtgaaaccccatctccactaaaaatacaaaaatta

SEQ ID NO: 91553 - DNA, 601 bp, Human
cctgcctcagcctcctgagtagctgggattacaggtgcccaccaccatgcctggctaatttttgtatatttaatagggacagcatttcaccatgttggccaggctggtcttgaactcttgatctcaagtgagttgcccgccttggcctcccaaagtgctgggattacagctgtgagccaccgcacctggccatcactgtgtgtttttcccgtctttgtatcctcatgtacccagtttagctcccacttataagtgagaacatgtggtatttggttttctgttcctgcgctaattcacttakgataacggcctccagctgcatctgtgttgcagcaaaggacatgttttcattcttttttatggctgtgctggcttttttttttaggccgggcatggtggctcacaccttgggaggccgaggtgagctcccagcactttgggaggccgaggtgagcagaactcctgaggtcaggagttcaagactagcctgtccaacatggtgaaaccccatctccactaaaaatacaaaaattacctgggtgtggtggcgcacacttctgatcccagctattcgggaggctgaggcatgagaatcacttga

SEQ ID NO: 91554 - DNA, 601 bp, Human
ccccacgcccggctatactttgtactctttcaatgcccggggacctgaacaaatttatccctactaccaaagcaaataagcttggttctcgcaactatgcatgaccttcacaactctgtacaggcttttattttttcttacacaggtgaagataagaggtcagtcctaacaaggtgaaggaagtaaggtgatcttagaagcctcttgaaagatacagagattgagaagttgggaaagcatttctttgggcaaggaaatttttcctcttatccaaaatcagacctccgaaggctggccctgsaggaaagcttgcttttgtactttggaactagggatgagaaggccttgtcagcagtggctttttttttttttttttttttaatcagttggtcctttgcttgccaagagatgaactagctggggccagccaggcagaagttctgttctgagctgcagaaggcagtggtccggatgggacctgggagctgctgtgtctgagaatctgagaatagaccttcccaccggcatgtcttctaccctggccctgccctctccctccctgttagagccaaatacgaagaatccagagtccattctctgg

SEQ ID NO: 91555 - DNA, 601 bp, Human
tttaaatacgcatagattgtgagtcactcctggtggagacaatgaaaagaggaggaaattggccaggcttggtggctcacacctgtcatcccagcactttgggaggccgaggcaggtgaatcacttgaggtcaggagtttgagaccagcctggccaatatggtgaaaccccatctctactaaaaatacagaagaattagccaggcgtggtggcaggcgcctgtaattccagctactcaggaggcaggagaatcgcttgaacctgggaggcggaggttgcagtgagccaagatcacatcacygcactccatcctgggcaacagagtgagaccccatctcaaaaaaagtaaaaataaaaattaagaaggaggaaatcaaaagtgtacagggaggtgcaccattttgcagagcaggatgggaagagctaaaaggagctgtggccgagtttgctctgctgcccaatcaagcagggagggagttgatactcttgtaacccaatgggtgaaggccatctcccctggcctgaccgtttcatgggcagagttaaggtcctaaaatccagctcagtctcctagggagggtgtggaaaaagaatcagcctt

SEQ ID NO: 91556 - DNA, 601 bp, Human
gtaattccagctactcaggaggcaggagaatcgcttgaacctgggaggcggaggttgcagtgagccaagatcacatcactgcactccatcctgggcaacagagtgagaccccatctcaaaaaaagtaaaaataaaaattaagaaggaggaaatcaaaagtgtacagggaggtgcaccattttgcagagcaggatgggaagagctaaaaggagctgtggccgagtttgctctgctgcccaatcaagcagggagggagttgatactcttgtaacccaatgggtgaaggccatctcccctggcctgaccgtttcatgggcagagttaaggtcctaaaatccagctcagtctcctagggagggtgtggaaaaagaatcagccttccaagtaaattcaatgtaaagtgagtctctaacattctattttggccagcatggtggcttacacttataatcccagcactttgggaggctgagatgggaggatcatttgaggccaggaattcaagaccggcctgggtaacatagtgagacctcatctctacaaaaataataataatagtaacttagctgggtgtggtggtgcgtgcctgtggtctctgcta

SEQ ID NO: 91557 - DNA, 601 bp, Human
aaaaaaaaagtccttagtattccttgagccataaattgtgtgtgtcaccaggcgcagttgctcacgcctgtagttccagcactttgggaggctgagtcgcatggatcattttagcccaaaagtttgagaccacccttgggcaacatggtaaaacaccatctctactaaaaatacaaaaaattagccagatatcatgcctgcctgtagtcccagctgctcaggaggctgagccagggaggcagaggttgcagtgagctgagattgcaccactgcactccagcctgggtgacagagtgaggcyctaactcaaaataaaaaaaaatgtgtgtgtgtgtatgtgtgtgcatgtgcatgtgaataatgtgtgtgtgtaaaaatgtgtgtgtatgtgtatttgtgcggactgaggttggtaaaatccacaggcataggagccagatcgtgatgggcataaattatgtaataaagacattatgttaatggctgggtactgtggctctggtagggcaccggtggctcacacctgtaatcccagctctttgggaggctgaggcaggaggatcatttgaggtcaggagttcgagaccagacaggccaacat

SEQ ID NO: 91558 - DNA, 601 bp, Human
aaaaaaagtaaagtaggccgggcgcggtggctcacgcttgtaatcccagcactttgagaggccgaggcgggcggatcacgaggtcaggagatcgagaccacggtgaaaccccgtctctactaaaaatacaaaaaattagccgggcgtggtggcaggcacctgtagtcccagctacttagagaggctgaggcaggagaatggcgtgaacccgggaggcggagcttgcagtgagcggagatcgcgccactgcactccagcctgggcgacagagccagactctgtctcaaacaaaaaaaacaamaaaaaaaagtaaaataaaataaatgtaaaaatcattcttacttgtgagccataccaaaccaggtggcagggtggatttggcctacaagctatagtttgctgacccctgacttaaaatatttttttttccaggtcaacttaaaatggccttattctgccaactgcattggttggaaatcagttgagcagtgggttgttcaactgctttgagtctgtttttaactgcagtctattctaaatatagattacttacatcatctgtgtagccttgtatatgacatattagtctctgataggaggc

SEQ ID NO: 91559 - DNA, 601 bp, Human
gttttttagtagagatggggttttgccatgttggccaggatggtcttgaactcctggcttcaagtgatgctcccgcctcagcctcccagagtgctgggattacaggcgtgagccaccgcgcccagcctcttcctggactttaatcagaccatgtcttcaactagcccctgtacattggcgacattgtgtatgtttagccctcatatttagctctgaccttttttctgaggcttaaagcctttcccagtatctggaagttaaagtctaaactccttagcctggccctaggacctgcttagtstgaattcctgatgcacagccaggcccctgggccaagccatagggtagcttccagcaggtcatctgcttccttctccttgtctttgctcacactcctcgctctgccatcacaagcctccctccttgtctccacccccgctccctctcctcccagcacatgccaaatcgatgccctgccctttgacaacccactcagagggccacttacctgtcagattcagctcaaatacttgtgcctccttgaagccttctttttttttcttttagttagagtcagggtcttgctctgttgcccaggctg

SEQ ID NO: 91560 - DNA, 601 bp, Human
acgctggtcttgaactcctggcctcaagcaatcctcctcctgccttagcctcccaaagtgctgggattacagggatgagccactgtgcccagtctgaagccctgtttcatagataaggctaaacatttttcctgtgttcccacagagccttatgcacacctctgcttttttttttttttttttttttgagacggagtctcgctttgtcgcccaggctggagtgcagtggcgcgatcttggctcaccgcaagctccacctcccaggttcacgccattctcctgcctcagcctcccgagtggstgggactacaggcgcctgccaccacgcccggctaatttttttatatttttagtagagacagggtttcactgtgttagccaggatgttctcggatctcctgacctcgtgatccgcccgcctcagcctcccaaagtcctgggattacaggcctgagccaccgcgcccggcctcacacctccgctttaatgcttgcttcctcactacaattaggtagaaaaaaaaaaaacaactatatatatatctaaaagaaaagaaagatggcttcaaggaggcacaggtatttgagctactcaggaggct

SEQ ID NO: 91561 - DNA, 601 bp, Human
ccttagcctcccaaagtgctgggattacagggatgagccactgtgcccagtctgaagccctgtttcatagataaggctaaacatttttcctgtgttcccacagagccttatgcacacctctgcttttttttttttttttttttttgagacggagtctcgctttgtcgcccaggctggagtgcagtggcgcgatcttggctcaccgcaagctccacctcccaggttcacgccattctcctgcctcagcctcccgagtgggtgggactacaggcgcctgccaccacgcccggctaattttttwatatttttagtagagacagggtttcactgtgttagccaggatgttctcggatctcctgacctcgtgatccgcccgcctcagcctcccaaagtcctgggattacaggcctgagccaccgcgcccggcctcacacctccgctttaatgcttgcttcctcactacaattaggtagaaaaaaaaaaaacaactatatatatatctaaaagaaaagaaagatggcttcaaggaggcacaggtatttgagctactcaggaggctgaggcaggagaatcacttgaacctgagtggtggaggttgcag

SEQ ID NO: 91562 - DNA, 601 bp, Human
cccaggttcacgccattctcctgcctcagcctcccgagtgggtgggactacaggcgcctgccaccacgcccggctaatttttttatatttttagtagagacagggtttcactgtgttagccaggatgttctcggatctcctgacctcgtgatccgcccgcctcagcctcccaaagtcctgggattacaggcctgagccaccgcgcccggcctcacacctccgctttaatgcttgcttcctcactacaattaggtagaaaaaaaaaaaacaactatatatatatctaaaagaaaagaaagayggcttcaaggaggcacaggtatttgagctactcaggaggctgaggcaggagaatcacttgaacctgagtggtggaggttgcagtaagccaagatcgtaccactgccctccagcctgggcaacagagtaagactccacctaaaaaaaaaaaagaaagaaagaaagaagaaactggtgtagtgtgggaagtaaacaaaaagaaaaggaaaaaaaaatgaatctgtgagaacactcttatgtggcctgcactgactttgacacaaattagattggcttagtaggcaaggtgggatcttttcat

SEQ ID NO: 91563 - DNA, 601 bp, Human; identical to SEQ ID NO: 30743

SEQ ID NO: 91564 - DNA, 601 bp, Human; identical to SEQ ID NO: 30744

SEQ ID NO: 91565 - DNA, 601 bp, Human; identical to SEQ ID NO: 30745

SEQ ID NO: 91566 - DNA, 601 bp, Human; identical to SEQ ID NO: 30746

SEQ ID NO: 91567 - DNA, 601 bp, Human
tgaggacatcggacctggctggcctgactgttgggtctccctcctaggacacggcgagccatgggcggggcagtgcctttcaaagctgctctcacagagcgcttagccctcatccagccctccagggagcaggtgcagagactcatagcagagcaacccccacacctgacccccggcataaggtaagaggaaccccggctccaggtgtatttcagcaccagtgttggggggcacatcctcccaagagcatctaactattcctttagagtgccctctgggtggtttatttattttcattttmattttttaattttttaattatttttttaaattgtattttttcgagatgaagtctcactctgtcactcaggctggagtgcagtggtgaaatgtcagctcactgcagcttctgcctcccaagttcatgcaattctcctgcctcagcctcccgagtagatgggattacaggtgcccaccagcacacctaggtaatttttgtatttttagtagagatgggtttcgccatgttgaccacactgcttgaactcttgacctcaaatgatctgcctgcctgggcctcccaaagtgctgggattatagc

SEQ ID NO: 91568 - DNA, 601 bp, Human
gcctcagcctcccgagtagatgggattacaggtgcccaccagcacacctaggtaatttttgtatttttagtagagatgggtttcgccatgttgaccacactgcttgaactcttgacctcaaatgatctgcctgcctgggcctcccaaagtgctgggattatagctgtgagccactgcacccggcctattattattttttttagagtcagcgtctcattctgttgcccatgttggagtacagtagtataatcatggcttactacagcgttgaactcctggggtcaagtggccctccctcctwagcctccttaatagtggggactacaggtgcatgccaccatgcccagctaatttttaaaaaaaaattttttttgagagacagggtctcactttgtcacccaggctggagtgcagtggcatgaatagagctcactgcagcatcagccttctgggctcaagggatcctcctgcctcagcttcctaagtagctgggactacagacgtaggccaccatgcctaattttttttttttttaattttctgtagacacagggtctcactatgttgcccaggctggtcttgaacttgtgggctcaaatga

SEQ ID NO: 91569 - DNA, 601 bp, Human
tcagcctcccgagtagatgggattacaggtgcccaccagcacacctaggtaatttttgtatttttagtagagatgggtttcgccatgttgaccacactgcttgaactcttgacctcaaatgatctgcctgcctgggcctcccaaagtgctgggattatagctgtgagccactgcacccggcctattattattttttttagagtcagcgtctcattctgttgcccatgttggagtacagtagtataatcatggcttactacagcgttgaactcctggggtcaagtggccctccctccttagcctccttaatagtggggactacaggtgcatgccaccatgcccagctaatttttaaaaaaaaattttttttgagagacagggtctcactttgtcacccaggctggagtgcagtggcatgaatagagctcactgcagcatcagccttctgggctcaagggatcctcctgcctcagcttcctaagtagctgggactacagacgtaggccaccatgcctaattttttttttttttaattttctgtagacacagggtctcactatgttgcccaggctggtcttgaacttgtgggctcaaatgatca

SEQ ID NO: 91570 - DNA, 601 bp, Human
tcaagaatgagtgtggtaattactgtaaaaatagaaataattgataaaaaataagctggaatttcctcttgggtgacataatatattaacattttaaatttaatatattaaggctgggtgtggtggctcacgcctgtaatcccagaactttgggaggccgaggcaagtctgatcacctgcggtcaggagtttgagaccagcctggccaatgtggcaaaaccccatctctactaaaaatacaaaacttagctggtgtggtggcatgcgcctataatcccagctacttgggaggctgagacaygagaatggtttgaacctgggaggcggatattgcagtgagccgagatcacaccactgcactccagcctgggcaacagagtgagacactgtctcaaaaataaataaattaattaattaatttgatactactattttatggtgttctgccacctcaacaaggtttgagaattactggaagcttaaaggatacaacaaaattcacccaatttatttatgacctaatagagccatctctacaattgatagttataatttaaaagcaaaggttggctaggtgtgatggctcacacctgtaatccca

SEQ ID NO: 91571 - DNA, 601 bp, Human
tatattaaggctgggtgtggtggctcacgcctgtaatcccagaactttgggaggccgaggcaagtctgatcacctgcggtcaggagtttgagaccagcctggccaatgtggcaaaaccccatctctactaaaaatacaaaacttagctggtgtggtggcatgcgcctataatcccagctacttgggaggctgagacacgagaatggtttgaacctgggaggcggatattgcagtgagccgagatcacaccactgcactccagcctgggcaacagagtgagacactgtctcaaaaataaatwaattaattaattaatttgatactactattttatggtgttctgccacctcaacaaggtttgagaattactggaagcttaaaggatacaacaaaattcacccaatttatttatgacctaatagagccatctctacaattgatagttataatttaaaagcaaaggttggctaggtgtgatggctcacacctgtaatcccagcactttgggaggctgaggcaggaggatcacatgagcctaggagttccagaccaacctgggcaacataccaagaccccatttctataatcataatcataatca

SEQ ID NO: 91572 - DNA, 601 bp, Human; identical to SEQ ID NO: 30747

SEQ ID NO: 91573 - DNA, 601 bp, Human; identical to SEQ ID NO: 30748

SEQ ID NO: 91574 - DNA, 601 bp, Human; identical to SEQ ID NO: 30749

SEQ ID NO: 91575 - DNA, 601 bp, Human; identical to SEQ ID NO: 30750

SEQ ID NO: 91576 - DNA, 601 bp, Human
tgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggtaacttaacctcatgaattatttatttgaggaaggctttgagcccagyggaggtaccaagagtgggcttataccaaagatgttttctccatttcgtgtattccaaagtcaccccttggagagaggccttcatatggtggctaattaaatctggcttttttggacttaatagaaacatgtagactcagaatttttctgttaggggagatcagatatctaaaaactaggtcacatcaagctataaaatatgaaccaagagaaacaaggacagcgtgtgaccttatgtaagttacttaacctcttcaggcctcagtttcaaacttgtcaaacaaatgaataatttagatgt

SEQ ID NO: 91577 - DNA, 601 bp, Human
aataagactgaatggaaatatgccaaagtgacaattttttttccccagtgtggtgggatttatgtgtgggtttcttttttctttattagttttctgtactttccccaagttgtctgtactaagtacatgccacttctataacgaaacgtttagaaaaagttaaaaaagtcttgcaactcattttgcttccccttattgatttgtgtaaatcaagtttgtccatcccatgacccaggacagctttggctttgaatgcagcccgacacaaattcataaactttctgagggttttttttttttwttttttttttgagacagaatttagctcttgttgctcaggctggagtgcaatggtgtgatctcagctcaccacaacttcacctcccaggttcaagcgattctcctgcctcagcctcctgagtagctgggattacaggcatgtaccaccatgcccagctaattttgtatttttactagagatggggtttctccatgttggtcaggctggtcttgaactcccaacctcaggtgatccgcccgcctcggcctcccaaagtgctgggattacaggtgtgagccaccttgcccagcgttttttgtt

SEQ ID NO: 91578 - DNA, 601 bp, Human
agttgtagagtaaaaactggtccagcagcagaaagcaatttaatataatgaccttagacgttcttatgaccatggtaaccttataaactactatgcctgtgtccttaaaacaatatcctattttgtaaaaataatggaagtgccaaatcaaacaaagcctgatcctactcgtctgtgaaagcagtaccacagcaatatgcttttcaaactaaattacagtagtttcattgaggcataactatctcttccaatagtttaggcttgttcctcagatttttgcattgggatatttatatttaargtgtttttctaaggaaagtcttttctttccaaattgctagtctcaaacatgcaaccgggtaaaatcctattacaaagagaggttctgtttagtaaagctattccaggtgctcagagaggcctctagaaacagggctttgttggtctgattgcattgagttctggccagcagataatcccgtataataagatcttttcctggtccttgtctatttcacactgaattgttcatgaggataaggtgggagggaaatggcttagccttgggttgttttctatcagaggtcttctaaaacctcac

SEQ ID NO: 91579 - DNA, 601 bp, Human
cttgttcctcagatttttgcattgggatatttatatttaaggtgtttttctaaggaaagtcttttctttccaaattgctagtctcaaacatgcaaccgggtaaaatcctattacaaagagaggttctgtttagtaaagctattccaggtgctcagagaggcctctagaaacagggctttgttggtctgattgcattgagttctggccagcagataatcccgtataataagatcttttcctggtccttgtctatttcacactgaattgttcatgaggataaggtgggagggaaatggcttakccttgggttgttttctatcagaggtcttctaaaacctcacttatccctgcctaccctcagtagaacaagccatgctcctggatgccatatacatcctccaaactttgaagctaggccattggtttctgtctttcttgcgaacaaaaacctcttttattattcagctctactcatccatctttgtctaccatggacttatagtttttaaagctgaactccagaaagctacaatcctactttcatggagtcctagtattggaaacataagaggaggcctcgcatggctaggagatggaagaa

SEQ ID NO: 91580 - DNA, 601 bp, Human
gagaaccatcagctatgagtgggagcaaaaaaggtggcagctgtccttgtattttctcttaaaaattgttctatgcttcctccatctcctaacagatgtcggctttcaccaggagactccatcttatgtatgggtccacctcacaggtgtacctgccatgtacctgctacaactcatctctttgccaaactggagccatagagaagagaggagggggtctgggagagctcaggttcaaatccattcagctactaaaaggctggatgatctcaggcaaggcactttctctctttggatctcrtctttctttgtaaaatcaggagacttgaacccatcacagaagggccaccagattttgatcagtgtgacaatttatctgtgccttacctgagtgtgcctactgtcttcctggtgtctatcaggaaaaacactggcctgaggggtcctgcaatgtgctgtagggtggagaacactgcgctgccagtcagagggaagaggccaggctcaatgccaacctcatgccactgaaggattgtgtgctcactgcaacatgaaagagctttcccccaggcttttgaacgtgtgagggcaggttagtgaa

SEQ ID NO: 91581 - DNA, 601 bp, Human
tctgggagagctcaggttcaaatccattcagctactaaaaggctggatgatctcaggcaaggcactttctctctttggatctcatctttctttgtaaaatcaggagacttgaacccatcacagaagggccaccagattttgatcagtgtgacaatttatctgtgccttacctgagtgtgcctactgtcttcctggtgtctatcaggaaaaacactggcctgaggggtcctgcaatgtgctgtagggtggagaacactgcgctgccagtcagagggaagaggccaggctcaatgccaacctsatgccactgaaggattgtgtgctcactgcaacatgaaagagctttcccccaggcttttgaacgtgtgagggcaggttagtgaaaatttctatttaaattaggtcacagggttgggggaaaaccaagagaatgtgtaataactctgtgtgcttttagggagaatgtgagacatttttttttctttttttaaaattacactttaagcactagggtacatgtgcacaacatgcagatttgatacataggtatacatgtgccatgttggtttgctgcacctatcaactcatcatttacattagg

SEQ ID NO: 91582 - DNA, 601 bp, Human
ctactgtcttcctggtgtctatcaggaaaaacactggcctgaggggtcctgcaatgtgctgtagggtggagaacactgcgctgccagtcagagggaagaggccaggctcaatgccaacctcatgccactgaaggattgtgtgctcactgcaacatgaaagagctttcccccaggcttttgaacgtgtgagggcaggttagtgaaaatttctatttaaattaggtcacagggttgggggaaaaccaagagaatgtgtaataactctgtgtgcttttagggagaatgtgagacatttttttttctttttttaaaattacactttaagcactagggtacatgtgcacaacatgcagatttgatacataggtatacatgtgccatgttggtttgctgcacctatcaactcatcatttacattaggtatttctgctaatgctatccttccccgagtccgccaccccccaacaggccccggtgggtgatgttccccaccctgtgtccaagtaatctcgttgttcagttcccacctatgagtgagaacatgcggtgtttggttttctgtccttgtgatagtttgctgagaatgatggtttccaacttc

SEQ ID NO: 91583 - DNA, 601 bp, Human
aaagtgtgatgtggtgctgagaagaatgtatattctgttgatttggggtgcagagttctgtagatgtctattaggtctgcttgttgtagagctgagttcaagtctggatatccttgttacccttctgtttcgttgatctgtctaatactgacaatggggtgttaaagtctcccattattattgtgtgggagtctaagtctgtttgtatgtctctaaggacttgctttatgaatctgggtgctcctgtatttggtgcatatatattaaggatagttagcttttcttgtcaaattgatccctktaccattatgtaatggccttctttgtctcttttgatctttgttggtttaaagtctgttttatcagagactaggattgcaacccctactttttttttgctttccatttgcttgatagatcttcctccatccccttattttgagcctatgtgtgtgtgtgcgtgtgagatgggtctcctgaatacagcacaacaatgggtcttgactctttatccaatttgccagtctgtgtcttttaattggggcatttagcccaattacatttaaggttaatattgttatgtgtgagtttgatcttgtca

SEQ ID NO: 91584 - DNA, 601 bp, Human
aatggagaaaactgtcgctcatatacgggtagaggctggggttatagaaataatttatttcacttctagaaaggcaatgtccaagtctggtttcacatgcaggttataggctaagtgctctgctgggaagaaggtggctttccaggggcccaggcagcgctcttgtccacagggtatatctttagccatgacaaccacaaatttcttcctttaaaaatgcttatgagagatattaaattagagaggcattattctctgtcttagatgatatttctccctctttgttctgctgtttggtacmttatctcttggttgagagttattgttatccatatgttgcattatttgcctaaagagaagctaaatggtcagtctgcccaattctgaattagttggaatttggctaaagcagggaaatacattatatgaagtaaacatgctatcctattctgaaatgagggaagtttgggataagtttgtaaccaggttcacccttaaggaatctcaaggcaaaggaaaaactagaaaataatctttacaaagacttgttattcagctgcttaacttgtgatgtttttatttaattatatatatttgaaca

SEQ ID NO: 91585 - DNA, 601 bp, Human
tgacttgcccaaagtcacatggccagtagggttagagggaagccaaggcctggctctctaattctcgagacagtgctctttatatttgacatgttgctttcctggtcaaaggactgcagggttcttctgctcagtacagaggacattctggtttgtaaacaattactcaagtttcttgaatgagaaaacacacaggcgattgcaaaaacctagaagataaataaggatattggagactgaggtttggggaagcaaaggaatgaaggaacatagccctttggcccttatcaggggcataggktagatgaggtggggatggaaggcatgtctcagagcctgacctgctgtctctccctggatagcctggatgacaccggtaatggttcctagatgataatcaagacagaaggggaagcggtatgtgtctacctttttatgagtatcttttacttggatgatttcaggctgggggaggtgaaagaactggctgtgagataaattaggagatcttggctccaggtgaaagcaacttaaagaaatcttaaaatctttcaacacaaatgaaaccttcccacctttgccttgaagagacaaaggtgtt

SEQ ID NO: 91586 - DNA, 601 bp, Human
aacacacaggcgattgcaaaaacctagaagataaataaggatattggagactgaggtttggggaagcaaaggaatgaaggaacatagccctttggcccttatcaggggcatagggtagatgaggtggggatggaaggcatgtctcagagcctgacctgctgtctctccctggatagcctggatgacaccggtaatggttcctagatgataatcaagacagaaggggaagcggtatgtgtctacctttttatgagtatcttttacttggatgatttcaggctgggggaggtgaaagaactggctgtgagataaattaggagatcttggctccaggtgaaagcaacttaaagaaatcttaaaatctttcaacacaaatgaaaccttcccacctttgccttgaagagacaaaggtgttcttctttatgcctcctttccttgaaccctcttagagacttgagcacctttctagctgcttttgacattctctgactttaactcagttttacttgaaaatgttcttgtccaggataaatctatatgaaagctcctctaggagagccttattattggtgagggaagggagagaagtaatacttcctgt

SEQ ID NO: 91587 - DNA, 601 bp, Human
aaaggtcttggattcaaatatttataatgtctcttttcatcttaaaatcctttccttcggagatgcaaaaactgaaacttgcagttgaaaacaacctacaaccaaccccttctgtattttaggattgaaattcaaatactaagttaaagtacagaccagctggcttggtggtcgaacctcttattagcataactttgatgtcccagtttgaatgtaaagactgttctttggggaaataacgctgcttaacaaacaagacataatttgcttagcatatttatttatatattgaactaagttwtattttaggacttgagtttctggtgataacattttttatttcttccattctatcccttatccacaatgtactactcaagcaaagcaaatcataacatcatccttctttccctagcaagccagcaaaaatggttttactcaacaacagcccagttcagagttctaagttcttatgaatcccaacaacaggcttagaaaaaaaatgtttccttccttccccaagtgtgattcctcttttaggattggtcaaatgtgggagaatttgtctttattgggggtcgtgaacaaaacccatctccca

SEQ ID NO: 91588 - DNA, 601 bp, Human
ccttaacaaagattgatatgcttcctgagtgccatgtcctgttctaagtttttataagtatcaacttcattttcataaccctatacagaaggccactattatccctattttagagatggggaaactgaggtttgaagagtaacttccccaagttcacatagctaggaagtagcagtgccaggttttaaagtcaggcactgatctgatgctagacactgtcccttaatgatcagaatctggattttcctataaattactcggtgctagaaaggtctaaccttttgtggttgatttaaaaaaacaaaacaaaacaaaacaaaacaaaaaaactgtgctcagtcaagaaaaaaattattaccttagcaaagcccagcttgttctggaataaaacgcctacaaaattgtcatcaacagtaaattttcctctgtagaaatcactcagatatcctacttgttcataaattgcttgaaatagaaaaattctaaagccagacacccaatggctgaaggctctacaaggctgttttaagaaatagaggctgtttcaagtaagtcagaggtgatggagtccttctaatctgaactcccttctgtttaactt

SEQ ID NO: 91589 - DNA, 601 bp, Human
tccgcctgccttggcctcccaaagtgctgggattacaggtgtgagccaccgcacccggcctaaggtatttatttttaaaatgtatatttcactccatgttttaactaacagcttttaaatttaagctgtttgggatattgaaaagcaaatcagcatttctcccacataggactcaaatacaaataggaaaaaaaaatctaaaaatgtatgtccttgagtcaacctggtcaggtattatgtaagcagattttgcagaagaagaggaatttctggaattctgctgatgttcttcatgagtaaytggtggctaacatggcaatgtatgtatagaattggacatattaggcttattgatgttgtgtcaaattttaacaaataggtaaattcaaatttataagtataaaaaacctcttaactatatttcaccaaatctgacacacaattaattgtgagacataccactcttttatataccactaagtagagaaaggaaataatgcaaccaaactatgaaaagacattgattaaaatatacattcaggtgtcttagaattagtaaatatggtgatctttcagctgcagtctcaccttttttccatag

SEQ ID NO: 91590 - DNA, 601 bp, Human
ggaaaaaaaaatctaaaaatgtatgtccttgagtcaacctggtcaggtattatgtaagcagattttgcagaagaagaggaatttctggaattctgctgatgttcttcatgagtaactggtggctaacatggcaatgtatgtatagaattggacatattaggcttattgatgttgtgtcaaattttaacaaataggtaaattcaaatttataagtataaaaaacctcttaactatatttcaccaaatctgacacacaattaattgtgagacataccactcttttatataccactaagtagaraaaggaaataatgcaaccaaactatgaaaagacattgattaaaatatacattcaggtgtcttagaattagtaaatatggtgatctttcagctgcagtctcaccttttttccatagagtgtgacaacatgattctaatgccactgttcagttctcagttttcctctgcttggcctattggcagcaatcgacactgttgcctcccttttccttgaaacactttcttccctttgcctccaaaataccacattgtcctggttttcctcctccatcttgggctgtttcttctctgtttccatggc

SEQ ID NO: 91591 - DNA, 601 bp, Human
acaaataggtaaattcaaatttataagtataaaaaacctcttaactatatttcaccaaatctgacacacaattaattgtgagacataccactcttttatataccactaagtagagaaaggaaataatgcaaccaaactatgaaaagacattgattaaaatatacattcaggtgtcttagaattagtaaatatggtgatctttcagctgcagtctcaccttttttccatagagtgtgacaacatgattctaatgccactgttcagttctcagttttcctctgcttggcctattggcagcaakcgacactgttgcctcccttttccttgaaacactttcttccctttgcctccaaaataccacattgtcctggttttcctcctccatcttgggctgtttcttctctgtttccatggcgggttcctcctcattttcctgacctctaaacagtggagagctccaggattcagtgcttgcacctcttttcaatgtacacactctctctcccttggtgacccacgactttaaataccatctatctgctggtaattcccaagtgcatattccagcctggaccttttacctgcactcacgatagaaata

SEQ ID NO: 91592 - DNA, 601 bp, Human
cttggcatttgttcactgccatatctcctgtacctagaaaagtgtctggcacaaagtagacgctcagtaaatttttgttgaatgaataagttaacagcttcagacatttgagatagcttcaaaaacagactaagataagcaggaaggagggatgtttttgttttgttttttgcccagtggaatgaaataaaagattatccattttcctcacagtatcagtgatatttcttccatttggaaaattgtctactgttttgatagtttatcgttggaaaacatgttgtccatttacttcaagagwtctttgcacggtgttttttgttttttttctttctctttcttagtagtccccaaggttcatctgagcttacggttattgtctattaaaccttcaactagatagtgataaattctgcttcagaaataattttttgcagctaaagtaaaatctaaacagatcttctaacttttacacctcagttagggaaggactatttttaacctggggcatacaaagttcctagcactaataaagcagtttcctgtgtagtggatgcactggaagttactgctgttggtatacaaatttttaaccatgcta

SEQ ID NO: 91593 - DNA, 601 bp, Human
atatctcctgtacctagaaaagtgtctggcacaaagtagacgctcagtaaatttttgttgaatgaataagttaacagcttcagacatttgagatagcttcaaaaacagactaagataagcaggaaggagggatgtttttgttttgttttttgcccagtggaatgaaataaaagattatccattttcctcacagtatcagtgatatttcttccatttggaaaattgtctactgttttgatagtttatcgttggaaaacatgttgtccatttacttcaagagatctttgcacggtgttttttsttttttttctttctctttcttagtagtccccaaggttcatctgagcttacggttattgtctattaaaccttcaactagatagtgataaattctgcttcagaaataattttttgcagctaaagtaaaatctaaacagatcttctaacttttacacctcagttagggaaggactatttttaacctggggcatacaaagttcctagcactaataaagcagtttcctgtgtagtggatgcactggaagttactgctgttggtatacaaatttttaaccatgctatcgtatactggttactatga

SEQ ID NO: 91594 - DNA, 601 bp, Human
ccatttacttcaagagatctttgcacggtgttttttgttttttttctttctctttcttagtagtccccaaggttcatctgagcttacggttattgtctattaaaccttcaactagatagtgataaattctgcttcagaaataattttttgcagctaaagtaaaatctaaacagatcttctaacttttacacctcagttagggaaggactatttttaacctggggcatacaaagttcctagcactaataaagcagtttcctgtgtagtggatgcactggaagttactgctgttggtatacaratttttaaccatgctatcgtatactggttactatgaaacacaggtacatgtgggtatgttgcttttaggagcacttactctgttattaggctggagagaccacagcttggacagctgatcccagcagaaggattttgctgcagtgggagaatctgggagaactttcctgcttatgagctctggccactaaagtggacgtagtggatcactctaaatgggaagagggcactggcagagggagaggcccttgtacaagaacagggtccctgggagcccaggtttcacccagtggtgagcata

SEQ ID NO: 91595 - DNA, 601 bp, Human
aaagtggacgtagtggatcactctaaatgggaagagggcactggcagagggagaggcccttgtacaagaacagggtccctgggagcccaggtttcacccagtggtgagcataggacaccatagaactgttgtcctttcttctcattattatagaggctagagatctggcagggccacaaggctagggtgtgtgtgggcctggggccactcaggttctcagtggcttaggttacagaagctaatgagatgacgaatggtgaggagggtcagtcaagagggcagggatgacaaaaaaagactytcattcatttatccaaagatatttgtggtattcctctgacaggtgctggggatgctgctagtcaaagcagtgtggtcttgggcttggcctcaaaggcatcttggaggacaagaccattgtatgtggaacatcaattccagtaatgctaaagccaggcttttattccaatttctgactttgacatatgttgctttgtatagttgctgtatgtgctgtggccatctctgtccctgtatctgcagcttgtaaggttatggacacagtgcgtgcctgttaggagcatgtcttttagggaggttt

SEQ ID NO: 91596 - DNA, 601 bp, Human
taggttacagaagctaatgagatgacgaatggtgaggagggtcagtcaagagggcagggatgacaaaaaaagactctcattcatttatccaaagatatttgtggtattcctctgacaggtgctggggatgctgctagtcaaagcagtgtggtcttgggcttggcctcaaaggcatcttggaggacaagaccattgtatgtggaacatcaattccagtaatgctaaagccaggcttttattccaatttctgactttgacatatgttgctttgtatagttgctgtatgtgctgtggccatctytgtccctgtatctgcagcttgtaaggttatggacacagtgcgtgcctgttaggagcatgtcttttagggaggtttgggggggtgttagaagggaggctgtcttgagttcatgtctcccgtcttccatgtgtacatctcaggagactgctgtgtgttgagaaactggcacagggataactgtggagttgtctgtcctgggaggaggttgtgtattaattgcctccctgggaattttctcattatttgtccctttacactctctttctagaagaataatgagaactgacattacatgtaaca

SEQ ID NO: 91597 - DNA, 601 bp, Human
ctaggaggcagaggctgcagtgagctgagatcacaagaaaagaaataaagtccctggggaaactgttccagtgtctattaggtggtgcaaaagttactgtggtctttgccattttggtgaccaaaaaaaaaaaaaaaaccacaattacttttatttttttcttttttttgagacagttttactctgttgcttaggctggggtgcggtggtacaatcctggctcactgcaacctctgtctctcaggttcaagtgattctcctgcctcagcctcctgagtagctgggattacaggtgtgcacmaccacgcctcgctaattttttgtatttttagtagagacagggtttcgctatgttggccaggctggttatgaactcctgggtcaagggatccactcacctcagcctcccaaagaattacaggcataagccacccgtccagcccatgattacttttgcaccaacatatgcttggtcagtaataacagaccaggaggcagcacacacactgtggccagccttgagtgcgttcatcctaggctggatggccatgcctgaggagaataattccagcaaataataatgttcctccactgcatcaca

SEQ ID NO: 91598 - DNA, 601 bp, Human
ttttagtagagacagggtttcgctatgttggccaggctggttatgaactcctgggtcaagggatccactcacctcagcctcccaaagaattacaggcataagccacccgtccagcccatgattacttttgcaccaacatatgcttggtcagtaataacagaccaggaggcagcacacacactgtggccagccttgagtgcgttcatcctaggctggatggccatgcctgaggagaataattccagcaaataataatgttcctccactgcatcacattccctattaaccacaattgaggcaycactaactgggtgggtgaccttgcactagtcaccaaccccaacatgcgatttccttgccaacaaaattgaacacttaaccatgtgtatttatgaagtatttataaacacatcttatatatgtgtatgttatatagatagtttaaaaaggaatagtaaaataaatctcaaataaaagtaataacatgaaaagaaaacccatttctccactgtccagcctaggaaacagaactttatgaatacctttgaaatcccttctgtgctccttccccctccccaaagaggtaactatctcaatttgg

SEQ ID NO: 91599 - DNA, 601 bp, Human
tcacattccctattaaccacaattgaggcatcactaactgggtgggtgaccttgcactagtcaccaaccccaacatgcgatttccttgccaacaaaattgaacacttaaccatgtgtatttatgaagtatttataaacacatcttatatatgtgtatgttatatagatagtttaaaaaggaatagtaaaataaatctcaaataaaagtaataacatgaaaagaaaacccatttctccactgtccagcctaggaaacagaactttatgaatacctttgaaatcccttctgtgctccttcccsctccccaaagaggtaactatctcaatttggcaaatcgtcctcctgcttttctctgtagttgattgttttcttttgactaacactttttcctacacaaggaaggcattcaaagccccagtctggtctcctcactggggttttgtgataatgtgctagactaaaaggttggtatcccctgagggagtcattgatttatctttgatttatcaactccacggtgggagaggacagcagtgaagaacattggcgaccccagccagttcatggagttgactccatgttttcatagtagagaatcta

SEQ ID NO: 91600 - DNA, 601 bp, Human
tctactttttttgagatagagtctccctctctcacccaggctggagtgcagttgtgtaatcttggctcactgcaacctcccctctggggctcaagcaatcctcccacctcagtctcccaagtagctgggaatataggcctatgccaccacacccagctaatttttgtattttttgtagaaatgggttttcaccatgttgcccaggctggtctcaaactcctggactcaagcgatccacctgcctcaacctcccaaagtgctgcattacaggtgtgagccaccctgcccatccattctactkttatagttgacaggaaaacagccttctactaggaactgatttttgaaaaccattttcagtggattggtgcagaatgtgtatacagtcttccacatcatctgcctcaataggattgcctggcaaagtaagaatgcgtgttgaggagccacagcgtccttcgtttttacagaaacttttataattattattgtttttattagcaataattgatagctcattttataaatattttcctgaacaactgatgggtgcaaaaaatatttttattttttttctaggaaacctttgattgagaaatca

SEQ ID NO: 91601 - DNA, 601 bp, Human
attttcaagtctgctatataagattaagatgagaaataaagcatataaaatgcctgactcattgaaagtgttctacaagtggtagttacgaccatgatgtaactcattttacttagcctttctttaattgtatgtacttccctgaaaggccatgaataaagttcagatttggatattgaatcatattttccacagacttcaattcaggtttcagaacatattcccaaagtaaagaaaatgctgccactaagactagataaaacccacttaagatttaaagggccggtctgtgttattattscagtggtccaaatttgttacctaaaagagctaggtagagattttttatgacatcaattcagtttactatcattctatatcacattttgtgtatcaaagtatttcattttgcatactttatacttacgtttaagtatactttatgtacttaagaagtccaaatgcttttatctttttatactgatagcgcagtaattcttgacaattgatgtaatcatttatcaggtgaatcttttatccaagtaactggataataacaatttataggtgctaattgactttgaaggtggtcttttaaagc

SEQ ID NO: 91602 - DNA, 601 bp, Human
atcaaagtatttcattttgcatactttatacttacgtttaagtatactttatgtacttaagaagtccaaatgcttttatctttttatactgatagcgcagtaattcttgacaattgatgtaatcatttatcaggtgaatcttttatccaagtaactggataataacaatttataggtgctaattgactttgaaggtggtcttttaaagctctggcatatttttaacttctttgaagtgtggaatttcagaaaaaaatacttattaatagacccaagtgataaacattcagaggcatacacyagtgtcttatgactttctaagaaataatttaggtgtgaaatattattcacaagtaaaactaggctttaagtagctggatttgggggaaagtgagggagatgttaaccctccaattaagtaaaatggcggcagtttgaatacagggagtttagaggcaaagcattgccacgcattcttagagactggctttaaggagagagctggaagacaagcctaaggctcaaagaaggatttagatacgtgagaataagtcgcctaatgtccttgatgatgcctaaaagaaagataacatatgactga

SEQ ID NO: 91603 - DNA, 601 bp, Human
tatcaggtgaatcttttatccaagtaactggataataacaatttataggtgctaattgactttgaaggtggtcttttaaagctctggcatatttttaacttctttgaagtgtggaatttcagaaaaaaatacttattaatagacccaagtgataaacattcagaggcatacaccagtgtcttatgactttctaagaaataatttaggtgtgaaatattattcacaagtaaaactaggctttaagtagctggatttgggggaaagtgagggagatgttaaccctccaattaagtaaaatggyggcagtttgaatacagggagtttagaggcaaagcattgccacgcattcttagagactggctttaaggagagagctggaagacaagcctaaggctcaaagaaggatttagatacgtgagaataagtcgcctaatgtccttgatgatgcctaaaagaaagataacatatgactgatgcaaggttaggatttggttaacccaaacctgtggtgggcccatggaaaaataagaaggtgagagtgcatgtcaaaaagagtgattcataataaaatcattaggtcaacgaatgagagaacaaagca

SEQ ID NO: 91604 - DNA, 601 bp, Human
ataatgggtcttttagatgctgaatactgagggtcacttagtgttgggtggggatgttcacccaattccaggactgctgaaagcaggtggccgagcaggaagtgctatctgggttcagtgccccagagctggaaatcccagctaactgtagctatgtgttgcttactgcctgagcacatgttcctaggctggctggaatgttttctctagcaagggagataatggtctgcttcctcaatagctgtcagagaaacaaaattgagcaagtgaatttctggttttccttatgatttggttttcyatgtttttttttcactccccccttttattttagagcctttgtatgtgcagagagacttaaccagtgcactctttccctgcgccttggctagggtgggaggaaaggagtctgtttcttctccttaggaaaccctgggcaaacaatttctctaactctgagatttttccatttaaaatgggaattacagaacctgcccttcacactctgagtggttatcaaaattaattttgataatcaaattactgggggccatactagagtgagatattaaagtgatgctttgcagctaggttcagaagt

SEQ ID NO: 91605 - DNA, 601 bp, Human
ctttttttttagggtgatgtatttgtttttattttttaagggagaaatcattatatacaagtattttacagtgtccgaacttaggaattgaatagattcagataaattgttttgtgatgaggctggtaacctcattatatgaacccttatttatatctgaaatcctggaaccacatagatttgaataagaaagcatttcttattatctgaattcctcttctctaaagaccacatagattcagatatcaagaaatacttttctggcaaagaaaatatgcctttttttcctcccagagcccaycttatatgcctgtataggcctatagaaggtcttgaaatctaatttgattttgattatgtgggcagctgggagagcaggggaaacaggcttgagataatatcataattcttaaatagttgtaattttatatttattcgcgactagaattcctttgagataaacctttagtagaaattgaatttgtttgtttgtttttttaaccagccacttgtctgttgggatctgaaatattttcaatagaaaacaaagttattggctacagttgaggtatctggtattcacagaatctctcatatttat

SEQ ID NO: 91606 - DNA, 601 bp, Human
ttgcatggaaactaatcagaaggacatttggaacttgtttggctgaaagaaatgccatgctcttgaagttcacaaaatagaattgttctcttttgggctgctttgggagccccctaccattttggtctatttactgtccccacctcatttctcacatgagtcttccaagttaggattatgtcatggcagtaggcaaaaagaactgtagttttcaagtttctccaaaggagcttcaaataagtgacagatacattgcctttacaggccacgttttcttaatatctgccttattgaaataagytggggcatgtatgaatgccgtgtccacaaacatttcacaaaagtatagagaggagctcagccacattgataatcttcctgttaccctgtttcttggctacctatataaataagagctgctacagccacaacattttcaaggtagcagaaggaaaatatacttatcggtagtgactgcttttaaaaacaacatttattgattttctagctgtcaaagttaatatatctttttttctttctttttttttgagacagagtctcactccgtcgtccaggctggagggcagtggcacgatcttgg

SEQ ID NO: 91607 - DNA, 601 bp, Human
ttggtctatttactgtccccacctcatttctcacatgagtcttccaagttaggattatgtcatggcagtaggcaaaaagaactgtagttttcaagtttctccaaaggagcttcaaataagtgacagatacattgcctttacaggccacgttttcttaatatctgccttattgaaataagctggggcatgtatgaatgccgtgtccacaaacatttcacaaaagtatagagaggagctcagccacattgataatcttcctgttaccctgtttcttggctacctatataaataagagctgctrcagccacaacattttcaaggtagcagaaggaaaatatacttatcggtagtgactgcttttaaaaacaacatttattgattttctagctgtcaaagttaatatatctttttttctttctttttttttgagacagagtctcactccgtcgtccaggctggagggcagtggcacgatcttggctcactgcaacctccacctccctggttcaagcgattctcctgcctcagactcccaagtagttgggattacaggcgcctgccaccacgcctggctcatttttgtatttttagtggagacagg

SEQ ID NO: 91608 - DNA, 601 bp, Human
aagcgattctcctgcctcagactcccaagtagttgggattacaggcgcctgccaccacgcctggctcatttttgtatttttagtggagacagggtttcaccatgttgcccaggcttgtcttgaactcctgacctcaagtgacccacccaccttggcctcccaaagtgctagtattataggtcaactggttatggtcaactgaaatgggaggatgtatgtataaaatattaaatggaacaaaaaaaaataggtgtgagtcaccgtgcccagcctaatatatctttacagagaatttggaaarctcaaagaaccttaggaaataaattattttattttataagtatcttggtaagtttatgctcaaagtttttataagaggatcctcttctctggaaatatggctttcttgtttagagtatttgttttctctttagtatctaaatcttattgtaggtgttcttcattggctataaactcagaatactgaaccataaactttcagaattaataaaacaaggaattaatttatttcacatattccgatgactcactgttctgattagaaagcagaagtaacacaatgcctagtacggtagcagta

SEQ ID NO: 91609 - DNA, 601 bp, Human
aaatcatgtgcttaagttttactaataggaccttttggtgaaatcggggggggaaattaaacatttcaagttttcaaatgaatttaggaaacaggtgagtggactttttgctcattggcatgtgatttgtgggtggaaatttccttttaagcaagaacagtgtactatattgactgaccatgtcttccaaggtattgtccctgagaaccaggatgtagacaagtgttcttagtctaactgagtgaattaaaaaagtgtgttggcgtgaatggccatgtgcattttcaaggaggaggggcaygcgccagggcctatggaattaacattttacaagcatatacgtaacatttgtctgtaggtcagaaagggactgctaggtgtgcatgtttcccaagtctgaaacttgccctggaagcagcagcagggtgtgggtggtggttcagaggaaaaacgctgttggaacattagacatgtgcagtaatcagttatcttcacaatctgcaatcagttgcaagaatttctcaggccttaaaatttgtaaaagaagcagttgtgtttgctttgtgccttatataactatcccacgtaatactttgaaata

SEQ ID NO: 91610 - DNA, 601 bp, Human
aatgaaagggccaaatagagatgtcaagcaggcctgagttgagcactggctttctgccagtagctgtgtgccctctttgggccgcagtcactttactggtaaaatgaagtcacatcacctatcacttccccttctctccactgcacacccccagtacaagccatagtcatactgtatgtagccactgtaggagcgtcctaactgctctccctactttgaatcttgcctccctaaaatccattctctacccaccagccagagtggtggtgaagctcaccatctttatctgaaaccatcttgygtgtttgttattgtctctctgacctccccactccagaatgcaatcttcacagtctctgttctatccttttggtcattactctcctcctagccactgacacctctcattttctcctgttctcattcttaattttagcagtttttttcctgagctagtttgaaatgggagtcagaaaacctggggtctagttttagttctgtgacttccttgttggcccttagttaagaaagtcacttcacttctccaggccccagtttccttccctgtgaagctgagtgtaagagtcagcaagcactgcag

SEQ ID NO: 91611 - DNA, 601 bp, Human
tgacctgagaagaaatcatattttcttatttatgtgcttttactctctcagcagtttagttctaaaatattacaatgtaatcagaaagtcacataagtagactacattgtcttggaatttttgatcatttggaaaggggtgggcctatgtatatcttagtttagtaaacacatttcagatagggaaagcagtaaaggttttttagttttttgtttttgtttctttggtttctttaagtatctcaccattcaccttctgaattctaaaataatttagaagttacttaagtctaggcaaatgycacattaatgataactcagcaagccattcaagcaagaccttgtctgatctctaccaggcaaatcttgtttgctatcttacacgtgcaacacaagtaaaaactcttgtgttgtttcgaatgtgccagaggatcactcactctctcactgtaatggaggatggagaataataggctgggggggacatagatgtctctctctctaggaccctgctctccttcctccaggccttgccagtacagtcaccttacagctgtctttgcttccctctcttctctgcagaaaagaaggacacagtgttg

SEQ ID NO: 91612 - DNA, 601 bp, Human
gcatgtccagccccccacggcgggaggacaggctctgtttttaagccacagccgggagaggctgagcagagcccctcagagcacaggggagccgaccctgcggagctccatcctgcacgtccagccctcagtcggcgagagggcaggctctgtttaaaagccactcggtcggcggagctttgtcatggcagctccagccgcccagtccccaaagcaaatgtgtcaatattcttagttattgattctaggtgagggatattcattgtttttaaacgtttttgtatatttttcaaaatagtcsgtttaaaatctgacttcaaaagtttgactttaaaaatcagactttaaaaatatgtgtcatggaggccagatgcagtggcttatgcctgtaatcccagtacttggggaggctgaggtgggaggaccatttgagcccagcctggggaacatagcgagaccctgtctctaaaaaaaatggaagaaattagcctggcagggtggcacgtgcctatagtcccagctactctggaggcagaggtgggagaattgcttgagccccggaggtcgagtgagccgagatcacaccactgcactccagcct

SEQ ID NO: 91613 - DNA, 601 bp, Human
agccgaccctgtggcccctcggtcctgcatgtccagccccccacggcgggaggacaggctctgtttttaagccacagccgggagaggctgagcagagcccctcagagcacaggggagccgaccctgcggagctccatcctgcacgtccagccctcagtcggcgagagggcaggctctgtttaaaagccactcggtcggcggagctttgtcatggcagctccagccgcccagtccccaaagcaaatgtgtcaatattcttagttattgattctaggtgagggatattcattgtttttaaacktttttgtatatttttcaaaatagtccgtttaaaatctgacttcaaaagtttgactttaaaaatcagactttaaaaatatgtgtcatggaggccagatgcagtggcttatgcctgtaatcccagtacttggggaggctgaggtgggaggaccatttgagcccagcctggggaacatagcgagaccctgtctctaaaaaaaatggaagaaattagcctggcagggtggcacgtgcctatagtcccagctactctggaggcagaggtgggagaattgcttgagccccggaggtcgagtgagcc

SEQ ID NO: 91614 - DNA, 601 bp, Human
ggctgcagcccttactgggcctaggctggggctgggtggactcggcacagagcaggggaaatgccctgccctctgggtttctgggaatgcagtggggacccaggggccccaccaccgcaggcagcccctcggggtctccatctcccaggccagggctgccatgcagctgtcgggacagacaggcaggtgaggaacagaagtcatcacgggtactgtgagcagggaccctgcatggctaggaagtgctaagggaccccccagctgtagggcgaggtgctggcgacaggacaatggccgctgygtgtccacaccgcaatgtccctgggaccatctgtgcattgttcttgtaactggaaacttagctgctatttatttgcacacattggtggagggacctgctcctgacttgatctgtgctggcgctgacaggctcaacccttttcctgtctggcttgcaccagccctcagccactgggcctcaagccaggaccctgggctcctgttccgccccccccaacccccctattttggaatccaccccggggagcaggtccagctgggcccctcggcctcccctgcctccaccaactggctgggtggg

SEQ ID NO: 91615 - DNA, 601 bp, Human
cttgtctgccggccggccaggggaagctccctgcataggcgtgtgcggcgtgggcccggggaatcttccagccactccagagtggattttgaccaaggagggctgtggggtagtgtgactctcagggccagcaggcagccaggccagggcactcagagacctgcctgaatggaggaagatgggcttctggcatcagggccaagagggctcctgggaggcagcctgggacagggtgggctgcagcccttactgggcctaggctggggctgggtggactcggcacagagcaggggaaatgccytgccctctgggtttctgggaatgcagtggggacccaggggccccaccaccgcaggcagcccctcggggtctccatctcccaggccagggctgccatgcagctgtcgggacagacaggcaggtgaggaacagaagtcatcacgggtactgtgagcagggaccctgcatggctaggaagtgctaagggaccccccagctgtagggcgaggtgctggcgacaggacaatggccgctgcgtgtccacaccgcaatgtccctgggaccatctgtgcattgttcttgtaactggaaacttagctgc

SEQ ID NO: 91616 - DNA, 601 bp, Human
acgtggtatgggcattgctgccctgggcagtgggcagtggggcctccacattttccagcaagacagtggggactagagctcacagcaaagatgcttcagagacgagatgggccattgactcggatgtggacagacacggggcccccgaccctgggctcccaagacaaggacctcctgaaacatatgcctgccagggtcagggcttgggatacccgcatggcaacgtgggggtcgcggctcttccgccaggcggaggcaccaacacaggcgcttaagatccaggcccgagatgccatgcaayggggtgattttcccggctcacccacaggtcccatgccacagggttccccaaacatggcgccagccccacactgtcagacccagtgcactgtcactcagttccgtctcaggcctgggcacggccccccagcgaggtgacacagagaccaggccctggttgccacagctgcggtccctctgcttcctgggacaggcggcctccgtggcaggcggtggtgatgactcaaggagcaaccagctcagaggaggagggggctgctgccctcgtgtccctgcagccaggctggcccacggcgtgctg

SEQ ID NO: 91617 - DNA, 601 bp, Human
ccatggagaccccagccctgggaggagtgtggccccttggcaggctcagggtccagtctttgcccccttttcaggacaagctcggagctgggaccacgtggtatgggcattgctgccctgggcagtgggcagtggggcctccacattttccagcaagacagtggggactagagctcacagcaaagatgcttcagagacgagatgggccattgactcggatgtggacagacacggggcccccgaccctgggctcccaagacaaggacctcctgaaacatatgcctgccagggtcagggcttsggatacccgcatggcaacgtgggggtcgcggctcttccgccaggcggaggcaccaacacaggcgcttaagatccaggcccgagatgccatgcaacggggtgattttcccggctcacccacaggtcccatgccacagggttccccaaacatggcgccagccccacactgtcagacccagtgcactgtcactcagttccgtctcaggcctgggcacggccccccagcgaggtgacacagagaccaggccctggttgccacagctgcggtccctctgcttcctgggacaggcggcctccgtgg

SEQ ID NO: 91618 - DNA, 601 bp, Human
ttatattttatgtttctaatctcttttaatttcatttttccatgaactttttgaaggcctctcatataattatttattctaaaagcaaatgcaactgagtgagtctataggttggagcttagattaaacaaatgacttcagagaggatctggcctgagctctgaattttgtaaatgtgatctctgccttctttataaagaatttatcctggaaaaactcaaatgtaaagataagtactacctttagaaggtaaattttagctatataagatactgaatgcttatgaagaaaggcagagtccatcatcttcatactgaccacagccataaacagtggcaccaacctctttcagcaaagcccctgaagccaccacccaaacaggaccccatggggacagcattctgtctgccacccacctggctttcttcactcacctcagggaatttctttttctgcacatattcagtggtggccgcatcaaaatacttggcatagccctcattcaggctgtaaatctttcctttcttcttaatcttgacatctttttccaccaggacaaattcaccaagagcctagcaacatgaagagagatgccaggaag

SEQ ID NO: 91619 - DNA, 601 bp, Human
ttgtacatgctgaagtttcagaaccactgtgctaagcaacctgttggaaatacatgggagttatctacaaatacagaactggagctcaaacagggtgggaaatatcaatacatccacattctgaagttaattgctattgaaataatgggagctcacaagaaacagcagacataaataacaacagctaacattttaaaagcactactatgtgctagacattataagctgttaacagtcatgcatcacttaacaactgggatatggtctgagaaatgcctttaggcgatttcgttgttgtgtmaacatcatagaatgtactcacacatacctggatggtatagcttactacacacctaagcaatatggtataccctattattcctaggctacaatcctgtacagcatgttactgtactgaacaggcaattgtaacacaatgatgtctgtgtatctaaacacagaaaatgtacagtaaaaataggtataaaagataaaaaatggtacatctgtatagggcacttaccatgaatagagcctgcaggactgaaagctgctctgggtaagtcagtgagtgagtggtaagtggatatgaagccctatg

SEQ ID NO: 91620 - DNA, 601 bp, Human
gttaactaggactccagaaaacaacacacatctcagacacagttttgaaagaagggaagaaatagaccacagacaacttactccaactcaaagattaaaatataacatgttctcccaaagaaataataggttacgaattctgaggcactgaaaaaatgtacctaaaagttcaaattgtgaaattgttattttaattctagtgcatttaatttgcaagcctttcaagaagataacaagtgctatcaaaaactcatcatcggtatttgaatgaggttgaaaataactataccaattattaccmcacaataatggagaaagaatagcaattattcagctttttttttttttttgactgagtctcgctctgtcgcccaggctggagtgcagtggcaccatctcggctcactgcaagctctgcctcccgggttcacgccattctcttgcctcagcctcctgagtagctgggactacaggctaccaccaccatgcccggctaatttttgtatttttagtagagacggggtttcaccatgttggccaggctggtcttgaactcctgacctcatgatccacctgcctcggcctcccaaagtgctgggat

SEQ ID NO: 91621 - DNA, 601 bp, Human
ccatccaaacccacctcccaggctagaaagtctcctctggattgaaggaaagagagaaatcagtgaggcctaggttggaagagtcagatctgaaaggaatcaaacagattaaaaatgaaggagcatttttagtgacgaccatttcttgaatgctcaggaggcccttgggggtgggttcagcatctacagaccataagagcaagcacatggtcagaatcattcctggggctatgtgctgagggcttcccttgggcagtagccactcccttgctgatgacctccctaccttaaggatgcctayccatgcctgaggctttagccagttgccatccagtttttatccatgcctgaagctttagccagttcccatccaatttttatccatgcctgaggctttagccagttcccattcaatgtttccttgtagatagccatccttgtaacttccctggaacttataagccctgaagaagacgatcctggacactctgtgacagtaagagtagtggtggtgtctacagtgatgaggacaagctctgtatttggaattagcagagtgaggaaaggagtggcaagcactaggaatcactagcctgatttc

SEQ ID NO: 91622 - DNA, 601 bp, Human
tacattgtgtgtctactacatgcttaggtgctagagaatccaacagtaagcaatacagacacaaacccctgccctcactaaaggtacaatctagagggaagaaatagttaacctgtgtctgtttatttaaacaagcaaaagtatagtgtgtaaaacagtgataaatagtggtacctatcaaggagaaaaataaggcaggaaaagatgttatttaaataactattgcctgtgtaagagaagtacttctgtgggtttatttattttgggaggatacttgtctttactagttttctttctttcttttttttttttttttttgagacagagtcttgctctgtcaccctggctggggtgcagtggcgtgatcacggctcactgcagcctctgcctcccaggctcaagtgatcctcccacctaagcctcctggtaattttattattttttttttttgtatagacagggttttaccatgttgcccaggctggtctcaaactcctgggctcaagtgatccacccacctgggcaaagctaggcaagcttgagcctcccaaagtgctgagattacaggtgtgagccaccacacctggcactagttttctaa

SEQ ID NO: 91623 - DNA, 601 bp, Human
ttttcttatgagcctcagttttataatacataaaatgaggataataatccctatttacaacatagggttgtcttacaactcaagataatgtagagggaatacctatgagttataaagtgctctacagaaatgtgttaatctcagaataattatagattcttaagagtcctaaatactaagccctgtttaagaattcatacatagtgaatgggatttcagtgccacacacaatggacactggtagtagtagactaataaaaaattaaatatacaaggctgttctcatcttccccaccttaakatttaaattttgtttataatccttcatgtcacataaacgaatgattcttctaacacatatgtacaaataacttcttcatctaatatcaaagaatgctaaaagaaattcacctcagttttaatttctcacctaaactgtacagttatccaagtgtgttttttgttttcatgcatccttaatttatgttatgaggctagtgtcatatctttgcaatatttttcctctgtgtccctctgtatgatacactgggctacgtttgtgagaatctttgccaagtgcaggaaaaatttcattgtacag

SEQ ID NO: 91624 - DNA, 601 bp, Human
cagagtctcactccatcacctaggctggagtgcaggggtatgatctcggctcactgcaacctctgcctcccaggttcaagccattctcctgcttaagcctcctgagcagctggtactacagggtgcaccaccgtgcgcgggtaatttttgtatttttagtacagacggggcttcgccatgttggtcaggctggtctcgaactcctggcctcaagtgatccactcgcctcagcctgccaaagtgctgggattacaggcgtgagccaccgcgtctggctgcgacacatttttaattaattcakttatacatatacgatctagatgctttaagaagcctctgaactcaagggttccctatgcatactgcatttatattggttgaagtacatgaaattacagtttttgaaggccatttcatatggttcaacgtaatatgttaagtgtaggttcctatggttcaacctaatacataggccacattggaacaagaattatatacttcaaatccatgaaatagagagtgaatgatttgtcaccatcagagaagcacataacattagctattccactagttcctctatcactttctttcctatctgttc

SEQ ID NO: 91625 - DNA, 601 bp, Human
gattattaatatatttaatacctgaaatctgccccctaaggaccatacagtagttatgatcattacctaaaacttaaacaaatctgtagtaccagaggcatacaatgaaataccagataacaggtaggtttcctggaaaaagtgtggataatatgccagaaatggatttctatgagagatgacaaaagaggtaaagtgtgtctataaagtcagtattctttaaaaataaaacaaacatggttcccaccagagtgacactaactatctcaatatggtatacttaaaagccaaatttcagagmatacattcagatgtctctcatctaatgattttatgctttgtaaggaaaaaggacatagagagaaatggcgcaatatattctcccacagaggaaggcaaaaggcaaagttttctttaaaggggttttaaactttataactacttcttatcaaaaagaattcgtcatgaaatggcagattacaccaatcaaattaatagcaattatgtaaactgatttaaaggtatggtattctaatacatatttctgaaccaagagcaatgccttgctcccaagaaacaaacaaatatggaattattagtg

SEQ ID NO: 91626 - DNA, 601 bp, Human
tatagcatatagtatatgtttacacaggaatgagggaactgaaacccattaaaaagctcatatatttaaaaaataattggaagttgcaggattgagctagtgggagtgggaagtctaagagactgagaaaaaaataatgattattaatatatttaatacctgaaatctgccccctaaggaccatacagtagttatgatcattacctaaaacttaaacaaatctgtagtaccagaggcatacaatgaaataccagataacaggtaggtttcctggaaaaagtgtggataatatgccagaaayggatttctatgagagatgacaaaagaggtaaagtgtgtctataaagtcagtattctttaaaaataaaacaaacatggttcccaccagagtgacactaactatctcaatatggtatacttaaaagccaaatttcagagaatacattcagatgtctctcatctaatgattttatgctttgtaaggaaaaaggacatagagagaaatggcgcaatatattctcccacagaggaaggcaaaaggcaaagttttctttaaaggggttttaaactttataactacttcttatcaaaaagaattcgt

SEQ ID NO: 91627 - DNA, 601 bp, Human
gcacactgtagtagcttgtcctgaactgtttttggaaaacatataggctgattgcacctgactaattgattacatagtctagtttcagctacatgaccagtgggatatcaaagatcttctgtacacatgagccttagctcccgataccaaggttatcttgcacataatcttggtggttcacaattagaagacaaatgtgtcctgtgcaactaaaaatggccttgtgagtgatctctctcctgctgtaccataccttgagccattattaaagccttatgagaatataccccgtagaatcttrtaagtcttttcaattaaccaatgctgtatagttgctacaatatacttttatgattcataaatattttggggatatcatgagattttaaaatttcagaacttcttctcaagaaatggtccagaaatggtccttattataaggacttgatacttataacaaacttgtgaggaaataccctttgccataatgtatatgcttgcttttattaacttcaactttggtcaaatatatgttgatagcttatcatcactggaattttaacaacagaccacaaataagctcttagaaaggatagattat

SEQ ID NO: 91628 - DNA, 601 bp, Human
tttacttatttattcacttctgagacagagtttcgctctgtagcccaggctagagtgcagtgatgtgatcttggctcactgcaacctctgcctcctgggctaaagcgacccttccaccttagtctcctgagtagctgggactacaggtgtgtgccaccacacttgacttctcttttttcttttttctttcttttctttttttttttttttttttgcatagacggggtttttccatgttgcccaggctggtctcaaactctgggctcaagccatcttcccaccttggcctcccaaagtgctrggattacaggcatgaaccatagcacctggccataggtgccctatttttgatataagactatacaccagaaacagtagcaaacagtagcaagaacatcaagaacagagaatgaggactttctacaaatgaacctagcattccatagctcttcttcaattcaagagtcagggcctctcctctagacctattgtgcaaccctggagttattggatttcttgtgggaacaaggttagtcagaaaaggaataaagacattatggcattgatggggggagccttgtggttgttttgagtaatcaat

SEQ ID NO: 91629 - DNA, 601 bp, Human
actatatatcgagtgaagctgtggggtggagatagatgaggactgattgtgtagtacctggtgggtgattctgagcactttggcctttactgagggagatgggaagcccttgcaagtaagagaatttaaaggatcactctaacctgctgttttgagaatcaactatggggcaggggccaaaaaatcatacagatgagagggttgtggtggcttggatgtaaagtgataacaagtagaaaggtggctagattccgagtatattttcatattagaaccaactattgcagatggggtgtgggawatgaaaaagagaggagtcagagatggcaaaaagcctggagatcagcaaacatgatggatggagttactacttattgagatcagagaggatgtagtaagtgtagatatttgggggaaggggtgcaaatttgtttactttgagaaccatatttgattctaagataacatgttgagtaggcagttagccatacaagtctgtagttcagtttagcgctccaggaactacaaatataaatttggaagttattagcatttgaagtatgagaagaggaaagatcaccaggggagcaagtgtaggcag

SEQ ID NO: 91630 - DNA, 601 bp, Human
aaaaaaaaaaacaaatagatgtcaaatgatgtcagtgcttgaaaaaaagaaagtcacagaagggacaagcggttgcaatttaaggtagagtgctttctcactgtgaaaatgaacttgagtgaagacttgagagtggtgaaggaactcagacatatccatctagaagaggagagagcaagtgccaaagtcatgaggcaggtcacgtgctgtctgtgtatgtgaggacgcacaagaaagccacagcaaagtgaataaggggtggggtgtcataggagatgtggtaaagaaataactatatatsgagtgaagctgtggggtggagatagatgaggactgattgtgtagtacctggtgggtgattctgagcactttggcctttactgagggagatgggaagcccttgcaagtaagagaatttaaaggatcactctaacctgctgttttgagaatcaactatggggcaggggccaaaaaatcatacagatgagagggttgtggtggcttggatgtaaagtgataacaagtagaaaggtggctagattccgagtatattttcatattagaaccaactattgcagatggggtgtgggatatgaaaaag

SEQ ID NO: 91631 - DNA, 601 bp, Human
ttgttttaatggcatgaacaaactcagatgacaaactttaaagcacaaagaaggaaatataacaacaacataataaaaaccattttaaagtctattatctatcagccaacttgggtttaaatcggttcctcccataaactaaatttactttgtgatttgccaatccattccttcattcatccatcaaatacttatttggcttctattatgtgccagcactgctttatatgctagggaccatagctatgaacaaaacagatgagaaatgttgctctcatggagctaacagtcctgatggggygggggaggtaacaattaaaaaaaaaaacaaatagatgtcaaatgatgtcagtgcttgaaaaaaagaaagtcacagaagggacaagcggttgcaatttaaggtagagtgctttctcactgtgaaaatgaacttgagtgaagacttgagagtggtgaaggaactcagacatatccatctagaagaggagagagcaagtgccaaagtcatgaggcaggtcacgtgctgtctgtgtatgtgaggacgcacaagaaagccacagcaaagtgaataaggggtggggtgtcataggagatgtggtaa

SEQ ID NO: 91632 - DNA, 601 bp, Human
aggtataatatcctccttttaaaagatacaaaaattgaggcctaaaagatgaaatgtttgcgcaaatcaatatagtcagtagatggcagagctcagacaccagatcaaggtccatctgattctcaaagcagaggattttggcatgacaactcagctttattgaggtataactgacaaataaaaattgggtatatttaaggtttacagcatgctcatataagcctttgtgcatatgtctgctgtttctatcagaactcaaatgccatgaggagcagcctattcattgttgtatatactgtgwctgttacatagtaggcattcagcagataatgtctgaataaatctgacccattttctacatgatgaaaatgaggaccgtgaagtacaatatgttttctcccattgtataattagacttgtgttccaaattaggtaaataattccaacaataaacattctactgaaagcagacttctaaattcacatacttcatgtttggaaatgatgaaaccacgtatgagtaaaagtattctgagcgataaattttagtaaacaaaaagatagtaaagatagtctaaaagtagaaagcaaatctcaaatc

SEQ ID NO: 91633 - DNA, 601 bp, Human
tcctttttttccagaatctaattgacatttcgtctaatcatgtctctagtttcctctggtctgtgacagtttcctagtcttttctaatttttttttcatgaccttgactgttttgatagtagtcagacattttggagaatgtcttttggtttttggatttctctgtaagtttctcatggttagactggggttatgagtttgcggtgatggaaataaatgatgtctgttctcagtatatcatatgtgtgacttagtaactttgattaccaggtcaaagtagtttgacaggtttctccattgyaaagttaccccacctccccccacccgctgatccttcccatactctgttctttgaaagctagtctttaagttcaagccacactcaagggaagaagaaaattaagctccaccatctggggtggagtatttacatacataatttggaattctatagtgtggatttttctcttttcaccttttcattcagtcatgcatttatatcattatataatcatgtgtatttattttgtgttttgggctataatccaatactacatcatttattttgtggctaaaattgttcagctttggccactgagag

SEQ ID NO: 91634 - DNA, 601 bp, Human
atgaatcaatcctagtccattactattaactaaatataacactttttttagattatattagtttttccattaatgtcctttttttccagaatctaattgacatttcgtctaatcatgtctctagtttcctctggtctgtgacagtttcctagtcttttctaatttttttttcatgaccttgactgttttgatagtagtcagacattttggagaatgtcttttggtttttggatttctctgtaagtttctcatggttagactggggttatgagtttgcggtgatggaaataaatgatgtctsttctcagtatatcatatgtgtgacttagtaactttgattaccaggtcaaagtagtttgacaggtttctccattgcaaagttaccccacctccccccacccgctgatccttcccatactctgttctttgaaagctagtctttaagttcaagccacactcaagggaagaagaaaattaagctccaccatctggggtggagtatttacatacataatttggaattctatagtgtggatttttctcttttcaccttttcattcagtcatgcatttatatcattatataatcatgtgtatttatt

SEQ ID NO: 91635 - DNA, 601 bp, Human
ctcccagtcttgacgctctggcttcctgatgtcgtgaaagcagatgcagccactgtgctggttctgcagcctcatcagctcctggacgtgctccctcttcttgtgcaactggcgcaggaagtagcggctaaagtgctccagggccgcattgtcccggtcgaagtagaaggccatggacaggtacacgtaggaagcatgcaactccaggttgacgtggttgttgacagcggcctcgcagttggggtggtagttctgacgcacctgcaacactggggtggtggccatggcaggcaccttgggrtgtggtgagcaggcaggcgggagctgtggtagtagtagctggctgaaggcggatggctaatggcggaaagggccggaagtgggtatttgggtccattatctggggagggatgcattccttttcagtggaagtgggcagggaggagaatgagtactatgttccatgtgcaacccagtgaactctgcactgtctgacctgtgtccagtttttagttttgcagtaacatttctaatgtccaaggactttctcttatcccctaattggtcccctctgtaatagcttcttctcattttacaaacc

SEQ ID NO: 91636 - DNA, 601 bp, Human
ttgcacaggttgctcaggtagtcacccagctttttgatggccttgacctgctggttcaggaagtggctctccaggaagtcgcatagctgggggtcacctttctccatggccagctggtgtagctccaggaggctctggttgacactcttctccaggtggaaggcgcactccatggcctcgagcctgctctcccagtcttgacgctctggcttcctgatgtcgtgaaagcagatgcagccactgtgctggttctgcagcctcatcagctcctggacgtgctccctcttcttgtgcaactggygcaggaagtagcggctaaagtgctccagggccgcattgtcccggtcgaagtagaaggccatggacaggtacacgtaggaagcatgcaactccaggttgacgtggttgttgacagcggcctcgcagttggggtggtagttctgacgcacctgcaacactggggtggtggccatggcaggcaccttgggatgtggtgagcaggcaggcgggagctgtggtagtagtagctggctgaaggcggatggctaatggcggaaagggccggaagtgggtatttgggtccattatctggggagggatg

SEQ ID NO: 91637 - DNA, 601 bp, Human
aacgtaggcttacatcactaccatttctctaaggaatctttttcttactaggaaataatttcattctatccatagccataagacaagacaaaagaactcttctccacatctagaaaggagaaaccagaggtcacacttacatcaggacaagctgatttgaaaatacactaggagtggacactgggggccatggtctggaataaggtaatggtcaggtgggaacagaaactctctgggtgttcaaacatctcaactataccctaaatgttagctgccctgagcttggggatagatttgtcamactctctcttacactttttctggtgagctcatccaatcacatgacttcaataccatctataatgtctcccttacgtatatttccaaagctgacattcatttttccatctacttgattcacgtttccatttggatacctaataaggatctaagatttcacatgacatgtattccccagccctctaccctaggtgtccccactgcaaatgtcctgaggttaagaatagcaccatcaacccaggtgctcaagatcaaacaccagaacttattgtccccatctcccagtcctcaccttctgtcc

SEQ ID NO: 91638 - DNA, 601 bp, Human
aacaccttgttttctaatggttctgtttggggttccttgccaccagacattcctcctcagctccctctccaaccccaaagtttagtacacagatgttgactgaaggtcaaaattatatattgttcctaggagagacctcaggctggtgaagaagctacattaggttacttctaaacctggaccttaatcccaaatgaaaagtagtccagtagttcaagactttaacgtatgtaggagaagtatttaaaagataaaaaggaaacttgacccaattactagttatgaaacctggtcaagttaytcctttaggcctcagtttcctcacttgtaaaatggtataatacaaacctaccttacaggctgcctgtgcattaagtgagataacatttataacatgtctaattaagtccctggcatataaatactcaatacatattagtgattataattaattttatatattataatcaaatctctgcttcaaaatgactgattacctatcccttactttgatacaaagatcaccctcaattgcaatgctattcactgcatttatcaaagtgcttttcttacaatcatgtttatttgcaggtattatggg

SEQ ID NO: 91639 - DNA, 601 bp, Human
aagagaacgctgatgggctgggggtactcatgccctgggactacctggcaacagggtgagggacatgctgcagccataggcgcccagaatgtgcatgggtgtgacttcaggctgaggccaaattgactaggcccggggtagtagcagctggatgtgggctctttctgacccactagctgcttctaactaacccaaaaacccccagaaaaaccttggcgggtcaagagatgaaaacgcagcccagagaatagctccatactgcccccgtgtggtgttctcaagcactgccccctccctatgyagaaatctaaggctaacaagcggatttcattaaaggtctggtttgttttaaacagattatctatgtgtaactctccatttatacaagataaatcagggaattaccatttgccgtacaaaatgacgatgcactttactaaagaattcatcatgggattcctataagtggtgattttttccccgatgtgtaaaaaataataatgaggtaaaattgatattacaccttttatagaaacccatctgttgtgcaaaaaaagcatgtgtatttggctaaatactgaaacccggaggggcactgctg

SEQ ID NO: 91640 - DNA, 601 bp, Human
ttgaggaaaggtggggatgagggaggacaaaggagagggaagccaggttctgaagaccttttctggaaagcagggggtgccctgtccaaaggggcctaagctcagagggagggagagagacgaactccttcctatccatggagcgggaggtgacggtgtgaagctggcgggacttgcaccccttccagccaccctgggcttggaagagaacgctgatgggctgggggtactcatgccctgggactacctggcaacagggtgagggacatgctgcagccataggcgcccagaatgtgcatgrgtgtgacttcaggctgaggccaaattgactaggcccggggtagtagcagctggatgtgggctctttctgacccactagctgcttctaactaacccaaaaacccccagaaaaaccttggcgggtcaagagatgaaaacgcagcccagagaatagctccatactgcccccgtgtggtgttctcaagcactgccccctccctatgcagaaatctaaggctaacaagcggatttcattaaaggtctggtttgttttaaacagattatctatgtgtaactctccatttatacaagataaatcagg

SEQ ID NO: 91641 - DNA, 601 bp, Human
gtgtggaaccggtgctctgtcctctctcaggacacaggagtgacccatccattctctggcctgggagcccccttctaccctgccacatcctcagggacagagaaatttagacaggagggactggctggtgggggcggtgctgccaaaagatgcgagctgcagaagtgtttgaggaaaggtggggatgagggaggacaaaggagagggaagccaggttctgaagaccttttctggaaagcagggggtgccctgtccaaaggggcctaagctcagagggagggagagagacgaactccttccyatccatggagcgggaggtgacggtgtgaagctggcgggacttgcaccccttccagccaccctgggcttggaagagaacgctgatgggctgggggtactcatgccctgggactacctggcaacagggtgagggacatgctgcagccataggcgcccagaatgtgcatgggtgtgacttcaggctgaggccaaattgactaggcccggggtagtagcagctggatgtgggctctttctgacccactagctgcttctaactaacccaaaaacccccagaaaaaccttggcgggtcaagagatg

SEQ ID NO: 91642 - DNA, 601 bp, Human; identical to SEQ ID NO: 40403

SEQ ID NO: 91643 - DNA, 601 bp, Human
agcttcccagagctccagtcacaggactagagaggcgcaggcagtctcaaaagggatcccctagcctctctcttgtccttcaggcgctgcccccaaaagatcgagcagctcatgggcactagagccttcatttccaaatgcacccctcagctcaaaatagagaaaaccaacttttcaaagaaccagctggagttcaacaggaaaccacagcagaaaaaccaatgattcccggtcagccaaggggcagagggctaactgggcatttcagcatcactgccagctccctgggctggtattaccygcacgcaaggaaacaggaagactgactgccagcccataagtccaccacacacatatcacgccagtatgcacaaggacggacacaaactcaacagatgctcaacacactgatgtgcagaaacccagacacatacgtgcacaagagacactggcacacgcacatgttcacacaggtgcacgggcacccagatgcaggtacacaccaacgttccacaacacatgtgcacacactcacaaaggtacacacacatacacggacccacccccggatgcaagccagagacctgttcaggcaggcaaa

SEQ ID NO: 91644 - DNA, 601 bp, Human
tgcctgtaatcccagcactttaggaggccgaggcaggcagatcacaaggtcaggagattgagaccaccctggctaacacggtgaaacaccgtctctactaaaaattttaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttcccagctctgtctggtacatgggacacttcagcaggcctgtcctgcccaggccaatccacacctggtacctctgcacacgctcctccctctgcccgggttgccaacctgcgtcttttccagctggccactcattcttccagcccccattcaaacagccccccaggagcacactctccaagtcctggccagagtgtccg

SEQ ID NO: 91645 - DNA, 601 bp, Human
gctcatgcctgtaatcccagcactttaggaggccgaggcaggcagatcacaaggtcaggagattgagaccaccctggctaacacggtgaaacaccgtctctactaaaaattttaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttcccagctctgtctggtacatgggacacttcagcaggcctgtcctgcccaggccaatccacacctggtacctctgcacacgctcctccctctgcccgggttgccaacctgcgtcttttccagctggccactcattcttccagcccccattcaaacagccccccaggagcacactctccaagtcctggccagagt

SEQ ID NO: 91646 - DNA, 601 bp, Human
ggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaatttwaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttcccag

SEQ ID NO: 91647 - DNA, 601 bp, Human
gggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaattwtaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcaggcaggtcccagctcctcttccaaccccaatattcttccca

SEQ ID NO: 91648 - DNA, 601 bp, Human
acatacgcagcaacaaagtcagaaaaggaaagaagaggccgggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaycctggctaacacggtgaaacaccgtctctactaaaaattttaaaaaaaataaaaaaaaattagctgcacgtggtggcgggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaaagaaaacagaaccaatggtgctgtcccactgtccaaggccattattcagtgacagcattcaatgccgctcag

SEQ ID NO: 91649 - DNA, 601 bp, Human
gatattattatgaataacttccgtctagtcactcaacctcccagagcctgagtgctccacctgtaaccagggatgagatgcctccccgaccagggctctgtgaggacaagaggtgccctgtgtaaagacccaggtccttagcaaagaagcctatcgtggtggcagcagagggggatttaacagtaggacagacacatacgcagcaacaaagtcagaaaaggaaagaagaggccgggcgcggtggctgaggcctgtaatcccagcactttaggaggccaagatgggcagatcgcttgaggtygggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaattttaaaaaaaataaaaaaaaattagctgcacgtggtggcgggcgcctgtagtccctgctacttgggagg

SEQ ID NO: 91650 - DNA, 601 bp, Human
gcttcgaagcttgaagcaagctatctcgacttttggagcctcagtttattcatctgtagaagggggatgatgtcgggatatgttccgtagggtgctgtgaggattaaacaaggcgaggtggcacagggggctcagctgagagcctggcacacaatgttaataggaacacagtcaactgtcacttaccatcattaccttttacgccaaaaggcttctcactgggtttttaatgggcatgtaaaaaccacgtgaaattagcacgcctaccacgctgcccaggagatactggaaaactcttccrcagcaacgtgaggcacaacaccactctgtgcagcctgttttgctcatgccttgtgcaaagggacattttgctgtggatactatgaataacccctcgctgtggatattattatgaataacttccgtctagtcactcaacctcccagagcctgagtgctccacctgtaaccagggatgagatgcctccccgaccagggctctgtgaggacaagaggtgccctgtgtaaagacccaggtccttagcaaagaagcctatcgtggtggcagcagagggggatttaacagtaggacagacacatac

SEQ ID NO: 91651 - DNA, 601 bp, Human
cccacaggagcctctgctcctacctggggagccccgacaccctagggaacccagaggttcctgcagcccctctttagtcttcctgacaacctctcattgcgatccaggcagtgccaaggtggggtgggaggaaggaagaccctaccagcggcagctgcaaatctcaggtgcccctcaccccactgcacagtcccaggacccgctcacacctgcctgatctgctctagcacctgagcctgctggagcccagtgtgtggcctcgaaggcagcagccttgctgggaaaaatgaaactcatctcratcccttaggccggcttctgacttctctctgtggcctttatgactcttaatgtccagcaagacagagtgggtgcctggcccagacagcagccccgcaggggagccccagcctgaaaggcagcagccctggatttcttcttgccatgcaaccttgggtctctctgagcctcagccacgcagtggggcagccctatctcacagggttgtggggttcgcatcaagcatccagggaagggcatacacttcctcctttgggccccaggattggaccaggccttggagggcggaccatctccaccg

SEQ ID NO: 91652 - DNA, 601 bp, Human
ccaaaggtgggcaggagacctgggctaggcccgcatcacagccatgggtttgaagatgggcctccaatccctcccccaactctcacaggtgtcacccagagaggagggctttccatctcaaaggttgcctccttggaaaacgagttgggcctggagccgctggtgggccgggggttgaggggtggagagcaattctgaaatgaacactgagaggcagggctgagaaatggatagcatgctctgagcccctggattcagccaggcctgaagccaacactcctcaggacccccagataattgsggccatgctgtcccttgtttgtttcatccaatatgagcaggggtttctgtcacttaaactgagcaagtcttaaggtgacaagtatggcggaggctgagactggccttagcagctgtgtaggctgcttgcagctggggcccacaggagcctctgctcctacctggggagccccgacaccctagggaacccagaggttcctgcagcccctctttagtcttcctgacaacctctcattgcgatccaggcagtgccaaggtggggtgggaggaaggaagaccctaccagcggcagctgcaaatc

SEQ ID NO: 91653 - DNA, 601 bp, Human
gggcgatcctggaagggtggggtctggaggagagtggggagagccacgtgacttgagtatggggtcatccagggaagggggttccagaggcagccgagcaggcaagcctggagcccaggaggacttctaagcccaacatggggtctggagtccaggagaagggtggccacaaccgtgttcaccaccctgcacaattctcctcccttcttgtatgataggcccctcttcattccagagtttgggagtctgtccctccccctcagtcccaaaggtgggcaggagacctgggctaggcccgcaycacagccatgggtttgaagatgggcctccaatccctcccccaactctcacaggtgtcacccagagaggagggctttccatctcaaaggttgcctccttggaaaacgagttgggcctggagccgctggtgggccgggggttgaggggtggagagcaattctgaaatgaacactgagaggcagggctgagaaatggatagcatgctctgagcccctggattcagccaggcctgaagccaacactcctcaggacccccagataattggggccatgctgtcccttgtttgtttcatccaatatg

SEQ ID NO: 91654 - DNA, 601 bp, Human
ttctataaaaatcagtagccttcctgtgtaccaatagatggaaagtattcaatgagcaatggcaaaaagaaaaaaaatccttgaaataatcctgatttttaaaaatggatgacctgtataaaaatatgtatatataatacttcatggtacaacatcaaagcagaatgaaataagctgaaaaaatatactatgttcctgatgaatactgtaaattatgtcaattcctcctttaattagtttctaagtttaatttactatcaatcaaattcacgagggatttttctacccgacaaaacaattmtaaaattcatttgaaagaataaacatatgtgaccagccaagaaaattttgtaagagaataccagcaaagggggacgtatccagccagatgttccaaagccacacagtccaacagaaatagaactcgagctttatatgtagccatgtttttaaaaaaaaaagacacaggtgaaattaatttcagaaatatattttatttaacccagtatgcccaaaatattaccatttcaacctgtaatcaatactttaaaatgatctattaaacattccacattctttttggggggtacgaagtctctga

SEQ ID NO: 91655 - DNA, 601 bp, Human
gcagtggcgcaatttcagctcactgcaagctccgcctcctgggttcaagagattctcctgcctcagcctcccaagtagctgggactacaggcgtgtgccaccatgcccagctaatttttgtatttttaatggagatggggtttcaccatattggccaggctggtctcaaacacctgacctcaagtgatctgcccgcctcagcctcctcaagttacacaggcgtgagccactgtgccccgcctacagatttcttctaaggagggaaatgtctttgcttggaaaaacaccttctagaagcacrtgggataacagataacagtgggactggaagagcaggagactctgcagacagtgccaccacctcagagcagcgggcaaagtccgctgttaagacacaggaggagaatggagggattgctccagagaaactggacagagggagggagacgccactgggagggaagaaagaacccacagatgaaagtggaaatgcccccacacatggcccaaagggctttccaagaacagggtcctgttcttccagaagtcacccgcgtggccgggaggtgctggctcccccaccttctgcaggaaggctgcc

SEQ ID NO: 91656 - DNA, 601 bp, Human
caagacagagacggcctacatctacccaccccataccatgcccagtcctggaccagccatccctggccccaaaggccacagcgtagtcaccacagctgagactgccccaatcagggccacctgcaatgtccagcagcctccctgcaactgccccggctttggtttttaatgtccctagtcccgagaatgcagaagctctgcaaagagaagaacgcagcaactctggcaacctgactgtggaggcagacacctggcacacatttcccctcccccagtgcccgtgatctccacccagcgctgsgcaccctccaacctccactccattcactcccagacggagcaaaggctggcctcattggccaccttgcccagcacaccacctgcacaaccttcccagcagccctgctcatcgggccaccctccccagtgaggacacagcccgtgacagcctgggcaccccaacaggaaagacagcccaaaggccaagccgccctatctgaggtggaggatgctctggcagggcagggactcagccttgaccttgtttgctagaaaatgcaccaagaactcagtagcaggccaaggagaggagacatgaatt

SEQ ID NO: 91657 - DNA, 601 bp, Human
cttatttccgtgagaaaattaaacatcatgaagatgtcgttcatttgttcagcaaagatttgctgagggccttctgcaaaggggacactactttaggcatttttttaaaacctcacgatggtgatacttgccctatcagatgtcagaacatattgtcaaccaacagcaattaaagacccctggactggtgcaaaagaaaaacagaaaaggccaggcacagtggctcatgcctgcaatcccagcactttgggaggccaaggagggcggatcacgaggtcaggagatggagaccatcctggckaacacggtgaaaccccgtctctactaaaaatacaaaaaattagccgggtgtggtggcgggcgcctgtagtcccagctactcttgaggctgaagcaggagaatcgcttgaacccaggaggcagagcttgcagtgagccgagatagtgccactgcgctccagcctgggcaacagagtgagactccgtctcaaaaaaaaaaaaaaaaacaaaacaaaacccagaaaggccagaaataaaccccatatcctccatgaacttcacagatgatggaatatacattccaaagtcaagaagaaagagt

SEQ ID NO: 91658 - DNA, 601 bp, Human
atctgaatcaatcttcttatttccgtgagaaaattaaacatcatgaagatgtcgttcatttgttcagcaaagatttgctgagggccttctgcaaaggggacactactttaggcatttttttaaaacctcacgatggtgatacttgccctatcagatgtcagaacatattgtcaaccaacagcaattaaagacccctggactggtgcaaaagaaaaacagaaaaggccaggcacagtggctcatgcctgcaatcccagcactttgggaggccaaggagggcggatcacgaggtcaggagatsgagaccatcctggctaacacggtgaaaccccgtctctactaaaaatacaaaaaattagccgggtgtggtggcgggcgcctgtagtcccagctactcttgaggctgaagcaggagaatcgcttgaacccaggaggcagagcttgcagtgagccgagatagtgccactgcgctccagcctgggcaacagagtgagactccgtctcaaaaaaaaaaaaaaaaacaaaacaaaacccagaaaggccagaaataaaccccatatcctccatgaacttcacagatgatggaatatacattccaaag

SEQ ID NO: 91659 - DNA, 601 bp, Human
ccaccgtggggaaatgggcctgggagatccattcaggccaaggtttgtccactttgggtctaccaccaccagcattcacagaagaagcagcacctggttctcaattcccttagaagcggggctagatgctctgaaggcatggttgtagctcccacacaaaattactaaagacataaaacgaaaacatgttgaaaaagaagagacaatattatgaactgcagaaagtaactgcacacgtagagaatcctcacccccaaaaacatccaaaaaaaggaaccaaataataacaaggaagttcatraaaagtctagatgcaaaataaatagagaaactcatatatctgggaacgcaaacatgggaaacatccaagcgagagatttaggtttgttttgttttgttttttgagacagagtctcgctctgtcgcccaggctggagtgcagtggtgcaagcgatctgagctcactgcaggctccgcctcccgggttcacgccattctcctgcctcagcctcccgagtagctgggactacaggcgcgcaccaccacgcccggctaattttttgtatttttagtagagacggggtttcaccgtgttagccag

SEQ ID NO: 91660 - DNA, 601 bp, Human
aaaagccaaacaaaactcatctgtgggtggacatggcccgtggcccaccagtgtgcaaactccgccctgcacaatgggaaccctgaagtgcagaaaattatctcattgtgaagggtaaggcagggactcaaaacagggctcctcagtccacattcatagagtctccaggttgtaccaccgaatctactcgccagccttctcctgaaagtgtctcactgaaccacatcccccgtagaaactcagggcatctttcaaagaccgcagttttcctgccagcctgcaaacaaccctgtgcatgccyggtgcactgctccccaaccacaggggacacctaacagaccacgagggactgagagagcctccttgactgaaagggaaggtcaaccgccgccactcatccccataaaaccacaacatgggcacatcctgcgttcgaagctctacttgatgcaagagagcagggaaaggaaagccgtgccaccgtggggaaatgggcctgggagatccattcaggccaaggtttgtccactttgggtctaccaccaccagcattcacagaagaagcagcacctggttctcaattcccttagaagcggggcta

SEQ ID NO: 91661 - DNA, 601 bp, Human
ttttcagattcaacttcagccaagacaaatggtcccctcctgcacctgccacaggcactgtttccaacgtgggcagagttgacagttgatgggtgtgtgtgatctttcggagctcctgtcccaggcccacaggatgaacgggaaggtggacatggtgggtagagcaagcaggaaatgatgatggtcaggaggggccttgaatgctggttctgggggcctgtgctttaccctcaaagtggaggagccatggggagcatttcgggtggggcacggaagggagaccgcgtgcttatcatgggcrgctggaagggagtgggagaaacgggggcagggagaagacagggcagatgtcctggagacagaaggcaatggggacccatagctcctcctgacacatcagcctggctttcctctggggcccatcctctccccgacccactcccagagggtcagaggacagacgccagccctggagccacagcagtcctgtgacgaggcctggccagccgaagtcctgctccgctgtcctggccatagtgatttgcctgaagcatgtgacccaacctgagccagtgagaactcaccactgggctctcccaga

SEQ ID NO: 91662 - DNA, 601 bp, Human
gggttcacgacatggaacagctgtgctaactaccaggacagaagacaggaaggtttgctggaagaggggtgatgagaagttggccaggcctatggggttcccagcattcaggcaaaagcccagaggtcctcagggaccccccactgtctgctctgctaatgcaaagcccatgaggcccaaggagtctcagcttcttcagccacccgatcacaccccgacacacactaggccctggttccttcaagtccttaggtcattttcagattcaacttcagccaagacaaatggtcccctcctgcamctgccacaggcactgtttccaacgtgggcagagttgacagttgatgggtgtgtgtgatctttcggagctcctgtcccaggcccacaggatgaacgggaaggtggacatggtgggtagagcaagcaggaaatgatgatggtcaggaggggccttgaatgctggttctgggggcctgtgctttaccctcaaagtggaggagccatggggagcatttcgggtggggcacggaagggagaccgcgtgcttatcatgggcagctggaagggagtgggagaaacgggggcagggagaagacagggc

SEQ ID NO: 91663 - DNA, 601 bp, Human
taatgaagctctgatgcatgctgcaacctagatgaaccttgaaaacattatgctgagtgaaagaagccagacacaaagggcaaatattgtgtgattcatttatactaatgaaatgcccagaacaggcaaatctatacaggcagaaggtaggtcagtggttgcctaggcctgggaggacggggtaattgggggttactaaagggtctggggtttcttttcagagtcttgaacatgatctaaaattgtggtgatggttgcaccattctgtgaacatactaaagccattcattgaattttacgytataagttggtaaaatacatagtatgtgaattatgtctcaataacattattatcaaaaatgtgtaaggtataataatgattaaaaattttaaaagcatgtgtatgttgatagctttatttttctctttttttttttttttgagacagagtctcactctatagccccaactggagtgcagtggtgcgatctcagctcactgcaacctccacctccagggttcaaacaattctcgtgcctcagcctcctgaatagttggaactacagatgcccgccaccacgcccggctagttccttgtatt

SEQ ID NO: 91664 - DNA, 601 bp, Human
ctaaggacagagagaatacttcggggaggagaaagaagcagacaccaggcttcgtggcaggtgtcagcatggctgagggcaggcagaacagccgccagcttgatctggacacctggtcctgccacaggccacagcacttgccaggggccgttgggtcctgtcactgccctgtgggagctccctggagagttcttaacctgggctccataaactgggaaaagagaacacttcaacttcatctttactaactgggaactgaaagctgccattcccttcaactctggagagaggcagcaacccsagacttaacagcacctgcgcccatcagggcagaaatcacaggcttcggcaactgtcagcaccgctgctgcagaccagaccaaatggtgtttacactcagcacaacttaaattatagaggctgtaagatgcactcctaggtcttattatttaatgcatcaattaaaagcacacaaaaaagttttacatgaatgttcctggcagcattattcacaagagctaaagggtggaaacaacccaatccatcaacccatgagtggatttaaaaaactgtggtacatccatgcaatggaatcatatct

SEQ ID NO: 91665 - DNA, 601 bp, Human
tagttctagatatttttctttttgcagattaaccaataagtttttttttcttttttctgaagccacttttacttggatttccaacacttgaggaataacacctgactaatacactctctcttctatagcttcaaactctccatctcccggatcctcatcctcggtccctgagcaaactcaagccacctaaaatcctctgtgctcgaggcagggccacacacacatctacacaagcgcacacgtaaacactgcactcacatctaagactgcacaccctccgcagctgatgtctgccccaccrcagcatgtgtgccatgcgcaccagcttccctccactcccttgcctctcactggcccctcacctggtcagtctagcttccaccaactccccagcgaccctgcaaagccccctcttggctgctgggcctgatgccccctgccatcccaattccctgaaccccctcctcttgaacctctctcatcctttagcaggtgggcagccccgctcctaagaccccactgcctcctccacttgtctgcacatggtggggggccaaggagcacttccttccccttctgcctccctcttcctttggtgccc

SEQ ID NO: 91666 - DNA, 601 bp, Human
ttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcctggctaatttttttttttttttttgtatttttagtagagacgaggtttcaccattttagccaggatggtctcaatctcctgaccttgtgatccgtccacctcagcctcccaaagtgctgggattacaggcatgagccactgttyctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatgaggacttgccacaaggtattccatgaagttaaatccaggaactattgctggaattgttggaaaggaaaagctgtttcccccgggttgttgccctgtgaggaggtaatgcagcagctgcctgcatccatttttctgcctcagagaa

SEQ ID NO: 91667 - DNA, 601 bp, Human
tctctcctgctgtgctcctgggcagcagctccctcctccagccttccaggtctcccaatcctggccccagccacttccttgggaaccctaagcctgcctggagtccaccctcctccatttttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcctggctaatttttttttttttttttgtatttttagtagagacgaggtttcaccattttagccaggatggtctcaatctcctgaccttgtgatccgtccacctcagcctcccaaagtgctgggattacaggcatgagccactgttcctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatgaggacttgccacaaggtattccatg

SEQ ID NO: 91668 - DNA, 601 bp, Human
ctccatgtctgcctcgtgtccttctctctcctgctgtgctcctgggcagcagctccctcctccagccttccaggtctcccaatcctggccccagccacttccttgggaaccctaagcctgcctggagtccaccctcctccatttttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcstggctaatttttttttttttttttgtatttttagtagagacgaggtttcaccattttagccaggatggtctcaatctcctgaccttgtgatccgtccacctcagcctcccaaagtgctgggattacaggcatgagccactgttcctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatga

SEQ ID NO: 91669 - DNA, 601 bp, Human
acagctccttctcagaccagggcaggtggggcaatgccaaggccccctcggctcaggatggagctgagcctccccaggatgactcccctgggggaaacactgatgtcgctgtttgagcgttgagacgttggggcctggcctctgagaggcggggccccgaagggtcttccaggaaggtcagaccccagcccaaaagcagcaggcctgggccacaaagagagctggtccctgggccagaaagccctcttccaccatgcactctgggcaaggggcgtgtgtgccattaggaacacagctgcaygctatttctctcctgtcttcctccagctgaagatttcacacagccctgttatgactgagggttcccaacagctattccctcaacacacaggcccccacacacatgcatgtgcactcatgcactcccacatgcagcatgcatgcacccacatacaaatgtccatacgcatcacatgcaccacgtgtgcactcacacgcaggcgtcacacaggcaccatgcagacgcatgcacacacacatcactcatatgtgcatctcctgtgacacatgcatcacatacacatgtccacacatgtgcact

SEQ ID NO: 91670 - DNA, 601 bp, Human
ggacacatgccccacacaaacgcccccacatgtgcatcgcatacatcacccacacacacacgtgtacatttcagcacgcgtctaggggaggttagcgtgccagcaccagctgagactccctggccagactcatcgccagttggggagagtggagcagacgtacaggatggagggtagaggtggggctggtccacagtgagggagggaggcaggtgtagactgggccagggaaaggttctggaaacccagactgaaggttccctggggtccctggggctcatccagggctggggtggagccrggacatgaggaacgggcagtgatgaatctgaagccctgctggtcagcagagcctccacctgcacgtcctccccaaaggtcaggcaggcttcaccctggccacgtctctaccctggccattagcaaagaggccccccttggaccaggaggaacacagcaggccagccctcctgcccttcccatccaaggctccagccactctcatggagactctgagctgagacactcccagcagaaagggtcatttatctcagagcttaactagccccttccaattagtgaggaataaaatggcagcatt

SEQ ID NO: 91671 - DNA, 601 bp, Human
acttctataagcacggacccagaggccatcccagcgacactgtgtggggactcctgcacctcttcctgctgcccagaccatgggtggccagcagcactgcagtgttggtgtaatctatgtcccccggatggccagcgggcacagagcatatgtgtgctgagggacacatgccccacacaaacgcccccacatgtgcatcgcatacatcacccacacacacacgtgtacatttcagcacgcgtctaggggaggttagcgtgccagcaccagctgagactccctggccagactcatcgccagytggggagagtggagcagacgtacaggatggagggtagaggtggggctggtccacagtgagggagggaggcaggtgtagactgggccagggaaaggttctggaaacccagactgaaggttccctggggtccctggggctcatccagggctggggtggagccgggacatgaggaacgggcagtgatgaatctgaagccctgctggtcagcagagcctccacctgcacgtcctccccaaaggtcaggcaggcttcaccctggccacgtctctaccctggccattagcaaagaggccccccttg

SEQ ID NO: 91672 - DNA, 601 bp, Human
gtcaaggttgcagggagctacgattgcaccactgccttctagcccgggagagagcaagaccctgtctcaaaaaaaggaaatatatttaattttttaaaaagaatacacagtggtgagaaaggatggaaagaagagaggaaaggaaggaaaggatagggaaagaacaaaagaaggaaagaaagaaattccagctaattctcagcaacagacaattacaggaacacaaggacaaagcccagagccccaaccccacgtggcctgggtccccacagcctccagccctcctgtcactctgccagcyggcagcagggccacctctgagcatccttttcctcagcactttggcgtctttcctcccagtggtttcttggtagttcctcataaatccatgcgtaggtctggctacagctatccttgtccctgaagatggactcagctagcagagtcgctgatatggtaacacaatatcacacatctcatccaagcctgctcggacgctgcccttctgaccccgattcctgtcaccaacacaacaggaaaggagcttgaagacccaggaggccacagcacagttcctcgtggagggagagagatgcgagca

SEQ ID NO: 91673 - DNA, 601 bp, Human
gggaagccatctctggggactttcctcccatctcccttgtcccgctcacgaggagaagccagagctagaagctggcatgagccctcctagcaccaccagccacagtctccacctccggggacacgagctgggatctgagtggcgcaggtactatgttctagagaggccgtacccaggaccgcccatggcacgcagaggaaaactgaaacaacgatccttccagagacaaagcacagccccagatggccacaggaactggccgcccccaggagctgctgagcacaaacgccactggagagarggcttggtggctgcaccgaagagcagaacagaggaactgaacagccacagccaccgcagaactgggggatctggacagagctctcgctgtgtgctaagaaaggagcaagagacagagggcagggagaaaagctgcgagacgtgggcaagtcccagaagagagtcggggaggtgagagaaggaatatttcaaaaaacaaaattacatgaaagattccagcatggatgggttcctagaggccttatcaatacatatataagaaaaagctccatagctagacccacgataatgaaacctaaga

SEQ ID NO: 91674 - DNA, 601 bp, Human
ccacacccctgcctatgcccagacctccagcttcaggctctgcatccacacggaggcttcggattgggcgcagcctgggagcacacagaccggccagggccagggccaggactggcatttcccgggctcctggtcccatcctgcccctcccaccgggtcggccctgtccttgtcttgctcagctcgggggaagcacctctcgccagccatctggggcttggctgggcctcagcctcctggctgccacgtctcactgggagctgggcggccgccagctctgagctaagtgagcgcagaggaragtgcagggagcggcaaggccaggctcctccccaccccgtggcgtggcgtggcgtggccggaatactcagttttccctgctttttgagacaagagtagtaaatgcaccgtgctgtactcagagcccaggaagcagccctcccacccacagcgctcctgcctctgcagccccccgggccgtgtctctctctcacgggcccacatcctcactggactgtctcccttttacagatgaggtgagacagcatgcagaggcccatgtgcttgtcccacagggtgacgggccagaattacaagcccc

SEQ ID NO: 91675 - DNA, 601 bp, Human
agaggagggcctggccggagcaggggtgtcagcagaggggacgcacacgcattcacactcgtgcacacacacactcacaccgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcrggctctgcatccacacggaggcttcggattgggcgcagcctgggagcacacagaccggccagggccagggccaggactggcatttcccgggctcctggtcccatcctgcccctcccaccgggtcggccctgtccttgtcttgctcagctcgggggaagcacctctcgccagccatctggggcttggctgggcctcagcctcctggctgccacgtctcactgggagctgggcggccgccagctctgagctaagtgagcgcagaggagagtgcagggagcggcaaggccaggctcctcccca

SEQ ID NO: 91676 - DNA, 601 bp, Human
tcctcaggagtggcctgtgaagaggggacgcacacgcattcacactcatgcacacacacacaccgagacagaggagggcctggccagagcaggggtgtcagcagaggggacgcacacgcattcacactcatgcacacacacatcacaccgagacagaggagggcctggccagagcaggggtgtcagcagaggggacgcacacgcattcacactcatgcacacacacactcacaccgagacagaggagggcctggccggagcaggggtgtcagcagaggggacgcacacgcattcacactcrtgcacacacacactcacaccgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcaggctctgcatccacacggaggcttcggattgggcgcagcctgggagcacacagaccggcc

SEQ ID NO: 91677 - DNA, 601 bp, Human
taccggggctccctcctcaggagtggcctgtgaagaggggacgcacacgcattcacactcatgcacacacacacaccgagacagaggagggcctggccagagcaggggtgtcagcagaggggacgcacacgcattcacactcatgcacacacacatcacaccgagacagaggagggcctggccagagcaggggtgtcagcagaggggacgcacacgcattcacactcatgcacacacacactcacaccgagacagaggagggcctggccggagcaggggtgtcagcagaggggacgcacaygcattcacactcgtgcacacacacactcacaccgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcaggctctgcatccacacggaggcttcggattgggcgcagcctgggagc

SEQ ID NO: 91678 - DNA, 601 bp, Human
tccgggtgggcccagggatagacagaatgtttatattccccccaaattccgatgttgaaagctactcccccaaggtgatatattaggaagtggggcctttgggaggtgattatgtcaccagattccatccacacgaatgggatttgtgccccgatcagagggaccccagagagctccctcaccctttcagcatgtgaggatgcaacaagatgccttcttgaaccagggagcagaccctcaccacaaccatatgcacagcttccagaaccgtgagaaataagcttccgatgcttttaagccrctccgtttatggtatttggctatagcagcctgcatggactaagacaggccctaaatgcaatcacacttctctttatcagaggaaggcagagcaagatgagccaggcagaggagaaggccacgtacaggcagagcagagggagatggaggatgtcggccctgaagcccagagcgaagaggccacaagccaagcactgctggctgccacgaggacctggaagagcccaggacgcatcctcccctagaggctccggagggagcgcggccctgccgccacctgcgttttgccctgttgaaactg

SEQ ID NO: 91679 - DNA, 601 bp, Human
ccttgatatctggtcaggctcgtcctccccatcacccctctggtgatgtctggtcaccccagcctgtcttcagctagaatcatgttaggtgagtttagctagaatccccgacccctgatgttgctcttagtaattccccatcccctggcccctaccctgctccttggctatcaccccccactcgcccgtgctgtattcggagttgagcccagtctctctccccgactgcaagagcccactctagcggttcctgtgtctatctccatggtcctgaataaagtccgccttaccgcgctttaayaagtatcattgaatcatttttcatttaacaacactctgccttgctgaagggaaggtagaaatgacagcagtggggaggagggagaaggggcatgggaaccctgtgccgctaagggcatactctagaccctctgccccaggctaatgttagaagctgcagaggtgcaaatataacagtcagacgaccatggcagtggtcagctgaaaaatggcccccgaagacacgtccgggtcccaatccctggaacccataaatgttaccttccatggcaaaaaagaactttgtagatgcggtgagtcc

SEQ ID NO: 91680 - DNA, 601 bp, Human
caggaaaccatttttccagacagcattatataaggggaggatgcgtatgttcagcagatgttcactctgaggccgagcctcccccgccctctgaacaggaaggccacgtccccatccctctcccccagggcctggcgctcctggcccaggtggagctggcctctggctggccacttctctggaagggcctcgtccagctctgtcctgtgcagggtcatgcccctccactctgctctctctagcccatgggcaggcgccgcctggctcagaggcacagcaatgggccagggtcagacagtgktgagcagcatgccaagaatcacagggacatccacctgccagcaaagcctcaatgacaacaaaggacctgaacagtggacactgacagggactctcctgcttgaccaaactttagtccagctcctgaaccttctccttcgcccacttccttgtaagatccagtttatcaagaactctgctaagtcacgaatgccccatctctccatatctgatcacccttgatatctggtcaggctcgtcctccccatcacccctctggtgatgtctggtcaccccagcctgtcttcagctagaatcatgt

SEQ ID NO: 91681 - DNA, 601 bp, Human
gctcccctggtcattaaatatctcaggatttccaggaacaaggagaggttcaagtccacagaagaatctgattggcgtctctgggccacccaccggtgctagaatcccggctggggtgagggatggtggtgcagagcctggctatgcaaaatgtggcctggagcagcctgggggcccccgggagcttgttagagatgctgaatccaggccccatccagaccagctgaactaaaacctgcattttggcaagttcccaggtggtctgatgacattgaagtctgggacacactgctctagaccytcccagggtccctcaaaggtgggtgtagaggccctactgccctgccctggggacgcagaggcatcagggccttagtcctcctggggacagtgaaagggccaccaccccagaccatggccaaactgcaggggtcagggaggcatggcccaggacagcagctcagcagggtgcccaaccccacctgcccctgcctgccccaacccacttgccggctgggtcctctggacctccgcccctttccaccccaggttggagccaaagaccaccctctccactccccagccccccaccccccaaccc

SEQ ID NO: 91682 - DNA, 601 bp, Human
ggacggccctcctcccccaccaggctgcagctcccagcgggcagggatctaggcatgccttgctcataccacaaggcagaaacacagtgaagaaagacagagaactggtcttgttgtctttgggggctcagccccccagctccaagctggaggatcaggaggcatctacaagcctttccgaagcccccccataggctgccttgcagggtacagtatggcctagagagccccagagggctcccctggtcattaaatatctcaggatttccaggaacaaggagaggttcaagtccacagaagwatctgattggcgtctctgggccacccaccggtgctagaatcccggctggggtgagggatggtggtgcagagcctggctatgcaaaatgtggcctggagcagcctgggggcccccgggagcttgttagagatgctgaatccaggccccatccagaccagctgaactaaaacctgcattttggcaagttcccaggtggtctgatgacattgaagtctgggacacactgctctagaccctcccagggtccctcaaaggtgggtgtagaggccctactgccctgccctggggacgcagaggcat

SEQ ID NO: 91683 - DNA, 601 bp, Human
agagctggagaaaggccacctcttcgggacccaggtcacaggatgtccccccaaagccatcccagtcagatgtctgcagacacctgctcccctggcaacagtgacccagacctgaccttcaactctaactgtgcacagcttcctagcccggcccccaagcctgaagcctggtccctccagacactgcagaaagctggggctgactgtaatcccagcactttgggaggccaaggtggggcgggtcacgaggtcaggaaatagagaccatcgtggctaacatggtgaaaccctgtctgtactraaaatacaaaaaaaatagccacgcatggtggcacgcaccggtaaccccagctactcaggaggctaaggcaggagaatcgcttgaacctgggaggcggagttgcagtgagccgagatcatgccattgtactccagcctgggcaacacagcaagactcagtctccaaaaaaaaaaaaaaaaaaaaaaaaaaaggctctggccctgccacttgaccgggtgggtcacctctccgtgcctcagtttcttctatttaaaatgcataggggaggagctctgagggcaaaacaccctgggtttgcct

SEQ ID NO: 91684 - DNA, 601 bp, Human
tgccagctggaaaggtcacgcacgccagctggaaggggagccgcgcagcccctgggcaggctgaggacaggaacgggcagccgccactgttcacgagcaagggtgcaggggcaccagagcccacaggagctcctgcaatgcgatgaccatgcctgcaggcccccataatagacagcctcattttttttttctaggcaaaactttgggaggatcctttttaattgtatttgcaaaacagtttctcccaacatgatgcccatgtgtatgtggattgggggaaattcccaaggcctctcagagragtgcctccttcctaaggtggtgtcccagcagatgaatctggctggcgtcctgagtggaagcagggcgcgggctgccatggaaccccaccctcctgcaggttcctggcccctctgcctcctcttccttcccaccccaggggccctgggatgcagctaggccagctgggagccagacagccactgaagccctcggggtactgttccctgcctttagcatccccctcagctgcccattcattcagccattcttctaggaggacaggccaggccatggtgaggccctgggtccagggaaagat

SEQ ID NO: 91685 - DNA, 601 bp, Human
tccctgtggtgcagagtgggccaagtttgccgccttctggagcgacaacaaggagaaaacaggggtttaagtggaggatccggtgctctgatttctccccagttagtaaagcattcaggctgctcggtggaggtgggaagacaggcgctgagagttgtctgacacaattgtcttagcagcaggagacgctgatgggatgtcgggagtcaccaggaccatctgacaaatgaccgccttggggatccgtggagctcagcggtgcccagagagagcactcgaaatgccagctggaaaggtcacrcacgccagctggaaggggagccgcgcagcccctgggcaggctgaggacaggaacgggcagccgccactgttcacgagcaagggtgcaggggcaccagagcccacaggagctcctgcaatgcgatgaccatgcctgcaggcccccataatagacagcctcattttttttttctaggcaaaactttgggaggatcctttttaattgtatttgcaaaacagtttctcccaacatgatgcccatgtgtatgtggattgggggaaattcccaaggcctctcagagaagtgcctccttcctaaggt

SEQ ID NO: 91686 - DNA, 601 bp, Human
ccttcttccagaagtccaggtcctagctccgatgcctcctcacaaggaccttggtgaagggtgtcccttctccatcacactccacactgccatcctgtcctatttttttgtaacaccatttcccaatcatcgacacgtgggttctttattgggtcactctctgccccctgaccagggatcttacgagagcaaagttgtccttgctgggtccacgtcaccagaccagtgcctggcatctcacaggcatggagttgagtacgggaggtcgccggccctcccgaggctcccttcccctacttcrggatggtgtaaggtttccttgccaaggtccctgtggtgcagagtgggccaagtttgccgccttctggagcgacaacaaggagaaaacaggggtttaagtggaggatccggtgctctgatttctccccagttagtaaagcattcaggctgctcggtggaggtgggaagacaggcgctgagagttgtctgacacaattgtcttagcagcaggagacgctgatgggatgtcgggagtcaccaggaccatctgacaaatgaccgccttggggatccgtggagctcagcggtgcccagagagagc

SEQ ID NO: 91687 - DNA, 601 bp, Human
tagtttaaaatcctgcaaaaaagaaatttccaggtctagacggttttactggaaaattctactaacctctcaggaaaaaatggcaccaattctcccattcattttatgaggtcaacattaccctgatattaaaaccagacaaagacagttcaataaaaaaaaaaaccctacaaaccaatatccctcatgaacctataaaccaatatccctcaatgaacatagacacaaaaatcctcagcaaaacactggcaagtctagtccagccatgtataaacagcagagtgcacaacagacaagtcaygtttgtcctggatttgcagagtctggcacaatatccaaaagtcagtgtaacccagcatattaacagactgaagaaggaaaaaaaatatgcttatatcaagtgatagagaaaaccatatgatatgattcattcatgactaaaaattaaaaactctcaactaacagagaaagaaacgtgctcaacctggtaagaatatctacaaaaaaactaaagctaacacaataccgcatcctgagaaactgttttcccctaaaataaggagcattttcacgactcctactcaaccttgggttgagtcct

SEQ ID NO: 91688 - DNA, 601 bp, Human
ctaccctaagatggttgctgaaggaagttcttcagacagggggaaaatgatgctagaaagaaattttgaacatcaggaataaaggaagagcaacagaaatacctgaaaaaatataacagattaggctcttgcgtattttaaagaggaatgataatgctgtctgatgtagttttccatgtatgtaggtgtataaaagacaacaacattcaggggaggacagagggacctatatgatggcagggtctcaacattcaacttgaagtggtaaaatattgatttgaaaaagactctgaagagttayataggtttattataatccctggagcaaccagtaaacactatacaaagatatacaaccaaacacaataggtaaattaaaattgaataccaaaacatgctcaaatagaaaaagcaaaataagcccaaagcaagtagaagggaggaaatgataagagtaaaaatcaatgaaactgaaaatatgaaaataatagagaagatcaatgaaaccaaatttggttctttgtaaagatcagtcaactgataaatctctagtgagactgaagaagagaaacagaaaaaaatatgaattaccagtatcaga

SEQ ID NO: 91689 - DNA, 601 bp, Human
aacagataacaagactgagatagcacatatgttggaattaactgacaatgatcttaaagcagctattataaaaatactccataaagtaagggcaaaaactctggcaactaatggaaagatagtctcagcaagaaacggaagacatatttttaaaaaggaccaaacggaaattttagaactgaaaaatacaataacagaaactttaagaactcactggataggctcaagagcagaatggatatgacagaggaatgagtcagtgaacttgaggatagagcaatagaagttacccaattcaaaytgcagcgagtaaaaatattttataatgccaagagccttagagactgtgggaaaataccgaaagatctaactaacagtcatgtcccagaaggagaagagaaagaatgtattactaaacaaatatttggataaataatggctgaaaacttctcaaattctgtgaaatgcataaacctaccaattcaacagatcggcaaacctcaaatgagagaaatccaaggaaacacaatcccacacgttataaacacactctgaaaactatagacaaaaaaaagtcttgaaagcagtcaaagaaaaacag

SEQ ID NO: 91690 - DNA, 601 bp, Human
tgcatcccccactgcctgcagccacccaaatgcactggattcatgagcagctagctgaggaccctgcaaaataaataacagcatgcagattggggaagaagactagaatgtgaggttcagcaaacccgcagagtttactcttcattctctggtattcctcagcctagatacaaggcaggtcaaactccagaagcgggcactgggtacagacagacagagctcgagacaagccctgttgttgtagctcaaggatagaaaaagcatttccgaatgctcagagccaagccaacacctcattttwctttcctatttcctttttcttttcttcgtgttctcacacgccagctcatggcagcccacaggcacctaaaactctaagaggggagcctggctgtgtagctggaagtgctgtggtcctagaaaggtggagtgaaaccccattgctctttcctcttttggtcctcccaggagtgtagttgcaggaagtgtgcaagacagcagggtcaataaagccccagctttctggccagagagatttaacaaggagccgcaggaaactggacagggctaggaagatggcagagacagcagagcttgggga

SEQ ID NO: 91691 - DNA, 601 bp, Human
tataaaggaggccctggtttaagaagaatgatgtgcacactcaaaagtgcactttaaggccaagctccgaataaacacgatgatattattttatttaagagtcttcatacatacaacttaattcagtaacagtctgagaaacgcaagccagcagacagataaaccgttatggctctggctctggcaaaaactcttcatctacgcggagccagaagaaagccaattaaaagtcggagaggtcccgcaggacagaggccggaggatgtccccacacactgagcacaagccccaaacacaggcytccccagtctggagccggcggccagccccctcctggcctcagtgaagcctggactcctcactctgtccaagtgggaggaactggtcccagctgcaagaaccgcctactgtgatctgggcaaaggttctggaggctctgctcgctcctgtcccccaggaaaaaaaaaaaaaaaaagacagcagagggcattgctcaggggcccagcctggctgtcatccctgaacatcctgggctgaaggaaagaattgagcccagccgaaacttgagatctttagacttaaatccccactctgtcacttg

SEQ ID NO: 91692 - DNA, 601 bp, Human
tgtaatcccagcactttgggaggccaaggtgggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacacacacacacctttattatctgacagttctagagatctgaagtccacaatgggtctcactgggctaaaatcaaggtgtggggagggctgcattccttctggaagctctaaggagaatgtttccttgtttttttccagcttttagaggctacccacattccttggcttgtggccccctcctccatcttcaaagccagcaccggagcatctactgacccctctctgactctgaacttctgcctccatcttctacttttatgaatccttgtcatggccagctcacacctgtaatcccagcactttgggaggctg

SEQ ID NO: 91693 - DNA, 601 bp, Human
caaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgcggtggctcacgcctgtaatcccagcactttgggaggccaaggtgggtgaatcacgaggtcaggagatsgagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacacacacacacatttattatctgacagttctagagatctgaagtccacaatgggtctcactgggct

SEQ ID NO: 91694 - DNA, 601 bp, Human
aaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgcggtggctcacgcctgtaatcccagcactttgggaggccaaggygggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacacacacacacatttattatctgacagttctagagatctga

SEQ ID NO: 91695 - DNA, 601 bp, Human
tgacagtgagaattcagcacatcagaacctgtggatgagaccaaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgckgtggctcacgcctgtaatcccagcactttgggaggccaaggtgggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacac

SEQ ID NO: 91696 - DNA, 601 bp, Human
atgacagtgagaattcagcacatcagaacctgtggatgagaccaaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgyggtggctcacgcctgtaatcccagcactttgggaggccaaggtgggtgaatcacgaggtcaggagatggagaccatcctggccaacacggtgaaaccccatctctactaaaaatacaaaaaattagccaggcgtggtggcgggcacctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacaca

SEQ ID NO: 91697 - DNA, 601 bp, Human
gtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaatttctgttgtttctaaacacccagtctgtgatattttgttatggcagcctgaacggagggacacctgcagascctgggatgctcagaatacacacgtggcaggaggggtgtggacgggctctacggaactgggagatgcctagaaatgctagaggggttgagggggaggcattcacaagcccttgtaggaaactgagatctgcgctggttaggggtggggtgtcactggaatggcaagatgcagatataaatgctgacaagacccaatttaaacccagagatgctaaggtctgaaaacatttggattatactaggaatcaacgcaaagcttaataacctaaaatccaaccactcggaagttttttcaacatt

SEQ ID NO: 91698 - DNA, 601 bp, Human
cttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaayttctgttgtttctaaacacccagtctgtgatattttgttatggcagcctgaacggagggacacctgcagagcctgggatgctcagaatacacacgtggcaggaggggtgtggacgggctctacggaactgggagatgcctagaaatgctagaggggttgagggggaggcattcacaagcccttgtaggaaactgagatctgcgctggttaggggtggggtgtcactggaatggcaagatgcagatataaatgctgacaagacccaatttaaacccagagatgctaaggtctgaaaacatt

SEQ ID NO: 91699 - DNA, 601 bp, Human
accagaggccagggtcccctcgtgccacagtgaccctgcaacgcagattccgtgctcccttcagaagcccacctgacattcatagaagctgagcaaacaccaggagacagaggcaatttcagaaattccccgaggctcggggaacccaggctgtccccttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgmccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaatttctgttgtttctaaacacccagtctgtgatattttgttatggcagcctgaacggagggacacctgcagagcctgggatgctcagaatacacacgtggcaggaggggtgtggacgggctctacggaactgggagatgcctaga

SEQ ID NO: 91700 - DNA, 601 bp, Human
tggcctctgctgctccctcccacgcaccaatgcccatggcctctgtccctcctccccagggccccggggacctccacaccctcctgctcagcctctctctggccgcccccagctgctccggtttccacagcaccagaggccagggtcccctcgtgccacagtgaccctgcaacgcagattccgtgctcccttcagaagcccacctgacattcatagaagctgagcaaacaccaggagacagaggcaatttcagaaattccccgaggctcggggaacccaggctgtccccttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaatttctgttgtttc

SEQ ID NO: 91701 - DNA, 601 bp, Human
cagccagaaggccctccccacagcctgcccctttctcttgactgttcccttccccaatacgctgaggccccatgtctcccaggaccctccctcaagaccccggcttccctctccagggtgacttgggcccttgcatcatggggcataatgccaactccccacccctactgatgaagtcactggcagagtgcccccaacgccctccactataatcccagaggacggagagctcttgctctgagccgagacaacccactgcccaccaccagctccctcagggctctccacaagtcccttctcscctcccctgctgcgtcttcggcctcctcctctctaaagtcctctctcagcccaacaacagaaccgggtctcttcaatcctgaacaagaagactctgcttcccctccagccacaggacctcccttccctcacagcccttctcagcaggctggcctctgctgctccctcccacgcaccaatgcccatggcctctgtccctcctccccagggccccggggacctccacaccctcctgctcagcctctctctggccgcccccagctgctccggtttccacagcaccagaggccagggtcccctc

SEQ ID NO: 91702 - DNA, 601 bp, Human
ccttgagcaccctactggaggctgctgggtttgtctgtcatcctcagagcctgagagcatctggcaccaggcctggctgaataaatagattctggattagaaaggaaacctggctttgaaaagacacagagaagaaccaggtccctgcgtcccttccttccaggctgatgttctgggctggcgggtctctgttgggctccccaccccttcaccttctgccctgtcctacagcccagtaggcagacctgatggactggctcctcctggctctccctgggtgaaggggggcaccgacaggaarccagggctggggagagagacagaaggttttatttctcccgctgtggtggcccccagcctccccgccctgcaagctccctcgtcctgcccgcagctctgtgagttgtgcctttgtcaactcctttctgttgatcccttatgtgtcccaggcccctgactgatccgacatgccctgtagcccgaccaggcagccctcactctcatagtccaggtgctggtcccatctctagggtttgggatgggacttccacactccagcccaatttccaccctgaagcacacgggtgagccagttccctgc

SEQ ID NO: 91703 - DNA, 601 bp, Human
agagagaagcccattgtaagcagggccaatccaagctcccaccccaccctggagtgcagaccactgcccagacggcttcctgaggtcctggctggggccctccaaggtaccccatttccaggcctccagccccagccccccaatagcctgccttgaattgtcttctgcttaagtgagttgaggtcagttttgccatccaaagagaagccctcctgttttcctagaggttgtcaggagctacgctggccggtcccctgggcttgggacatcctctgttgttggggggagagggtgggaagcrtctttcctgcagccatgacctcaccttggtgacagccacagcttctcactcacagcactggtgtaagtgctaacctgaagccgctcctccttgtccacggggaagacagtctgaccccactttcctctgctccccgaaaataaggaacgttattggtgttgctttgtcctgacagactcacacgtccttaaaaagtgctaatcttcacaaaagaggcagcggcctgtgccttccttgaggaaagtcagattaattagctgactcccacatgagcagcctctgattcttgcaggctttgtt

SEQ ID NO: 91704 - DNA, 601 bp, Human
aagagatagctcctgagcctgagcagtaacgagggtctctgcaagcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctagaaggactgtcaggaaggggcctgggtgggtgggagtcagctygcccaaggtgactctctctccttgcaagatacatctgagagagaagcccattgtaagcagggccaatccaagctcccaccccaccctggagtgcagaccactgcccagacggcttcctgaggtcctggctggggccctccaaggtaccccatttccaggcctccagccccagccccccaatagcctgccttgaattgtcttctgcttaagtgagttgaggtcagttttgccatccaaagagaagccctcctgttttcctagaggttgtcaggagctacgctggccggtcccctgggcttg

SEQ ID NO: 91705 - DNA, 601 bp, Human
aaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcawgcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctagaaggactgtcaggaaggggcctgggtgggtgggagtcagcttgcccaaggtgactctctctccttgcaagatacatctgagagag

SEQ ID NO: 91706 - DNA, 601 bp, Human
gaccagatgaggacgtatggctcacattttcttgcacactctgggcaagatccacattggtggtcatcattaatgaagcacggtaaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaataygaaattagctgggacagcacactcgaccataaagaacaggaagagatagctcctgagcctgagcagtaacgagggtctctgcaagcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctaga

SEQ ID NO: 91707 - DNA, 601 bp, Human
cccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcaagcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagcca

SEQ ID NO: 91708 - DNA, 601 bp, Human
gtgccacaacagctagctaattaaaagaaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccsggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcaagcactgagcagacagtgagcaaatgtgttcgtgcttc

SEQ ID NO: 91709 - DNA, 601 bp, Human
gtgtgcccaccattaaacgaggttgaattctgggagtgcagaagtaacagcctcaggactgatggggaagatgaggctgcaagatgtgtggttcttcccttcgctataaaggtccaaacgatatttatttatttatttatttatttagagacaggatcttactgtgtcacccactgcagtacagtggctcaaacacagctcactgcagcctggaccccctgggctcaagtgatcctcccaactcagcctcccaagtagctgggaccacagacgtgtgccacaacagctagctaattaaaaraaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggagtcag

SEQ ID NO: 91710 - DNA, 601 bp, Human
gggagtgtgcccaccattaaacgaggttgaattctgggagtgcagaagtaacagcctcaggactgatggggaagatgaggctgcaagatgtgtggttcttcccttcgctataaaggtccaaacgatatttatttatttatttatttatttagagacaggatcttactgtgtcacccactgcagtacagtggctcaaacacagctcactgcagcctggaccccctgggctcaagtgatcctcccaactcagcctcccaagtagctgggaccacagacgtgtgccacaacagctagctaattwaaagaaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggag

SEQ ID NO: 91711 - DNA, 601 bp, Human
agatctaaagttatttcaaaattaaaactttaaacacataaaaataaaactgggccccagcctccctcagtgctctctggccggtccattcttcacattggctgcctttccctggagtggaggcgcccactgcatccccagtgtccagggagcaggtcctgtagaaggtggtaggttccagggatcggggagcaagtacagaggccctgagaaggaagcaagcctggcgtgttccaggaacaccagggagaaccgtgtagccggagcaatgctcttgtgcagagggcctatgcctgagccrccctgtgggccctgccgttcccttcagggcactctccaaccctctgccctgtgcatggggccacggatgccccaggagctctagggctgttgactatgaggttgcttcaggtctcagtgagtggcttgatgagcgagccaccctcactggccaggaggggacttccttcacaggtgtgaatgggactgagccaccagcatgatgctgacacgtgggttttgaggattcccactcacatcagacagaatgagtgcggggctctgggatacagctgcccaagcctcaagcctgagtggcact

SEQ ID NO: 91712 - DNA, 601 bp, Human
gttataaaagcaggacactccctgggtttcccttctttgcacacatgggctttccctttgaccctctccaccacgttatgacacagcacaaaaaggcctcaccagaagccagggccatgctcttgaacttcccagcctgcagaaccatgagctaaataagcttcttttctttataaattacccagtctcaggtattccattatagcaacacaaaatagactaaaactaagacactaagtaccaacgcttagtatcaacctacaaagttcctggtttcagtccttgttctacgttgcatacrgaggaagctgggtgaagggcacagaggaaatctatgctatttttgcaacttttcttgcaatttttccaagacagcatagatctaaagttatttcaaaattaaaactttaaacacataaaaataaaactgggccccagcctccctcagtgctctctggccggtccattcttcacattggctgcctttccctggagtggaggcgcccactgcatccccagtgtccagggagcaggtcctgtagaaggtggtaggttccagggatcggggagcaagtacagaggccctgagaaggaagcaagc

SEQ ID NO: 91713 - DNA, 601 bp, Human
accagaaaaacccatggggatgcaccgtctacaaaacagctgaccagtcctcttcaaaaacatccaggtcatgaaacctcagatgggaggaaacgggagagacacaacaactaaatgccacgtgggatcctgagggggagcctgaaccagacaacggacatgagtcggaagactgacaaaattcagtgcagtctggagtgctacggttagaatgtgactggtttgttcccaccaaaactcatcttgacatttggtccccagtgtggcagtgttggaaggtggggcctggggtgaggtatcygaatcatggaggccgatccctcgtgagtggcttgatactgttctcaaggtagcaagggaattcttgctctggagaggcttgattagttcccgagcctgggttgttataaaagcaggacactccctgggtttcccttctttgcacacatgggctttccctttgaccctctccaccacgttatgacacagcacaaaaaggcctcaccagaagccagggccatgctcttgaacttcccagcctgcagaaccatgagctaaataagcttcttttctttataaattacccagtctcaggtattcc

SEQ ID NO: 91714 - DNA, 601 bp, Human
tagccaaatgaagaagggcatcactgacaataggagacaactggacatcccaatgtgacagtcccagcgtggtgccctacggagggcacagtgcttctgtgacagtcctgccagaaacacgtaagctcaagccagtacaaggcacaccagaaaaacccatggggatgcaccgtctacaaaacagctgaccagtcctcttcaaaaacatccaggtcatgaaacctcagatgggaggaaacgggagagacacaacaactaaatgccacgtgggatcctgagggggagcctgaaccagacaacsgacatgagtcggaagactgacaaaattcagtgcagtctggagtgctacggttagaatgtgactggtttgttcccaccaaaactcatcttgacatttggtccccagtgtggcagtgttggaaggtggggcctggggtgaggtatctgaatcatggaggccgatccctcgtgagtggcttgatactgttctcaaggtagcaagggaattcttgctctggagaggcttgattagttcccgagcctgggttgttataaaagcaggacactccctgggtttcccttctttgcacacatgggcttt

SEQ ID NO: 91715 - DNA, 601 bp, Human
gggcattctcacatggggacacggggcagtgagtgcaggcgcagggagacaagaatgctgcacagccggtgggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaataccctttctgtggcagctcagcccggagagcaggtccccagtctcgaggacccaggaggcagggtctgctccttcccacagcgggtgctcctccaggaggggccaggtgctcagagggaaaccagtgcccaccaagggcccagctgcctggctggctcccagcagtgtggggaagacacactacccgacggacgtcccccttagaagcaggggcagacaggaactcccatggggagagcacaggctgggacgcagcc

SEQ ID NO: 91716 - DNA, 601 bp, Human
ccaggcgccaagtccacacagaatcggagcaggctgctggcagggtccggtggccagagctgggcgggctgttccttggggagccactctggacaggccggaaggtcaatgccaggatcactccccaggggccagaaatccagcatggaggaaagctgccactccagggaagtaggagcccgcccagggctggccacatgggatgcccatctcacccttccttctaaactgggcattctcacatggggacacggggcagtgagtgcaggcgcagggagacaagaatgctgcacagccggtrggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaataccctttctgtggcagctcagcccgga

SEQ ID NO: 91717 - DNA, 601 bp, Human
cactcagcccataacagcctccaggcgccaagtccacacagaatcggagcaggctgctggcagggtccggtggccagagctgggcgggctgttccttggggagccactctggacaggccggaaggtcaatgccaggatcactccccaggggccagaaatccagcatggaggaaagctgccactccagggaagtaggagcccgcccagggctggccacatgggatgcccatctcacccttccttctaaactgggcattctcacatggggacacggggcagtgagtgcaggcgcagggagacragaatgctgcacagccggtgggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaatacccttt

SEQ ID NO: 91718 - DNA, 601 bp, Human
aatcctagcactttgggaggccgaggcaggcggatcacctgaggtcaggagtttgagaccatcctgggcaacatggtgaaaccctgtctctaccaaaatacaacaaattagcgggacatggtggtgggcgtctgtagtcccagctactcgggaggctgaggcatgagaatcgcttgagcccagaaggcggaggttgcaatgagctaagatcgcaccgctgcactccagcttgggctacagagtgagagactcttgtctcaaaaaaaaaaaaaaaaaaaaaagaccctgtcgacaggccctyccctgggctggcacctgcccacaccagctggaacctaacacctttgcacagctgttccctgccagcctccctgcctccttggaggtctgcacacaccgcccctcccttcctccaaccagcccgggagaccagcacgcctgagcaccagcactcccagagacagagccggcacggtgggtctgtctgctcagggggctggggtggcaggggcacatgtctgggagttgccaacatatgcttccttaccagattccccaggggacccaccctggagagcaaccaaaccctgcaaggctgcac

SEQ ID NO: 91719 - DNA, 601 bp, Human
gcacggtggctcacgcctataatcctagcactttgggaggccgaggcaggcggatcacctgaggtcaggagtttgagaccatcctgggcaacatggtgaaaccctgtctctaccaaaatacaacaaattagcgggacatggtggtgggcgtctgtagtcccagctactcgggaggctgaggcatgagaatcgcttgagcccagaaggcggaggttgcaatgagctaagatcgcaccgctgcactccagcttgggctacagagtgagagactcttgtctcaaaaaaaaaaaaaaaaaaaaaagaccctgtcgacaggcccttccctgggctggcacctgcccacaccagctggaacctaacacctttgcacagctgttccctgccagcctccctgcctccttggaggtctgcacacaccgcccctcccttcctccaaccagcccgggagaccagcacgcctgagcaccagcactcccagagacagagccggcacggtgggtctgtctgctcagggggctggggtggcaggggcacatgtctgggagttgccaacatatgcttccttaccagattccccaggggacccaccctggagagcaac

SEQ ID NO: 91720 - DNA, 601 bp, Human
taaaagagtttctcagattttttgaccacttaaggaacagacacacccatgacatattggtgaccgaagaaggcggcaagcccagctgcagcatgacctccttacgtaaaatcatgtatatctctgtgccaaacgtcagcacagtctaataattaagcatgtggcctccgagtcactctgcctcgattcaaatgtttacttcacctctgactgagtggcctctctgtggacagtgtctgcagggttgaatggagataataacagggtttccatggctgatgtgagggctaagcgagatacygcgtctctagcactgggcacagcacgtgataaatcagccgactggcagcaccatcaccatcatgatgatcatggcatgacagctgttaggaaacgcgtaacaaagggtcagcagtgttacgatcgggggtgagtttcactttttattaatattttctgtattttttttgttttacatttttacaaagggcatatagcaaaacagacaattcatgtgaagacaggagagacggaaagggggagagcacagagagaaagataagggggaaaatggaataaacaagatgccgacaagaatgcc

SEQ ID NO: 91721 - DNA, 601 bp, Human
gcactccattctgggcaacagagtgagactccatctcaaaaacaaacaaacaaacaaaaacagacaacaaaaacaataaatggtcagattattattattattattttggagacagtgtcttgttctgtcacccaggctggagtggagtacagtggcctgagctcagttcactgagacctctgcctcccaggttcaagcaattctcctgcctcagcctcccaagtagctgggattacaggtgcacaacaccatgcctggctaatttttgcatttttagtagagacggggtttcgccatgttrgccaggctggtctcgaactcctgacctcaggtgatccgcccacctcggcctcccaaagtgctgggattacaggtgtgaaccaccgttcccagccagtcagattatttcaataacactctatgccctgcaaaataattttacaaaatttacagatttatgctaggctaaaagagtttctcagattttttgaccacttaaggaacagacacacccatgacatattggtgaccgaagaaggcggcaagcccagctgcagcatgacctccttacgtaaaatcatgtatatctctgtgccaaacg

SEQ ID NO: 91722 - DNA, 601 bp, Human
tgtgagcaactctgggccctgggagagggtgcacagagggatggcttcaaccctgctgctagagaatgccctcgagagcgtctgtctcagttctgcttggcatccctccccagcaccccccacctgccactttacgcagcctggacttgactttaaaactgagacacctggcaagtggggaaatcacaggtcgaaatagcggaattgccctctgcatctatgctacagggataatgagggttacaaatcagaagacatttagcatatattctggaaaaaaaaagctatgtaatatataaaytattcataatttaactttaataaatgggggcaggcaaaaaattgccaaacaagcccacaacaatcagacaaagagtagaggaagaaaaaaggaattacagtttaattgcactcgtttcctaatcttcagaatcttcagttagcatcaacagttactggtaagtttctaaaatcagtagatacaagctgaagaattctactcaaaattagaaaagtcacaactagtaaaactaatgtataccttccaaatgactgaaggcagaccatatagaaaatatggtagactagaaaaacagcaaaa

SEQ ID NO: 91723 - DNA, 601 bp, Human
gtctatcaactaaccaggtgagccactgtgagcaactctgggccctgggagagggtgcacagagggatggcttcaaccctgctgctagagaatgccctcgagagcgtctgtctcagttctgcttggcatccctccccagcaccccccacctgccactttacgcagcctggacttgactttaaaactgagacacctggcaagtggggaaatcacaggtcgaaatagcggaattgccctctgcatctatgctacagggataatgagggttacaaatcagaagacatttagcatatattctggraaaaaaaagctatgtaatatataaactattcataatttaactttaataaatgggggcaggcaaaaaattgccaaacaagcccacaacaatcagacaaagagtagaggaagaaaaaaggaattacagtttaattgcactcgtttcctaatcttcagaatcttcagttagcatcaacagttactggtaagtttctaaaatcagtagatacaagctgaagaattctactcaaaattagaaaagtcacaactagtaaaactaatgtataccttccaaatgactgaaggcagaccatatagaaaa

SEQ ID NO: 91724 - DNA, 601 bp, Human
gggatttgagccactcggtcctcaccactgggggctcctttacagttcagcatcccagaggatttcacacactgacttttccacttttccaaaagggacgccagcgggcaggagctgtccatggggttaggaaacagctgtcctcacccgcatctccaccagctcctcctctgtctcatgggatcctcgccaggtgccagccactcccgtccttcctcttggagagcgaccccttgtctagggctctgtcttggagctatggctggagctgggccttccagggttctgctgagcacagtgrccacaacagagttgcctctgagctccacagaacctgatgactttgcttggccactctaaccttccctggacctggtttcaggccctacagacctttactccagaaagtctcttttttggcctaagctggccggagccaatttccaacaggaccaaggagccccgacagtcacatgcccagcgaggctctaaggaaagctagactccactttgaagggcagggtggggggcgaggcaggcagggagagtaagcactggacgctgagccaggggccctggtttccaatgcggtcatggccag

SEQ ID NO: 91725 - DNA, 601 bp, Human
cgggactttgattttcctgctgccagtgtcaagtgtatctgtttttacatgtaatttttattaattagaatcagtttcctctccccactcaataaatattaaagaaactccagaagcacactaggctgaaaagcactcagttgggagcctgctggtggcctgtctgtccaaccccacagctgtccagcctggggtcttacagaaaggttggtaccccgacctggctctaagtgtgagtcccgctctgctcttgaagtctgtggatgtctggcaaacccagccaggttctcccctgggggayagagagaggatcatggggagggctctgtccctgaccttcaggtgccaccgcaggggcccagagcctggtagtacccgggtcatcaagtcaagttgccggcattcagatcctggtgagttacacaacgcctgccctgcctcttccttctatagaacctgctcctttgcagttggattgatggtaaagtagttactagaaatggcaactagatgttaaaaatttataaagatccaaaggcttaacagctctcctctattactctgaatttttaagtattcaaccacagacagcctggaagtt

SEQ ID NO: 91726 - DNA, 601 bp, Human
ctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagcccccctcacstctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaagaaacaggagagttcacataaacgac

SEQ ID NO: 91727 - DNA, 601 bp, Human
ccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagmccccctcacgtctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaagaaacaggagagttca

SEQ ID NO: 91728 - DNA, 601 bp, Human
agctgaactgctgcccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcraggcctgattcagcccccctcacgtctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaaga

SEQ ID NO: 91729 - DNA, 601 bp, Human
ccagactctacaggcagctgaactgctgcccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagcccccctcacgtctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttg

SEQ ID NO: 91730 - DNA, 601 bp, Human
cttgaacatggaatcccagctttccttggaaacgcaggccctgaccacagcgggtcttggatggaacacatgcccctgcaactggctccagtccctactgccccccaactgtctctcctgctctctgtgtcagccaccagcccagactctacaggcagctgaactgctgcccctgaccccctaggccagccagcaccctccctgactacaaactcctcgctgggtcctcatttccgttgggactcaggctgctctatatgctggcattcaggctcttggcctgccccaccctcccagacckcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcaaggcctgattcagcccccctcacgtctcctgccctcccctgccatccagcctgccctcccctgccataccctgccctcccctgccataccctgccatccagcctgctggcaccatcaggtccacccatcccatgacaactccag

SEQ ID NO: 91731 - DNA, 601 bp, Human
ccctgagctctcggggacacaggggttgctaatgccactgggcttgcccgacagcagctagctagcaaggagcaaagctggggccctgcccccgggtctggagcactcgctcagccccttccacgctggccctcctagattactcctccttccttccctgcaaaatagtccaagggtggggataagtcgaggctgagaccacagctggaaaaggctgggcaggcagtacccagtggcccggctgtctgcagcatagcagacgctgatttgtcaccaaggaacaaggggccaccggttgcaytgattggctccagagtacattgggcttcctgatggaacaattcctttgcaaaggtatctgatgccgtttcatgaaattagaagtatgcctgccaggctgtacccaatttttctgtcaagctaggaagtcagacagacctacagtaaatgaggcggggctgctatggagtgacgggagtaccttagtaaatcacagcacgggggctggcccagcccaggcccctggagcactcgctgtgaacgtgcaggtgtgcccgatcctgggccccagactccagactctcctcacccaggggtcctg

SEQ ID NO: 91732 - DNA, 601 bp, Human
gcctcacccagcgtcttctaaggccaatggtttctgggcttattctgagattgaaattcctttcctgtgttctgaatttcaagttctcattaaagatatgtggattgggggtgggggtggagggaggattcagcagaagatgccaaacaccagcagaagcccagaaaataaggcaaggccggccaggctgtgggggaagggctgccatgttcaggaagacaagcaccatatggaatctgggatcagagacatggccaagggcacgtggccagctcacctcgcctgagcagaggcccccagraccaccctgaatcttccaggagaggccagccagaagcaccaagcccacagcacaagtgaccagcccctgagctctcggggacacaggggttgctaatgccactgggcttgcccgacagcagctagctagcaaggagcaaagctggggccctgcccccgggtctggagcactcgctcagccccttccacgctggccctcctagattactcctccttccttccctgcaaaatagtccaagggtggggataagtcgaggctgagaccacagctggaaaaggctgggcaggcagtacccagtgg

SEQ ID NO: 91733 - DNA, 601 bp, Human
cacatacacacacacccgcacccaggtcctggagttgtgtgccaggcaggctgtgcccctcactatgcctggccacaggacacagcttttatgtatctcccagttgccactctgggccctgaaaaggcccaggcagatggaaagctggacgcctgaggtcaccgtgggccctccacccagctccggcactcactgggcctggtgcccttccagtcagtgtgtcgatctcagcccagggccacgtgggaacgattaggtgcatggcgtgggagctagctcactgaaggcccgagcccctcaygcagggtctgctgacaccagacaggaacatcaagcaaaggggacttggccccagccccaagttctgggatccagacctatagccccaggcccacgctcacatccacagcctgggccccaggcctggagctaaggctggacaggctcacctcctccccgacagcccattaccaaacccccaccttccagcccagcctcacccctgacctggcagctggcctcacccagcgtcttctaaggccaatggtttctgggcttattctgagattgaaattcctttcctgtgttctgaatttcaagt

SEQ ID NO: 91734 - DNA, 601 bp, Human
cgtgggcttctcggggaaaacaggacatcctgaaaaggaggcacccctgacgctgcagggatatcctgccacccagacagatgcccaccccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatcagggttccctcagaattcactggaagaaagggtcccctatacacacacacacatacacacacacccgcacccaggtcctggagttgtgtgccaggcaggctgtgcccctcactatgcctggccacaggacacagcttttatgtatctcccagttgccactctgggccctgaaaaggcccaggcagatggaaagctggacgcctgaggtcaccgtgggccctccacccagctccggcactcactgggcctggtgcccttccagtcagtgtgtcgatctcagcccagggccacgtgggaacgattaggtgcatggcgtgggagctagctcactgaaggcccgagcccctcatgca

SEQ ID NO: 91735 - DNA, 601 bp, Human
ttcccaggccagcagcactgagcaggacccttctgccaaggccagcatggccagggaggagagaaaaggaccctccccgctccctcaccccttgcccctcctaataacatcctctcccgggtgttgcctaagctgcccagtgcacacactcatccctggcctgtctgtgaaatgctttaaaaccgtcattttctatccgtttcccccaggcaatctgcaatccagcaactgatcttggatgacagagactattagtgaaaatgattccctgaggctccatgagtccccgagatcaccctgrgcagcccgtgggcttctcggggaaaacaggacatcctgaaaaggaggcacccctgacgctgcagggatatcctgccacccagacagatgcccaccccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatcagggttccctcagaattcactggaagaaagggtcccctatacacac

SEQ ID NO: 91736 - DNA, 601 bp, Human
caaaaggccacccagcctcagagctcggcctccggtcctggccaggttcccaggccagcagcactgagcaggacccttctgccaaggccagcatggccagggaggagagaaaaggaccctccccgctccctcaccccttgcccctcctaataacatcctctcccgggtgttgcctaagctgcccagtgcacacactcatccctggcctgtctgtgaaatgctttaaaaccgtcattttctatccgtttcccccaggcaatctgcaatccagcaactgatcttggatgacagagactattaktgaaaatgattccctgaggctccatgagtccccgagatcaccctgagcagcccgtgggcttctcggggaaaacaggacatcctgaaaaggaggcacccctgacgctgcagggatatcctgccacccagacagatgcccaccccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatc

SEQ ID NO: 91737 - DNA, 601 bp, Human
tgtaatcaaggcatccttgcaagagggaagcacagggacacgtcagaagaggagggggcgacatgacccgggggcagagattggcatgatgcagccacaagccaagggaggctggcagcccccaggagcggggatgggccagaaacagattctcccctggagcctctggagggagcacagccctgtccacccttgatcttggctcagtgagattcatttcagacttctggcccacagagctgtgagagaggcatttgtattagtccgttttcacaatgctgataaagacatacccgagackgggcaacttacaaaagaaagaggtttattggacttacagttccacatggctggggaggcctcacaatcatggcagaagatgaaaggcacgtctcacatggcagcagccgagagagagagagcttgtgcagggcaactcccgtttttaaaaccctcagatctcgtgagacccactcaccatcatgagaacagcatgggaaagacccacccccatgattcaatcatctctcactgggtccctcccataacacatgggaattatgggagctacaagatgagattcaggtggagacacagagac

SEQ ID NO: 91738 - DNA, 601 bp, Human
gacaggccctcagtgtcagcacagggttggcttctctgtgcacgtggtcttggagtcagccgctccaggtcccttaacgcgggcggtgggggaggactgccaggctgagactggcacttagacatgcagggaagagctcccacacgacagggtggagggtccagtgagggaggcagcaggaccagggcctgcctgggctgtgcctctgggctatatgccctggggaggcctaagtgaagcctacagtgctgctcctccgcgtgacccagacgggcgcctcccgggtgtgctgtgcactgcrtggccagccttgtacgtgagggccattcacatcctgtagctggctgcatggtgcccccaaagatgctggatcctgatccctgcaacctgagacgggtaccttctatgggaagaaagggctttgcagatgtgcttgcagtaaggctcttgagatgagaagcctgtcctggattactcgggtgagtcctaaatgtaatcaaggcatccttgcaagagggaagcacagggacacgtcagaagaggagggggcgacatgacccgggggcagagattggcatgatgcagccacaagccaagggag

SEQ ID NO: 91739 - DNA, 601 bp, Human
acgtgactcggggtctttctcactgtgtggcaaccttcacagagtcccaaggtcagtctctgggaagctaagacaggccctcagtgtcagcacagggttggcttctctgtgcacgtggtcttggagtcagccgctccaggtcccttaacgcgggcggtgggggaggactgccaggctgagactggcacttagacatgcagggaagagctcccacacgacagggtggagggtccagtgagggaggcagcaggaccagggcctgcctgggctgtgcctctgggctatatgccctggggaggcstaagtgaagcctacagtgctgctcctccgcgtgacccagacgggcgcctcccgggtgtgctgtgcactgcatggccagccttgtacgtgagggccattcacatcctgtagctggctgcatggtgcccccaaagatgctggatcctgatccctgcaacctgagacgggtaccttctatgggaagaaagggctttgcagatgtgcttgcagtaaggctcttgagatgagaagcctgtcctggattactcgggtgagtcctaaatgtaatcaaggcatccttgcaagagggaagcacagggac

SEQ ID NO: 91740 - DNA, 601 bp, Human
tgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagcgccgtggctggattcctggagccttctcagttcatcctctcattccagaaattttaagccacattttaacatcaggaaagttcacataaaaagtctgatgtctggattttcttgataggatgttcagctgcaccagaccccacttctaccaaattgaggtcaagggagttgaggagggtctgtccctccttgcagggcctcccagacgccctgtgcccatggcaaggccagggctggacaccacgtgtggctgcattcccactgctgtttctttttagtggagatgtattcttggtctccacgtttccatcaaaaggagagaaatgaaagccaggccaagggtgggtgcaattatctttttttcctccactgctgtccttgttggcattgcctgccaggccctgcaggctctgagtttgcagctcttgtctttctgcaaat

SEQ ID NO: 91741 - DNA, 601 bp, Human
ttctgtggaaagagggctttgtctggatttgctggctgagccctggacctggccagcgtccttgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagcgccgtggctggattcctggagccttctcagttcatcctctcattccagaaattttaagccacattttaacatcaggaargttcacataaaaagtctgatgtctggattttcttgataggatgttcagctgcaccagacccaacttctaccaaattgaggtcaagggagttgaggagggtctgtccctccttgcagggcctcccagacgccctgtgcccatggcaaggccagggctggacaccacgtgtggctgcattcccactgctgtttctttttagtggagatgtattcttggtctccacgtttccatcaaaaggagagaaatgaaagccaggccaagggtgggtgcaattatctttttttcctccactgctgtcct

SEQ ID NO: 91742 - DNA, 601 bp, Human
gcctgacagcagcaggcagaggcttggcaccggcggtgtctggggtggaggcagccaaggtcactggcacgttgctgtctgacttctcttccttcagcccagcagggtgtgtgcacagcagcctggtagcagttccccaggatgggaagcacctgcccctcctctgtcccaaggccaggccggggcgagccccaggagagcagcccacagaggagggcagaagatgcttctacctctgcatcacagaaagcatgggtagccaatgggggaccgtgttttgtttggtctatatagtgagcamgggaggggaccccaggcatgacagctcccactgggtgtgcagggcccagggctggaggcagagagctgatgtggaggcttctgtggaaagagggctttgtctggatttgctggctgagccctggacctggccagcgtccttgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagc

SEQ ID NO: 91743 - DNA, 601 bp, Human
cgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgccyggttggagacacagagacaggtctgggcacaagacgctggccaggtccagggctcaccctgcaaatccagccaaagccctctctccattctcccttaggacccaaggttcaacacttagacatgtcagctgaatcatgacccccggacgtccatgtcctaatcccccaaaactcgtgagcattaccttatatggcagaagagactttgcaaatgtgtttaaatcaggggtcttgagatggggaaagtaacctggatggtcccagcgggccctaaatgttatcacaagtgtccttctaaga

SEQ ID NO: 91744 - DNA, 601 bp, Human
ccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagrctccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgcccggttggagacacagagacaggtctgggcacaagacgctggccaggtccagggctcaccctgcaaatccagccaaagccctctctccattctcccttaggacccaaggttcaacacttagacatgtcagctgaatcatgacccccggacg

SEQ ID NO: 91745 - DNA, 601 bp, Human
ccccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagargactccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgcccggttggagacacagagacaggtctgggcacaagacgctggccaggtccagggctcaccctgcaaatccagccaaagccctctctccattctcccttaggacccaaggttcaacacttagacatgtcagctgaatcatgacccccgga

SEQ ID NO: 91746 - DNA, 601 bp, Human
ggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagcgccggcccccgcccaccccttccgcgtgggccacatcaccgcgctggcatctccaacagccatcccaagggcccrgtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttggcagggcccaggctgaccagggtatgagagagagcacctatcaccacgccagaggccctggcctcaggggtctggg

SEQ ID NO: 91747 - DNA, 601 bp, Human
aggggagttgctgcgcacgtgggggctgtcaggcggagtgccaggcccagacgccgtggagggggagcacaccctggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagygccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttgg

SEQ ID NO: 91748 - DNA, 601 bp, Human
ccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagacgccgtggagggggagcacaccctggcacgtctccactgtggaataagggggscccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggc

SEQ ID NO: 91749 - DNA, 601 bp, Human
ccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtyggaggcacaggggagttgctgcgcacgtgggggctgtcaggcggagtgccaggcccagacgccgtggagggggagcacaccctggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggc

SEQ ID NO: 91750 - DNA, 601 bp, Human
gagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcasgcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagacgccgtggagggggagcacaccctggcacgtctccactgtggaataaggggggcccagccctcgctggggctgcaagcctcgcttctg

SEQ ID NO: 91751 - DNA, 601 bp, Human
ctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagarccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagac

SEQ ID NO: 91752 - DNA, 601 bp, Human
ggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccasctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacagg

SEQ ID NO: 91753 - DNA, 601 bp, Human
ggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggrgctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggt

SEQ ID NO: 91754 - DNA, 601 bp, Human
gagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggyggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacct

SEQ ID NO: 91755 - DNA, 601 bp, Human
attcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccac

SEQ ID NO: 91756 - DNA, 601 bp, Human
caattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctcc

SEQ ID NO: 91757 - DNA, 601 bp, Human
aaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacc

SEQ ID NO: 91758 - DNA, 601 bp, Human
ggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtca

SEQ ID NO: 91759 - DNA, 601 bp, Human
agggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgt

SEQ ID NO: 91760 - DNA, 601 bp, Human
caagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggctt

SEQ ID NO: 91761 - DNA, 601 bp, Human
atccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcagg

SEQ ID NO: 91762 - DNA, 601 bp, Human
agggcatgaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccraaaagctctttggaggacattcccaacacagatccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactg

SEQ ID NO: 91763 - DNA, 601 bp, Human
ctctctatccccaagaggcctctgtctagggacccactatgggatgcagtccctttgtccccattatgcagggtgcccatgtctctttcaccgtcatccatggggcagccagggcatgaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccgaaaagctctttggaggacattcccaacacagatccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggta

SEQ ID NO: 91764 - DNA, 601 bp, Human
tggtcagaggcctccggctggcacaaactggcagagtttggacctcggacccaaatgcagtttctgagccaggcctgtcctcgctgctgctggggaagagcttcctgtccccttcagatgtccctacagctgcctctgcagccctgatgctggtacccaacgcctctcacctgtcgccccacccctctctatccccaagaggcctctgtctagggacccactatgggatgcagtccctttgtccccattatgcagggtgcccatgtctctttcaccgtcatccatggggcagccagggcaygaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccgaaaagc

SEQ ID NO: 91765 - DNA, 601 bp, Human
aacccgcatggcattcaggtgcccggccttttcccaaccagaccagcgcaccagccacctctccacacaggcccagtgcccaggtcacctcctgtcctgtcctgcaggctctctctgggtgtgccgacagtttgggatgggaggcgtgggaggcgtgagctgcgctcctggccgggttctctaccagctgtgctcgtggcgcagcccacacctcacggcaagccccagccaaagggaccaagtcaagagctctgagagacatcccagccgaagaatccagcccttgtcccaaacgtgtgtrtgcacaggcacacgaaagaaggtgagacagaaggagagaaaaatgaagccagagagcaggagagagagaagacagacgccagcacgcccatctgactgcgcgacctttccccgctcagagctccttcagggcccagagcacagcgctgcctaggattaatttcaaagagaaacgggtcaaagaaaattggaaatttttatagaaaatatttcaggcttggagctggctgaagtgtctgccaacctgcagagaattctgagaggagatggggcctgtggtcagaggcctccggctggcaca

SEQ ID NO: 91766 - DNA, 601 bp, Human
gacacatagcaagaacgtgacgagtgaatgcaggaaaatacacttgtggcagcaggcaaggtgccctctctgagcctcagtctccccctaagcagtagagctgctaatgctattattcccccatgatttggggagcagtattattcccccatgatttggggagcagtattattcccccatgatttggggagcagcattattcccccatgatttggggagcagcattattcccccatgatttggggagcagcattattcccccatgatttggggagcagcattattcccccatgatttgggragcagcattattcccccatgatttggggagcagcattattcccccatgatttggggagcagcattattcccccatgatttggggagcagcattattcccccatgatttggggagcagcattattcccccatgatttggggagcagtattattcccccatgatttggggagcagcattattcccccatgatttggggagcagcattattcccccatgatttggggagcagcattattattgagcattaatgaacccgcatggcattcaggtgcccggccttttcccaaccagaccagcgca

SEQ ID NO: 91767 - DNA, 601 bp, Human
cctggctgcctgtggggctgcattgggggctcctgcccccgccccgtgagtctgggaacacatgggtcttggccttggcaccttctttcctgggaaaacacctccctctgggccagggcagtgcagagcagtggaagcgggcagctgtggagtcagagtgatgggtgccaattctgactcctgcacgtggcccagaccacctaacctgccacccccaccagcacacctgcccggccacccccaccagcacacctgcccggccagcctcaggccaccagccagcctcccagccacgtgaccwctcaggggcaggatgtgtccttgattccttccttcacaccacgtcccggaagctccacctcaaactcatcctgaacccactgcctccaccgccatctgtcaccgggactcctccctgcttccacaccgtccaccgaaaaccctccaaaggcctccaccgcacagggaatgaattctcaccccgtaccgtgaccgtcccttcaaagcgatgagtgccacccatccctcccggccctgcacgcctcccactcccccattacgtcctcagttccaggtactagctcttccttctgccccttgg

SEQ ID NO: 91768 - DNA, 601 bp, Human
tgccctgcacactcctaagtacgtgcaggccacagttcctgcatccattcatcccggccagtctggggtccctccccacagtggcaggcaaggggaagctggaccggtcctgctagacaaacaaggatgcacacacgtccatgggaccccaaacctcacactgtccctgacagcccgccccacagagcacagcctctgcctcccggagcaagaggaggtggcagtgcatcccagggcctggctgcctgtggggctgcattgggggctcctgcccccgccccgtgagtctgggaacacatgkgtcttggccttggcaccttctttcctgggaaaacacctccctctgggccagggcagtgcagagcagtggaagcgggcagctgtggagtcagagtgatgggtgccaattctgactcctgcacgtggcccagaccacctaacctgccacccccaccagcacacctgcccggccacccccaccagcacacctgcccggccagcctcaggccaccagccagcctcccagccacgtgacctctcaggggcaggatgtgtccttgattccttccttcacaccacgtcccggaagctccacctcaaa

SEQ ID NO: 91769 - DNA, 601 bp, Human
aaaggacttaggaataggagacatgcagagtaatcaaacccagggaagatcactcatcctcgccagtaaccaaagaagcgcaaattagcgcaaaaagcaacgccgctttgctgccggagcagcaaaatattaaacactaaagcccccgtgctggtgaggatttggagaaaccaggagctgctgtgggagccagtctggctctgccccgagtggtgagtctgttaagcgctgggatttcctaattcatttagtcactcagtaggtgccccctgatggctgctcagggccagggctcgagcgygtctgggctggctcaggccgccatctgccgggtcagcaacagatacctatttgcaggaacagaacctgaggtcagctcccaggatgtccccacccctgagtttcaagagagtttgcaccaggagcagggagcattccagctgtctcgggcagcttttgtgtggggaacagctggtagcgctgcctgcggccccttggggtggacaggaaggctctgcctgcaaaggcctagaggcagccacacaccctgccctgcacactcctaagtacgtgcaggccacagttcctgcatccattcatc

SEQ ID NO: 91770 - DNA, 601 bp, Human
tccctcctgatgcaggagtcaaaaggcctggctcccactgtttctacagcttactatctgtgcgaccgtcggcacctcagtttcctcatctgtaacgtgggcacagcaaaagcaccaacccaccgtggggctcattacaagaatcctaggagatgatgtacctgcagcgtgctggcagacgcggtcaacggtaagtgctccaggaacgcgtcacgttcttcttgctccctgctgttcccgctactgcttggacagtggtagccctgcaccttagttttctctctgcttccaggactaccgygcctattaaatgacaccatgaagagtgcccaccttcgcgcaggccctcggtgaatgggcatgtccttgaacgcaaacttggctccaacggggcaggagaaggatcattcagactcagctacagaaaaacagacttttgtgcaactaacgctaacaaaactggaaaggaaagaggaactatggcctggggaaaagcttgtatcgaacatgacagaaagtcaatatctaaaaagagataaagggcttatcccaatatataagaccccaggagataaacaggcaaaggacttaggaataggag

SEQ ID NO: 91771 - DNA, 601 bp, Human
ctccccgaagctaacgtgctaagtgacctggagacacatcctcactcaccctcgctgggccccagtttctgcagccgttaagtggagttccaggccttggtgcttggaaggccctctgtccaacaaacagatggggtcacaggctaccgggttttgccagcccaggctctgagcggggacaggagggcactgcactgggtgtcagcagccctgggttctaagcctgctcctccctcctgatgcaggagtcaaaaggcctggctcccactgtttctacagcttactatctgtgcgaccgtcrgcacctcagtttcctcatctgtaacgtgggcacagcaaaagcaccaacccaccgtggggctcattacaagaatcctaggagatgatgtacctgcagcgtgctggcagacgcggtcaacggtaagtgctccaggaacgcgtcacgttcttcttgctccctgctgttcccgctactgcttggacagtggtagccctgcaccttagttttctctctgcttccaggactaccgtgcctattaaatgacaccatgaagagtgcccaccttcgcgcaggccctcggtgaatgggcatgtccttgaa

SEQ ID NO: 91772 - DNA, 601 bp, Human
ctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaagcagagtcacagaagaaagagtgatgaacagcactggycacttgatttgcagggcacagtgcaaaatggaaacgcacagtcccttgttcaaaaagtgattacgacttctaaggcaggaatgacagagtgttaaagtgggcatagggccctgccggatgggtcacaagccggcgaagtcagtcctgctcaagtgtgaggaagtgggactagcaaaggcccagggccacccaatgtcccatgggcccatgggaccagtagccacccacagctgccaacctgagtctgcagccctgacactgtggcaacaacaggaggcgtcagtgccaagccctccaatg

SEQ ID NO: 91773 - DNA, 601 bp, Human
gactagtgcactgtgggctgtatgaggtcagggctgtgcctgtctggtcccagagcctggcccagtgcccggtcctgctgtgcgtgccgggtagagatctgttggatgaatcaagggagagaggaaggggagcagccctgggattccacaggtgctttatgtccagagacaaccgcgcagggaacagtggccaaggcacgctgggagcagtgctccagcccgacggcatccccagggcagaggctgggattcacgcattgctgccctcaggcaccaaacgggcctgtggcagtcacagggrcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaagcagagtcacagaagaaagagtgatgaacagcactggccacttgatttgcagggc

SEQ ID NO: 91774 - DNA, 601 bp, Human
cgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtagagatctgttggatgaatcaagggagagaggaaggggagcagccctgggattccacaggtgctttatgtccagagacaaccgcgcagggaacagtggccaaggcacgctgggagcagtgctccagcccgacggcatccccagggcagaggctrggattcacgcattgctgccctcaggcaccaaacgggcctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaa

SEQ ID NO: 91775 - DNA, 601 bp, Human
gcctcagcccaacgtccagtgactgcgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtagagatctgttggatgaatcaagggagagaggaaggggagcagccctgggattccacaggtgctttatgtccagagacaaccgcgcagggaacagtggccaaggcacgctgggagcagtgctccagccygacggcatccccagggcagaggctgggattcacgcattgctgccctcaggcaccaaacgggcctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccac

SEQ ID NO: 91776 - DNA, 601 bp, Human
ggccctcaccctgcccctcctgccacacccccaaacaagccccgtcctcacccctcaggtacttcgcatctgctgccctggccccttttcctcctggggaactgcaacccacactccaggcctcagcccaacgtccagtgactgcgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtagagatctgytggatgaatcaagggagagaggaaggggagcagccctgggattccacaggtgctttatgtccagagacaaccgcgcagggaacagtggccaaggcacgctgggagcagtgctccagcccgacggcatccccagggcagaggctgggattcacgcattgctgccctcaggcaccaaacgggcctgtggcagtcacaggggcacattcctgataccgggtctgtcgttccagcatggacagggccatcttcctcgccatctgcagtctggcatcagacattcccaaataaaggacagacagt

SEQ ID NO: 91777 - DNA, 601 bp, Human
gatctgggaaaggtccttgagaaaagggccagacacagggaccttcccaggcccggatcccacagaggaaatgattctagcgagcgccacctcgacaggtctgaggtccagacaggggtggagctgtcacaggcagccgggtggggctgtgatctgggtcctcccagcctcacggtgatttggaatgggaatacggttctgccaggcaaggagtatccccctctgaccaacctgtggactgcctaccaggactcccaacacccttcctgcacgatggcgctgaggggctgatccggccgckgctctcattcccatggccacctgatccaggccgcagtctctccctgcacacaggacagcagcctcctgccggctccctgcctcttccgtgctcaccctcctcggaaaccagaccatgccacctgctgcatggcacagcccctcctccacgacggagcccacagaagccatcgtgatctgacctccagtcccctcaggccctcaccctgcccctcctgccacacccccaaacaagccccgtcctcacccctcaggtacttcgcatctgctgccctggccccttttcctcctggggaactgc

SEQ ID NO: 91778 - DNA, 601 bp, Human
ctgggactgcccatggctgtgggctctgatttgggtgggcagacctgagcaggccatcatgcttcttattcccagcctgacacccccagaccgccccccgccaacccagacaatgtgtactgaactcctcgtcaacttgacccctgagctcctccccgcagcccaccaggtgctcctgctgtggtttgggcagcacctagtccttttcgccctgctggacgtcgcctggccagacttgcagagccatctcagccctttgttctcctgactccatccctccaagcctggccaccccagcctsggccccagctcctgccacgtgaattgtcaaaggcagagcatgaggaggctgaaggcagcccccatggcacaccccacggagtccctgcagtcgtccaaaaaaggctcaagcctgggcagcattgctcgcagctaggaatctgcagctggactcaaatatgtgtccagaatgatctgggaaaggtccttgagaaaagggccagacacagggaccttcccaggcccggatcccacagaggaaatgattctagcgagcgccacctcgacaggtctgaggtccagacaggggtggagctgtcac

SEQ ID NO: 91779 - DNA, 601 bp, Human
ccccgtgtctacctgggcccagtgatctctgctggcgtcacctgccaggcccccatcagtgtgcccatacgagaccactgtcctcagcgaacgcctgacccccaggctccaggcaaggttgagaggacagatgctctcatcctgggggctctggccttcctggggccagtgttatccagctctgccctccagagccctctgcacacgctggggctgggactgcccatggctgtgggctctgatttgggtgggcagacctgagcaggccatcatgcttcttattcccagcctgacacccccrgaccgccccccgccaacccagacaatgtgtactgaactcctcgtcaacttgacccctgagctcctccccgcagcccaccaggtgctcctgctgtggtttgggcagcacctagtccttttcgccctgctggacgtcgcctggccagacttgcagagccatctcagccctttgttctcctgactccatccctccaagcctggccaccccagcctcggccccagctcctgccacgtgaattgtcaaaggcagagcatgaggaggctgaaggcagcccccatggcacaccccacggagtccctg

SEQ ID NO: 91780 - DNA, 601 bp, Human
ggccgaccccgtgtctacctgggcccagtgatctctgctggcgtcacctgccaggcccccatcagtgtgcccatacgagaccactgtcctcagcgaacgcctgacccccaggctccaggcaaggttgagaggacagatgctctcatcctgggggctctggccttcctggggccagtgttatccagctctgccctccagagccctctgcacacgctggggctgggactgcccatggctgtgggctctgatttgggtgggcagacctgagcaggccatcatgcttcttattcccagcctgacmcccccagaccgccccccgccaacccagacaatgtgtactgaactcctcgtcaacttgacccctgagctcctccccgcagcccaccaggtgctcctgctgtggtttgggcagcacctagtccttttcgccctgctggacgtcgcctggccagacttgcagagccatctcagccctttgttctcctgactccatccctccaagcctggccaccccagcctcggccccagctcctgccacgtgaattgtcaaaggcagagcatgaggaggctgaaggcagcccccatggcacaccccacggag

SEQ ID NO: 91781 - DNA, 601 bp, Human
tgtcatcttgtgacccgcccctggggacacgggtgcccaacaggaaagaggacgggggcttattataaggaaaatagtgtcaggcctgccatggagctttgggcctgaggcctcagctgaggccaaggcagcaggactcatccagagacaggacagaccctgggctcctggtgcccagctcagggaagctcctgggtgcggctcggttcactccagcatttcctacatggatgaagatgtggatgtgtctgctctgaccatgggtgtgtgcatgcctgcgtgtgtgtgagagagagagaggagagagagacggagagagtttatgtacgtgtaactaccaaccagagtccaggagtctcacactccactgcaaaccaggcaggcggggccagcatgagtgggggggccaggcacgaatcggcagggagggaggggttgtgttcgcccatccagaggaggcacagagcctcccacccagtgctgctggcaggaacacgcccagggtggccaggccttctgaaggaactgaaaattgagattttcatgtgaaacctcctgatttttaagtgtacactcaacatttctgaagccgttgtacgag

SEQ ID NO: 91782 - DNA, 601 bp, Human
aagttgtcatcttgtgacccgcccctggggacacgggtgcccaacaggaaagaggacgggggcttattataaggaaaatagtgtcaggcctgccatggagctttgggcctgaggcctcagctgaggccaaggcagcaggactcatccagagacaggacagaccctgggctcctggtgcccagctcagggaagctcctgggtgcggctcggttcactccagcatttcctacatggatgaagatgtggatgtgtctgctctgaccatgggtgtgtgcatgcctgcgtgtgtgtgagagagagagaggagagagagacggagagagtttatgtacgtgtaactaccaaccagagtccaggagtctcacactccactgcaaaccaggcaggcggggccagcatgagtgggggggccaggcacgaatcggcagggagggaggggttgtgttcgcccatccagaggaggcacagagcctcccacccagtgctgctggcaggaacacgcccagggtggccaggccttctgaaggaactgaaaattgagattttcatgtgaaacctcctgatttttaagtgtacactcaacatttctgaagccgttgta

SEQ ID NO: 91783 - DNA, 601 bp, Human
gcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatgggggatgggtagatggatgagtaagtagatgaatggagatcaatgatggatggatagatggatggatgaatgagtgggtagacgaatgaatacacgatggatgaatgaatggataaatgattggatagatgaatggatggayggatgacagatggataaatggatgaatgattggatagatggatgaatgggtagacagaaagactctgatactggaaagtgaatccttcacatccatggcaagtgaaccgggtaacaaagtcagaggcaagaccatagcagcgtcatttgtcactgttgccatttatacacatttttggggcagaatcggtcatgcttgaccacaggtcatctctagagggtgaggattgggggtcaggaactgtggggtgggctcagggctagggctgccgatgtggcctttgtgcctgtgagcagactg

SEQ ID NO: 91784 - DNA, 601 bp, Human
aacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatrggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccgggtaacaaagtcagaggcaagaccatagcagcgtcatttgtcactgttg

SEQ ID NO: 91785 - DNA, 601 bp, Human
gttgatggcgtcaaagatgcacagaaatatattttggctgaaagaaacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatgggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccgggta

SEQ ID NO: 91786 - DNA, 601 bp, Human
ctgttgatggcgtcaaagatgcacagaaatatattttggctgaaagaaacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagatgggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccggg

SEQ ID NO: 91787 - DNA, 601 bp, Human
aacagtcttggtgtttcctcaaaaagtgaaacactgtgttatcatgtgagccagcaattctcctaggcatatacctaagagtaatgaacatatatgtacacacaaagacttgtccacaaatggccatcgaggagaagctggccacagagaagatggcccagagaggaggtgctgtgtgcagaagcagctctgggaggaaagacgtgcacaggccaaattcagattactgacactttttttttaatgcagagattgtctgcagaattacctatttttgacttatcttgaaaaactgaggatstggcaacactgaccccgaatcttcctaacagcaacaatgatcagaactcagaggttttctgtctcactgatttttttttctttttcttttcttttttttttttttttgagatagggtctgactttgtcacccaggctggagtgcagtggtgcactctcagctcactgcaacctctacctcccaggctcaagcaattctcctgcctcagcctcccaagtagctggttccacaggtgcatgccaccacgtgtagctaatttttagatttttttggtagagatggggtttcaccattttgccc

SEQ ID NO: 91788 - DNA, 601 bp, Human
aatgacatccacacggtactggaagcagagctgctagaaacccagccaggcagggtttgaacttgttatctccaaaaagtctcaggaatcgtatttctgcctgatggtgacctacttcagcaaggacccaatgtagaaattactctgccaccaaaaaagcaggcctcagaccccctccatcacctccccaatttatgaattaaacaacgaggccagtgcctgaggggtctgcagatgagagtcagaaaccagcagccccccaccccacagagacaggtccctgctaactagacacaagaawtggccttctggggtgtctctgcgtgttctgtgtatggtgacctagccccggccctccaggagggacactacgtgcaggacattttggaaaacagtcttggtgtttcctcaaaaagtgaaacactgtgttatcatgtgagccagcaattctcctaggcatatacctaagagtaatgaacatatatgtacacacaaagacttgtccacaaatggccatcgaggagaagctggccacagagaagatggcccagagaggaggtgctgtgtgcagaagcagctctgggaggaaagacgtgcacag

SEQ ID NO: 91789 - DNA, 601 bp, Human
ggttcaaatcccagatcctccactttctaattgtgccatctctgagccttccatcccttacctagaaacagagttctttccacccatgcccttgtgagacagcgtaagtgaaaatgacatccacacggtactggaagcagagctgctagaaacccagccaggcagggtttgaacttgttatctccaaaaagtctcaggaatcgtatttctgcctgatggtgacctacttcagcaaggacccaatgtagaaattactctgccaccaaaaaagcaggcctcagaccccctccatcacctcccyaatttatgaattaaacaacgaggccagtgcctgaggggtctgcagatgagagtcagaaaccagcagccccccaccccacagagacaggtccctgctaactagacacaagaattggccttctggggtgtctctgcgtgttctgtgtatggtgacctagccccggccctccaggagggacactacgtgcaggacattttggaaaacagtcttggtgtttcctcaaaaagtgaaacactgtgttatcatgtgagccagcaattctcctaggcatatacctaagagtaatgaacatatatgtac

SEQ ID NO: 91790 - DNA, 601 bp, Human
ggccagcattaccctgataccgaaaccagacaaaaacatcataagaaaactacagactaatgtctcttataaatataggtgcaaaaatcctcaatgatattctagcaaaccaaattcagcagcatattaaaaggcttatatacaatcaccaagtgggatttatccgtggaatgcaagagtggttcaacacacaaaaatcaatccatataatacactacattcataaaatggaggaaaataaaccacacagtcatcttggttgatgcagagaaagcattagacagaacccaacaccctttgygatcaaaaaatactcaagaaacaaggactagaagggaaattcctcagcatgataaagggtatttacgaaaagccaaaagtactcatcatggtcaactgtaagactggaagcctgctctcaccacctgtattcaacatagtaccggacattctagtcagagcaattcagcaagaaaaaaataaataaataaaaggcatccacattgcaaaggaagaagtaacacttcttgagggaaaatggggaatgatggctcgtgggtacagggtttcttttgggagcaatgaaaatgatctaaagttg

SEQ ID NO: 91791 - DNA, 601 bp, Human
gtcaaatcactagctgaccactaagctaacaaaacagagactttggtggccatatataatgaacaatgcagactttacaaaaatagtttagaaaaatcactaaacaaacaagcaacaacacataaaaaacaacaagccccgggaagtggggggcatctgatttccagagtctccacattcaaaatgtccagtttccaacaaaaaatacaaagcatgcaaaataacaagaaaggatggtccactcacaggaaataaaaaagaccttccctgaggaagcctagacacctcatgtgccagacaragattttaaataaattgtcttaaatgtgttcaaagaactaaaagaaaccatgggcaaataacgtaagtaaagcaagaacataatgtatcacaaaatagagaatatcaataaagaaatagaaattataaaaaggaaccacaaacaattttggagctgaaaagcataataactgaaataaaaatttcaatagatcagttcaatagcagatttgagcaggcaaacaaagaatcagcaaacttacattatcagcaatcatccaatctgagaagtagaaggaaaaagaatgaggaaaaaggaaca

SEQ ID NO: 91792 - DNA, 601 bp, Human
tgagtagacccattttatcagacatactaaaggaagttcttcaagctgaaagcaagtgacctcagttggtaacttgaattcacacccacacacatacagtaccagtaaaggtaatcacgcaactttaaaagacaatataaatgggtatttcttctcttttcttcccttaactggcttaaaaagcaataatatagaagaagatgtatataattgtattattgggcccatataatatataaatgtaatatatttgactaacagcacaaagcaggtgaacagaaacacagctactggagtaaaraaatgacaccagatgggaacttgaatccaccgcaacaaatgaagagagccagaaatggtcaacaggaaggcaaactgttgatatatatgtactctcctctcttttttcagcttctttaagcatgaaattatataaagcaataattacaacaattgttaggtttgtagcatatatagctgtgtggtaggcagaactgtggccctccaaagatgttcacattctaatccccagaacctatctatctgtaaggttatatgtaaaggaaaattaacattgtaaatcagatgactttaaaatatt

SEQ ID NO: 91793 - DNA, 601 bp, Human
aatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacttaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccragaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtgggatttccagccgacttctcctaataatggaagccagaaggcagcagaatggcatatccaatgtaaaaaagctgtcaaccaagaatctttctccagcagaactatttttcaaaattaaggtgcaatatagacagtcccagataagtaaaaac

SEQ ID NO: 91794 - DNA, 601 bp, Human
aattataaacaagaaccaaatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacttaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccgagaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtgggatttccagccgacttctcctaataatggaagccagaaggcagcagaatggcatatccaatgtaaaaaagctgtcaaccaagaatctttctccagcagaactatttttcaaaattaaggtgcaatatagacag

SEQ ID NO: 91795 - DNA, 601 bp, Human
acagctgtcagattttgcagcaaagatttcaaagcagccattggaaatatgtctttgaaaaaaggaaaccatgcttatgtaaaggagtgatgatgacaatatctcatcaaataaagactatcaataaagagaaattataaacaagaaccaaatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacytaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccgagaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtggg

SEQ ID NO: 91796 - DNA, 601 bp, Human
agaatgaatttcaaagactggcctcaaaatcatccctacccaaatttaattggatcaaactatgtgacaatttatgtctcaggacattgttgaaaataatagagcaatcatccctcaattagtgaagcctagtagctgggtgtgataccaaatgaagcagagagtgtaacagacagatcagagaaagggacagtcatagggagccctgctgaaatcactgtcatcccgggatgaccctgcacacgctcaaggctgtgccctccaacagctgaggcttcccactgtgaagaatacagacttygtgaaaacagtctaaccaaatcaggaaacaaataaatacacaaacaactgcaaacagcctcagagatgggggaggggaatcagtatgcagagctgccacatgacccaaaatgtccagtttcacacaacagaaacacaaatgactcattcacagaaaaaaaggcggcaacagacactgctggtaagaaagcccagatgtcagatgtaacagctgtcagattttgcagcaaagatttcaaagcagccattggaaatatgtctttgaaaaaaggaaaccatgcttatgtaaaggagtgatgat

SEQ ID NO: 91797 - DNA, 601 bp, Human
ccgaaaggccggagcaccttcctccacccagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatcaggagaacagatcgttatgaggatctcttccagggggagaatgaatttcaaagactggcctcaaaatcatccctacccaaatttaattggatcaaactatgtgacaatttatgtctcaggacattgttgaaaataatagagcaatcatccctcaattagtgaagcctagtagctgggtgtgataccaaatgaagcagagagtgtaacagacagatcagagaaagggacagtcatagggagccctgctgaaatcactgtcatcccgggatgaccctgcacacgctcaaggctgtgccc

SEQ ID NO: 91798 - DNA, 601 bp, Human
aatcaaccaaatcttgggaagaaaaatcccagtaagaacagcaagaatcggtggcacctgagccatcacttgctctctcttccccgcttctagtccttccagttcagcttatggggagttccactctgggggtgtgtggccaagaacacagggctccctcttccctcagatcccagtcaaggaatacagtatttcaccaggatagatgggccaccagcgtttctcatcatctccaactcccagtgacagagggtaactccctgctgagtgtgaccgaaaggccggagcaccttcctccacycagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatcaggagaacagatcgttatgaggat

SEQ ID NO: 91799 - DNA, 601 bp, Human
aagcaacatcatctattcaagaaaatcaaccaaatcttgggaagaaaaatcccagtaagaacagcaagaatcggtggcacctgagccatcacttgctctctcttccccgcttctagtccttccagttcagcttatggggagttccactctgggggtgtgtggccaagaacacagggctccctcttccctcagatcccagtcaaggaatacagtatttcaccaggatagatgggccaccagcgtttctcatcatctccaactcccagtgacagagggtaactccctgctgagtgtgaccgaraggccggagcaccttcctccacccagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatca

SEQ ID NO: 91800 - DNA, 601 bp, Human
tagcccacacctggtactcaatgccctcagcacagtgattggtccagggggtgaacacatgactggagtgagactaatcatgggtcttccatgagatctgaacattgggagaaaaaaatattcccttcctggctcagtaagctcacagcgtaggcctggggctgcgtatgtgaagagccaatctgagaaggaagtctctgcagaagagagccaagtcctaggaggaggagagacgctgagccttggcagcctcgtgtgggccagcggtgcctgctgtcttgctcgcgtgtgccagcaaatytccttttcttggcttaattggatttggatctctaattataccttgaatgaccctgacatatccagtgtcttctaccttccttattgctgtggccctttaaaaaaagattaggaatcatctgccatgagaattccacttctggaatggtggtgagaggagccccatggacacattcccctcagaacaaccataactggtgaaaagtattgaaaagtcaccatcaacaacaatttaaagtctctagaaattatcctaagagcacacaacaaactaagcaacatcatctattcaagaaaatca

SEQ ID NO: 91801 - DNA, 601 bp, Human
tgtgttgccagggacagagtgcaaggtgcctggaagctcctcgggaacgttagctgtgtccctcatcgcaggcaatgggaccctgcaccagtggccagtacctgctgccccagccagcctctgtgaggcacacactgccagagatgacctcacgctggtggaaaacgaggagacagcagatcaacccagccgggcttccacgtccagcaaaacgaggcgagttcgggttgttattctgctctttcatgagtcagggctttgggcctcactgccttccaaacagagtcaaaatcaatttgaygttcaaaacgacatgaaaattgccatgtcaaaggccattctgtaatttcagtgtattaaaatcaaaagagcacagccttcttgaagaagtttcctttgggcagaattcaagtttcctctttcttttacttgtgcaatttgaatttatttcactttttcaggaagtgaccatttttgcaggaaaagtgtagtcaaaagagataatgcacatgaagtttctttttaagttctgagtatgtcgaagagatttacagtgcattaaaataaactataggcaaaatagtgtgtgtacctatctcta

SEQ ID NO: 91802 - DNA, 601 bp, Human
tcctgtgtcaaatgagttcccgtgacgcgtgtcagtgcgtgtggatcttgctgtttgggggagggcagaaactctgcagaccccatgccttgccaccctcgaccctgatacgcgatgccaatagacacactgctgcggaaaccataaacgtcaccagattcagagcttgagcccacctctcccagaggttttgtccggtaaagggaagaggaacagggttcaactctcctggcagaactctatggatgccgcagaagacaacgttaatgagcttggcttaacttacaagggatttccggtyttgtgaaagaggaggaaactcaaatctcaggagagtttaatggcaggagtgagcttgagtgttggtttccctaatagatgggtttagctgcatgggtgaggtagaccaaggccctctgtagaatatgctggagaacaatgattcaagactacaaagaaactgaagtgtgagcggaagataggagtgaaccttcgagaaccggaggccatgccactgccttgtttcgggtggaggaacaaagccttgtcactgtgttgccagggacagagtgcaaggtgcctggaagctcctcgggaacgt

SEQ ID NO: 91803 - DNA, 601 bp, Human
ttgctggagcacaggtcggagcaaaagggaaccgggaaaatagaaggtcatcagaatgcaacactgcaacggattatgcaggtataggggccgctggcaaaagaaggtttaaggtatgaccaaggccaaatccagtggggagtcctttttggaaaccttgacagctgtggtcatggtcgacctcatgggaaattttgcaaacttgatcctgtgtcaaatgagttcccgtgacgcgtgtcagtgcgtgtggatcttgctgtttgggggagggcagaaactctgcagaccccatgccttgccrccctcgaccctgatacgcgatgccaatagacacactgctgcggaaaccataaacgtcaccagattcagagcttgagcccacctctcccagaggttttgtccggtaaagggaagaggaacagggttcaactctcctggcagaactctatggatgccgcagaagacaacgttaatgagcttggcttaacttacaagggatttccggttttgtgaaagaggaggaaactcaaatctcaggagagtttaatggcaggagtgagcttgagtgttggtttccctaatagatgggtttagctgcatg

SEQ ID NO: 91804 - DNA, 601 bp, Human
agggaagccgtcaggtgtgaatgcggatagggagcagatgttggaggtgttcagaggacggaagatatgaaaagtcatctggaaggaggcaaacagactgaggggagcagtctggctgctagcggcaccttgctggtgaacatcatcgtaagcaagagcagaagcagggctgagctttgttcaggggtacccgtgccagcatgaagtaggtagaaagtttcattttaccaggactagggcattgttcagtagatgttacaaagcaagagtgactccaatgagggaacctgcagtttaagasaaggaggctgggtaaggggtggagggaaggatcagtggtgtgagagaccgtgacaaggcggcagcatcaatggcctgcaggtttgctggagcacaggtcggagcaaaagggaaccgggaaaatagaaggtcatcagaatgcaacactgcaacggattatgcaggtataggggccgctggcaaaagaaggtttaaggtatgaccaaggccaaatccagtggggagtcctttttggaaaccttgacagctgtggtcatggtcgacctcatgggaaattttgcaaacttgatcctgtgtcaaa

SEQ ID NO: 91805 - DNA, 601 bp, Human
ggcgtgctgaggtggtacttccaaattgaggttggcaagtagagaaatgccttggaacttggatttgaagagtgcagagacagatgaggtgcagattctgctggagtcaggagcgtgggcaatacagagagcatggaaggtggaggggcagttggaatatgagtcttgggtgcaggagagagatctgggctggagacgcaaatctgggagccatttcatggtacataaagcaacaagaggaatgagatcgcccacagaggggtgcagagggagaccaaggagcgtccaggacagagccctsggcgcatcaaccccagagggtgcgggaagaggaaggatcagcaaaggaaacggggatgaactgtgagtgctgtgattagaccaagaaagtgggtgtccggtaagccacaccaagggagcaggagggactagcctgccacgtgctagggatggcgactgaggattggcagggagatgcagcagcatgatgacctcggggagggtgcctctggcagagtggcacacacagaggcctggtccaagtggggttaagacacagtgagaggagaggaatcgaagatggcgtctccacctagggggt

SEQ ID NO: 91806 - DNA, 601 bp, Human
cggttttcacctgctgggtgtccacggattcacccccagctactgtgtaggggccagctcccctcagggactgctcctgggagaccgtgggagtcaccgcagctccctgctctgtggagcggccacgctagcagaaggaacagagggtgccagtgctctgagtatgccggagggcagtgagtgctgcgggaaggggctggagggcacagggtctgcgagtgccagggcaggtggtgcggggggagctgtctacaaagccttagagcgccagggtaggtcccactggaagggaacatgcaarcaaagactcgaatgaggtgggagggtgagctgagggtgtctagaaagggcatccaggcggaaggaggaccccatgtggggttttgaaaagaagggcaaggaggcccaggatggcaggaatcaagtgagtgagaaggaaaatggaggccacggggtcccagggcgaggcgctgggtcgtgtggggtctggtaggtggcccgggtgctgggtgctgacttctgagctgaacgaagcaggagccactgtgggatttccagcagaagacagacatgatccagcagaaggcatcaaaggatccct

SEQ ID NO: 91807 - DNA, 601 bp, Human
agctgaagagtcccaggcagccatcgctcccgacacgcacgccgcagtgtagctgtggctcctgagaacggcggtgttaaaggacagttacttaaccagaacttggggtccccctgccccgccccacggaggccttgaacatcctacaataaacacacaccgaagccatgttcttggagagactttggggaggctgtgcactctggaaacagccaagctgttctgtggcttggaagaaacaagcagttccatccactctgggctcacagatattcctcctgagcttgaaggaagccacagyggaacttggagctgctctagttctctggaacatgcagcaggtggaaccgcagacgtctctccagggagctgagtcccggttttcacctgctgggtgtccacggattcacccccagctactgtgtaggggccagctcccctcagggactgctcctgggagaccgtgggagtcaccgcagctccctgctctgtggagcggccacgctagcagaaggaacagagggtgccagtgctctgagtatgccggagggcagtgagtgctgcgggaaggggctggagggcacagggtctgcgagtgcca

SEQ ID NO: 91808 - DNA, 601 bp, Human
gcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcttggactttgggcccagaaatcactttccctccctcctctctgagcacacaaagggcaggacttgtcttcaggtgcttggggaagagggacgccaattgttccagccactcccrtaagggtgaaccaggagactaaccatcaaattcaccaggaaatcccaacctccaggccctgactgaggccctaagacccaagcaagcaatatcaatgaaagccagaggtgcttaaggtggggaacaagaatgagctgtcagaggcctctgataaagaatcgtttaaaaagactttctttgctgcggctcatgcctgtaatcccagccctttggaagtctgaggcggtaggatcacttgaggtcaagaattcaagagcagcctgggcaatatggtaaaaccctgtctccatacacataaaa

SEQ ID NO: 91809 - DNA, 601 bp, Human
cctgtgaccactcatgtccacctagcctggtcctggtcccaggtgccctcctggtctagctgccactaaacagatgagaatctccctcccatcccagccctgaaatatgctcagcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcytggactttgggcccagaaatcactttccctccctcctctctgagcacacaaagggcaggacttgtcttcaggtgcttggggaagagggacgccaattgttccagccactcccgtaagggtgaaccaggagactaaccatcaaattcaccaggaaatcccaacctccaggccctgactgaggccctaagacccaagcaagcaatatcaatgaaagccagaggtgcttaaggtggggaacaagaatgagctgtcagaggcctctgataaagaatcgtttaaaaagactttctttgctgcggc

SEQ ID NO: 91810 - DNA, 601 bp, Human
tctgctcagaccaaaggcagaatccagtgctgatggttgccaatagggtcctctctgttgctgggcccccatgaaccatgtgagccctgcacagagctcctgctagatcctgggggtctccctgcactgggattgctccaacagtgcccccaccctcagggcatgggttgccctctgcatctggccaagtgccttcccagacaccctgcagcctcagcctcctgtgaccactcatgtccacctagcctggtcctggtcccaggtgccctcctggtctagctgccactaaacagatgagaakctccctcccatcccagccctgaaatatgctcagcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcttggactttgggcccagaaatcactttccctccctcctctctgagcacacaaagggcaggacttgtcttcaggtgcttggg

SEQ ID NO: 91811 - DNA, 601 bp, Human
aagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcgggtgacaatggctgcaggtcctgccactcagacgattcccacgcgtgtctgtatcaggatgaggatgagtagatcggtaaagtgccttgtagactgtgatgatcatatttttgtctttgattccactgccagsacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggcatttccaacaagtctggagaatggaagcacatgaaattatgcacgaccatgagcatctgtgtcgggaggcgggaaggcgttcacccttcaaactcaagtgaaaaaggtttgccgtagttaaaggctgctgaca

SEQ ID NO: 91812 - DNA, 601 bp, Human
tgtgtgagttagctgtgatgcttatcttcattctgcagatggggaaactgagaaaggctatcccaatttcacactgctcggaagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcgggtgacaatggctgcaggtcctgccactcagacgattcccacgcgtgtctgyatcaggatgaggatgagtagatcggtaaagtgccttgtagactgtgatgatcatatttttgtctttgattccactgccagcacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggcatttccaacaagtctggagaatggaagcacatgaaattatgcacgaccatga

SEQ ID NO: 91813 - DNA, 601 bp, Human
gcactgttccaagcacctcgtctatagttgcccactgattcttcgcagcagctgtgtgagttagctgtgatgcttatcttcattctgcagatggggaaactgagaaaggctatcccaatttcacactgctcggaagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcrggtgacaatggctgcaggtcctgccactcagacgattcccacgcgtgtctgtatcaggatgaggatgagtagatcggtaaagtgccttgtagactgtgatgatcatatttttgtctttgattccactgccagcacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggc

SEQ ID NO: 91814 - DNA, 601 bp, Human
caggcccagaaggacaaatacggcactcgtccactcacatgaggatctgtaatcaaacgcatgaaagcagatgacaccatagaggctgccagagctgggggagcgggaaatggggagttgctgttcaatgggtgtaaagttttagtgatgctggacgagtaagtactagaggtctgctgtacaacgttgtgcctgtagctgaccatgtggcactgtgcacttcgaaattctctgagaggtctgagctcacgttaagtgttctttccacaaaagcaaacaacaacagcaacagaaatgaagkgacagaaggaaaccgtgggagaagacgagtgtctaccgcctcgatgtgctgatggcgtcccggtgtctgcacaaatccacacttgctgaactgtaaggggccggtgacctctacagtcgcctaccatggcgagcataaacttgcagagaagaggatgagaattctgataataggacaaatcaaagcttaacaagtaattaaaggacaaattggtgcatataacaagtcgttccctgtctcgcagctgacatggatcaatgtccaaaatttttatccaaattgttataaatacacatgaga

SEQ ID NO: 91815 - DNA, 601 bp, Human
aattagccgggcatggtggtgggcgcctgtaattgcagctactcaggaggctgaggcaggagaatggcttgaacccgggaggcggaggttgcagtgagccgagatcgtgccactgcactccagcctgggcgacagagcgaaactcagtctcaaaaaaaaaaagccgggggggctaccaaaagatgagagggacccaggcctgtattgcacatccacatcagtgacagtgtaatggtacgcagaccccctccccgcatgcacacgcattctgaaataagccaggcccagaaggacaaatackgcactcgtccactcacatgaggatctgtaatcaaacgcatgaaagcagatgacaccatagaggctgccagagctgggggagcgggaaatggggagttgctgttcaatgggtgtaaagttttagtgatgctggacgagtaagtactagaggtctgctgtacaacgttgtgcctgtagctgaccatgtggcactgtgcacttcgaaattctctgagaggtctgagctcacgttaagtgttctttccacaaaagcaaacaacaacagcaacagaaatgaagggacagaaggaaaccgtgggag

SEQ ID NO: 91816 - DNA, 601 bp, Human
tcaggcactctttcattttgtaaaacaatagggttatcaaggcctgcgcagtggctcatgcttctaatcccagcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcaggagaatggcttgaacccgggaggcggaggttgcagtgagccgagatcgtgccactgcactccagcctgggcracagagcgaaactcagtctcaaaaaaaaaaagccgggggggctaccaaaagatgagagggacccaggcctgtattgcacatccacatcagtgacagtgtaatggtacgcagaccccctccccgcatgcacacgcattctgaaataagccaggcccagaaggacaaatacggcactcgtccactcacatgaggatctgtaatcaaacgcatgaaagcagatgacaccatagaggctgccagagctgggggagcgggaaatggggagttgctgttcaatgggtgtaaagttttagtgatgct

SEQ ID NO: 91817 - DNA, 601 bp, Human
aaacacacatcaaatacatacgcttgacgttatgcccgggagggctgtgcacacaggcacacagagacggtgagacttggggatacttgggtccagttactgtcaccttgggtctcacttctgggagcgtggatttggctggcaccactgcactgcggtgtgtctgcgtctatacagacttcctccatttcacgcatgtacctaaaacataccaccattcatgtactgtcaggcactctttcattttgtaaaacaatagggttatcaaggcctgcgcagtggctcatgcttctaatcccarcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcaggagaatggcttgaacccgggaggcggaggttgcagtgagccgagatcgtgccactgcactccagcctgggcgacagagcgaaactcagtctcaaaaaaaaaaagccgggggggctaccaaaagatgagagggacccaggcctgt

SEQ ID NO: 91818 - DNA, 601 bp, Human
ggcttcctgagtgcctacctggccctgggcactcacagggcattgatgccgagatgctcagctgtgcagagggtgtgcaggtctggtggtcacttatgcgctccagggcctgcttctgctgatgccagggcaagacccagcctcaaacacacatcaaatacatacgcttgacgttatgcccgggagggctgtgcacacaggcacacagagacggtgagacttggggatacttgggtccagttactgtcaccttgggtctcacttctgggagcgtggatttggctggcaccactgcactgcrgtgtgtctgcgtctatacagacttcctccatttcacgcatgtacctaaaacataccaccattcatgtactgtcaggcactctttcattttgtaaaacaatagggttatcaaggcctgcgcagtggctcatgcttctaatcccagcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcag

SEQ ID NO: 91819 - DNA, 601 bp, Human
cagggcgcatgcccctgtcagctggccggacaggcctctcttgccaaggcttaccctccttggttctaatttaattttgtgaccttttctctcgacatcctgaccccgtacatccctgcgccttggcacactgcaccaaagcaccatagaattactgagctataagcctctcatggaaatctgtttttgactttgttagaaaacactataatcaaatccctgagagtcaggagggatgggcttggcctgccagaggaaacatatcaccggattaagtgatttagcagaggtggtcccggcrggaggagggcagggcaggctgggcagggctgggcgtgaggtgggcaggcagggtgccctcgggggcaaggggggaggggatgcgcagaggcagaggatgggcaatgtgggattaccagaaagtgcggtctggacatcccagggcctgcaggcttcctgagtgcctacctggccctgggcactcacagggcattgatgccgagatgctcagctgtgcagagggtgtgcaggtctggtggtcacttatgcgctccagggcctgcttctgctgatgccagggcaagacccagcctcaaacaca

SEQ ID NO: 91820 - DNA, 601 bp, Human
cccaggcaggaaatgggccgcaggcagcatgaatgtttaattacgttaattgtccaagtccagcgcacatcatccctcctaagtaccttatgggaaatcgtaattaggcgtgaaatggctcattttcacaactcccctttctcggggttctccagggcgcatgcccctgtcagctggccggacaggcctctcttgccaaggcttaccctccttggttctaatttaattttgtgaccttttctctcgacatcctgaccccgtacatccctgcgccttggcacactgcaccaaagcaccatakaattactgagctataagcctctcatggaaatctgtttttgactttgttagaaaacactataatcaaatccctgagagtcaggagggatgggcttggcctgccagaggaaacatatcaccggattaagtgatttagcagaggtggtcccggcgggaggagggcagggcaggctgggcagggctgggcgtgaggtgggcaggcagggtgccctcgggggcaaggggggaggggatgcgcagaggcagaggatgggcaatgtgggattaccagaaagtgcggtctggacatcccagggcctgc

SEQ ID NO: 91821 - DNA, 601 bp, Human
tcaggcacctccagctgtgcacctcggtcaggccaccctctctccgtcagaccctcagtgtcctgatcagtgtccacaagtaagacacatagaaaacctgaggcccagagaagccaaggaagtccttacaggcttctgtcagagaatcggaggaaaggaggggacgccagagaatctgggcttaagtgacttggccgtgatcaaaacacaggcagagtcacaaacacgagaccccgctgcccactcccgacggagaggtaattccacaaacacgagaccctgctgcccactccacaaacaygagaccccgctgcccactcccgacggagaggtaattccacaaacacgagaccccgctgcccactcccgacggagaggtaattccacaaacacgagaccccgctgcccactccacaaacatgagaccccgctgcccattcccgacggagaggtaattccaggtcagtggcatccagccttccccggcccccaggcccccagctgccaccaagaaacactctttgtaggggtcctgccccactggggtgcagaggtacatcccccaaggcccagccccgcaggaagcccttcctctgcagcc

SEQ ID NO: 91822 - DNA, 601 bp, Human
cctccagctgtgcacctcggtcaggcacctccagctgtgcacctcggtcaggccaccctctctccgtcagaccctcagtgtcctgatcagtgtccacaagtaagacacatagaaaacctgaggcccagagaagccaaggaagtccttacaggcttctgtcagagaatcggaggaaaggaggggacgccagagaatctgggcttaagtgacttggccgtgatcaaaacacaggcagagtcacaaacacgagaccccgctgcccactcccgacggagaggtaattccacaaacacgagacccygctgcccactccacaaacacgagaccccgctgcccactcccgacggagaggtaattccacaaacacgagaccccgctgcccactcccgacggagaggtaattccacaaacacgagaccccgctgcccactccacaaacatgagaccccgctgcccattcccgacggagaggtaattccaggtcagtggcatccagccttccccggcccccaggcccccagctgccaccaagaaacactctttgtaggggtcctgccccactggggtgcagaggtacatcccccaaggcccagccccgcag

SEQ ID NO: 91823 - DNA, 601 bp, Human
cagacacccatgagacactcaggcaggagtggtctggagcacagagagagggtgggccggaggccccaggtgtgggcggcctccaggatgaatcagctgcagagcaccgcagtggcgcacacagatcagtgtcctgatctgaaaagtaggcataacgatgctggccacagcccacaagtaagacacatagaaaacctgaggcccacagaggtgacaggaacgggccaggtgcacggacagggctgttcctgactcagctcactccaccagaacccagtctgggcaccagcctgttttcttstcctctccagccagcagggcagaattgggggtggacttgccccagcctgaagacctccggggccctggctcctccctgctccacctgccatagcccaaaaccagtgtgggtgtgaagcggaaggagactccgcagcaaggcccagctcttatgccggccactgccttgcctcctgcctgatgcagtctctcggcagcaaggcaggtgccctgagacctggaggtgcccccagccccagaacccaccatgcgcggctgggccgactgtgcctgcccttaaggcaggcagaacactaaccaa

SEQ ID NO: 91824 - DNA, 601 bp, Human
gaggagccgcgtgggaggaggagaaggccgtgtggggcgtgttgggctgagatttctgtggggacacaaggacagacacccatgagacactcaggcaggagtggtctggagcacagagagagggtgggccggaggccccaggtgtgggcggcctccaggatgaatcagctgcagagcaccgcagtggcgcacacagatcagtgtcctgatctgaaaagtaggcataacgatgctggccacagcccacaagtaagacacatagaaaacctgaggcccacagaggtgacaggaacgggccagstgcacggacagggctgttcctgactcagctcactccaccagaacccagtctgggcaccagcctgttttcttctcctctccagccagcagggcagaattgggggtggacttgccccagcctgaagacctccggggccctggctcctccctgctccacctgccatagcccaaaaccagtgtgggtgtgaagcggaaggagactccgcagcaaggcccagctcttatgccggccactgccttgcctcctgcctgatgcagtctctcggcagcaaggcaggtgccctgagacctggaggtgccc

SEQ ID NO: 91825 - DNA, 601 bp, Human
caggactctcccagcagctcccccaggggtcaggggcagagggagcccccagcctggcctgctccctgacgactctacacttggcagctgaagggggccaccctgacagtcaaggcccagctgtgatctggggtggaactggtctggcaccgatctgcttggcctggctctgggtgctggcacggcagtatctggtgggctgcagggcccccagctggggccctttgagtgatgatgagcctgctgggctgggaccacagagtgagcaggaccagcatcccctcaaccccagatgccctcyaggactgcagggcccagacacagagagggaacctgacgctcatggggagggctgagaggcaggcagagggggaagggtgttcctgaccacggcccacaggaccagcagtgcagagggcctgggagtgagggaagcccctgctgtgccaaggagggagggccaggagaggagagatggccgaggccgggaggagggcagaagtgcagagagactagagggggcagggcagccctggcttggggctggagagggagccaggaaggagggtggaaggcaggggaggcagcgtgtggacaaaga

SEQ ID NO: 91826 - DNA, 601 bp, Human
gagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtgtatatatatatacttgtgtgtgcacaggacatcctgaaaggacacagaagaaaggtgtgcagtggctgccctgcagaaaggagctgasttccaggacagccaatgggagggggatgaggacagcaatgagcatttcatatggctgcaatccttagtccagccaaaaagcaagccacgcacatgcaggagaggccaggactctcccagcagctcccccaggggtcaggggcagagggagcccccagcctggcctgctccctgacgactctacacttggcagctgaagggggccaccctgacagtcaaggcccagctgtgatctggggtggaactggtctggcaccgatctgcttggcctggctctgggtgctggcacggcagtatctgg

SEQ ID NO: 91827 - DNA, 601 bp, Human
gctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacggtgaaaagaagtaacgtccccatcagtcaaggtctggttaagcaagtgattcacaggatggaatgcctgagcaggaggaatgggcaggtctggaggggctgctgtggacgacgtccaagacrtgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtgtatatatatatacttgtgtgtgcacaggacatcctgaaaggacacagaagaaaggtgtgcagtggctgccctgcagaaaggagctgacttccaggacagccaatgggagggggatgaggacagcaatgagcatttcatatg

SEQ ID NO: 91828 - DNA, 601 bp, Human
attacgggtatgagccaccgagcagcttttcagtgtatgagaagacgctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacrgtgaaaagaagtaacgtccccatcagtcaaggtctggttaagcaagtgattcacaggatggaatgcctgagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtgtatatatatatacttgtgt

SEQ ID NO: 91829 - DNA, 601 bp, Human
ggcctcccacagtgttggtattacgggtatgagccaccgagcagcttttcagtgtatgagaagacgctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccasggctgcattataagaaacggtgaaaagaagtaacgtccccatcagtcaaggtctggttaagcaagtgattcacaggatggaatgcctgagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatatgtg

SEQ ID NO: 91830 - DNA, 601 bp, Human
acagagtctctgtcacccaggctggagtacagtggcgtgatctcagctcactgcaaccaccgcctcccggattcaagcagttttcctgcctcagccttccaagcagctgggattacaggtgcctgctatcatacctggttaattttttttttttttgtatgtttagtagagacaggatttcaccatgttagccaggctggtttcaaactcctgacctcaggtgatccatccaccctggcctcccacagtgttggtattacgggtatgagccaccgagcagcttttcagtgtatgagaagaygctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacggtgaaaagaagtaacgtccccatcagtcaaggtctggttaagcaa

SEQ ID NO: 91831 - DNA, 601 bp, Human
cccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcctttctttctttcttctctttcttctttccttctttcttttttttttttgagacagagtctctgtcacccaggctggagtacagtggcgtgatctcrgctcactgcaaccaccgcctcccggattcaagcagttttcctgcctcagccttccaagcagctgggattacaggtgcctgctatcatacctggttaattttttttttttttgtatgtttagtagagacaggatttcaccatgttagccaggctggtttcaaactcctgacctcaggtgatccatccaccctggcctcccacagtgttggtattacgggtatgagccaccgagcagcttttcagtgtatgagaagacgctcgacctcacccttaattaaagaaacaacctgcatcagattg

SEQ ID NO: 91832 - DNA, 601 bp, Human
aaacattcacccctagacactgctgtggggtcggagccccacagcctgcccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcctttctttctttcttctctttcttctttccttctttcttttttttttttgagacagagtctctgtcacccaggctggagtacagtggcgtgatctcagctcactgcaaccaccgcctcccggattcaagcagttttcctgcctcagccttccaagcagctgggattacaggtgcctgctatcatacctggttaattttttttttttttgtatgtttagtagagacaggatttcaccatgttagccaggctggtttcaaactcctgacctcaggtgatccatccaccctggcctcccacagtgttggtattacgggtatgagccaccgagcagcttttcagtgtatgaga

SEQ ID NO: 91833 - DNA, 601 bp, Human
ccgaccggcagaagcagaacgacacggagtttggccggggcagtcagaggagagcccaggctgcttagcggcccgactccagggaaagccctttgcaccccatcctccttctggcttcccccatctgctgagagctacttccactcaataaaacctcgcactcattctccaagcccacgtgtgatctgattcttccaggacatcaaggaagaacccgagatacagaaagccctctgtccttgcgacaaggtagagggtctaactgagctggttaacacaagccgcctacagacagctaaastaaaagagcacatgcagcacacgcccactggggcttcaggggctgcaaacattcacccctagacactgctgtggggtcggagccccacagcctgcccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcct

SEQ ID NO: 91834 - DNA, 601 bp, Human
cttggagcatgcggccctcttggcttgtcttttgcttattccctcttcactgagaaatattttgctcccatgagaaaagccatgtgggcagggggatgagagggcacactgcctccagcccaaggtggccagtggtgactaggagggtgcaggtccatgttgctgggtcttatttttgtaaggaagtgagaaatctggatttgcatgtgaagtctctgatctctaaatactggcaaaaagcaatttaagaataatgtaggtgctgtgctgcttgtgaaatgaaccaaagctgggtccccasgtctgtctgccacctcagctccacgcccagaccaaagctgtgtcctcaggtctgtctgccacctcggctccacgccctgagcaaccgtttccctgtatcctcctccgtctggcctggagaggttttgagcacagtaggttctggccaaccagagtgagtccacctgcctctgcctcacagtggctgaagcttcccgggccgcagttcacgccccacttgtttctccacatccctttcccaccttgaaggacagctcctgatggatgtgttttatggtggaatcctcacgcaggggcctga

SEQ ID NO: 91835 - DNA, 601 bp, Human
ccggcacatcctgacatccgtaggcgccatcctgacaacacgctgccggccgcaggcctcacaccacagcaattctcactcgggcctccctgaccctcgacctgtgggtccctgctaggctgggcgtgtttcccgatgccccatctctctgacctagacatattttgttcacatgttgaacagagagaaacggtccgcatttccagaaagaaatatactctcccaattttccttggagcatgcggccctcttggcttgtcttttgcttattccctcttcactgagaaatattttgctcccrtgagaaaagccatgtgggcagggggatgagagggcacactgcctccagcccaaggtggccagtggtgactaggagggtgcaggtccatgttgctgggtcttatttttgtaaggaagtgagaaatctggatttgcatgtgaagtctctgatctctaaatactggcaaaaagcaatttaagaataatgtaggtgctgtgctgcttgtgaaatgaaccaaagctgggtccccaggtctgtctgccacctcagctccacgcccagaccaaagctgtgtcctcaggtctgtctgccacctcggct

SEQ ID NO: 91836 - DNA, 601 bp, Human
tggataaatggaaaacttagttatccttatgctacttctgagcaggtggagacaggacagggtaggacgaggcgcagcgtggatgcgggcggattgtctgtatctccttggtgggagcagttggccgtggagtctacatcggtttccttcctggccgtcatttacagggagagcatgagggcggcgtgaggtcagcggggcaggtggatgctgtgcgcttactgcagccatgcggtgggtgcacgctaccaccgtcttctcctctttttcttgggagctgtcgccatggctcccggcacaycctgacatccgtaggcgccatcctgacaacacgctgccggccgcaggcctcacaccacagcaattctcactcgggcctccctgaccctcgacctgtgggtccctgctaggctgggcgtgtttcccgatgccccatctctctgacctagacatattttgttcacatgttgaacagagagaaacggtccgcatttccagaaagaaatatactctcccaattttccttggagcatgcggccctcttggcttgtcttttgcttattccctcttcactgagaaatattttgctcccatgagaaaa

SEQ ID NO: 91837 - DNA, 601 bp, Human
ttgtcttcctgtgtgaactccgtgggtccagaagcctgagtttgggggtggtgacaattggccctggtggaccccacacactcctgtcccatgatgcttcctgccctagaatatcccagctgcagttgaggagggaaggggctcctcatactccccacacagcacccagaccacggtgttgacaaggcttaatttgatcagccctatttcgagaagggaggaaatcagaaatcagagtgagtgctgagtcctgaaaatttaatccccaaggcagcctcacagggcctttcctccccaaccrgggcaggtggcagggatgcactacaagcccagatcccagggccaccctgagaaccaggaggggagggagggccaccctgcctgcagagaggatggcaaaggccctgcttgccgggccccagctgccctcaacactgcaagggctcagaagactggaccagcagctggccgggcagaaactatagaaatcatcctaattctactttaaaaggctggggtttcctcttcttgcttaaaagctggtgtgacccttccaggtagcagccagcggcaggcctgtggctcactgagatgggctggg

SEQ ID NO: 91838 - DNA, 601 bp, Human
acgggtaaatcccaaggtgcagactcagagacagcaccgagaggcccccagtgcagccgccactctgagcccagaggccaggccatccaaccctgcagggacgggggttcctcccatttgtcttcctgtgtgaactccgtgggtccagaagcctgagtttgggggtggtgacaattggccctggtggaccccacacactcctgtcccatgatgcttcctgccctagaatatcccagctgcagttgaggagggaaggggctcctcatactccccacacagcacccagaccacggtgttgacraggcttaatttgatcagccctatttcgagaagggaggaaatcagaaatcagagtgagtgctgagtcctgaaaatttaatccccaaggcagcctcacagggcctttcctccccaaccagggcaggtggcagggatgcactacaagcccagatcccagggccaccctgagaaccaggaggggagggagggccaccctgcctgcagagaggatggcaaaggccctgcttgccgggccccagctgccctcaacactgcaagggctcagaagactggaccagcagctggccgggcagaaactata

SEQ ID NO: 91839 - DNA, 601 bp, Human
ttcctagctgattgtgggacctggggcagccctgcacggtgggccacactgtgccaccaagctgccttcctaggaggaagagttcctcagatgcccaggcaccagggacttcacacacctcctgtttcttcttcatggtagccggtggagtgggcacgggacctctcttacgcaaatgagggaacaagccctgggcccaggcaacaggcacccctgcgtgaccccagcatctggctctgtcccccgcatcccgagcttccaatggcccatggtggtgattgcacctggtccagcagccaaragggagctgaaagtaccagggccctggcccagctgaggaccttgctgccatcacccaccatgacccttgggcacaaagaccccccactttcagtcgtggcaccaagcacagtccatgtctgaccaggacctgctcaaggagcaggagtgaccgaggacaaccccggggaccaccccagccctcccccatgctgggggtggaagggtggtgaggcctggggcctcttgatgctcccatgccctgatgtcccatcctccaggacgctcccatgcccctgcgcctcctgagggggcagggaaa

SEQ ID NO: 91840 - DNA, 601 bp, Human
aagcgggaggtctcagatgctgcccgaccctgtgcaaatgaggccctctcctacccggccatgagccacgtgcagggactcagcacctgcctctgctccctcctccttcctgacccctctaggtcaggagtccaggcacacagcagtgctggggtgctgcagccaagcacaggctcttcctagctgattgtgggacctggggcagccctgcacggtgggccacactgtgccaccaagctgccttcctaggaggaagagttcctcagatgcccaggcaccagggacttcacacacctcctgyttcttcttcatggtagccggtggagtgggcacgggacctctcttacgcaaatgagggaacaagccctgggcccaggcaacaggcacccctgcgtgaccccagcatctggctctgtcccccgcatcccgagcttccaatggcccatggtggtgattgcacctggtccagcagccaagagggagctgaaagtaccagggccctggcccagctgaggaccttgctgccatcacccaccatgacccttgggcacaaagaccccccactttcagtcgtggcaccaagcacagtccatgtctgacc

SEQ ID NO: 91841 - DNA, 601 bp, Human
cacaacttccccttcgtccccccagcacccgccgaactaccgaggctcctctgcacctgccccgtgccactctccagcggcctctgcagcccactcacctccaaggattcacgggggtctcggggccttcagaggctggggcgggtgacaagagccagcaagccctgcccctgcctagcatctgcttaagccagggagggtccccaggactcaccacagcccccagggctccaagccttccctctgctgggcagttggcccagggaaggggagctggcctgggtaatgtcacgggggcacygcagcacgcggcagccaagtggtgggggccgatggagaggccggcaggtcttttattgaaaatattcactgtgaacttcagaacaaaacgaagatccccacgggtcccaaaggaagggagaattcccaggggttgtgttctgaacgcagaggaggtgggggccggcaagtggggtgctgacagccagtgccacgggacccatgtggccggaggcttggccagtggctcagcagatgacaggcggaaaatccctgtcaccagtctggtacatgctccagagcccctgatttggacatcatc

SEQ ID NO: 91842 - DNA, 601 bp, Human
gcggacagatggacgctccagcccaggcctgctcagcctcagccgtgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccccatatggctcatgggsagccaatcccactgcaccccagctccaggagtgcccaaggggtcctgttaggccactggaacctgatgctgtgtgttggtgtgcacaggaagactcccgtgctttcctctctgctgggaaaatgtgactctgggactgctaagtacctccttcccccaggagcagcagaggcgagagatgagggcagccccgtgtgctgctgacactgttcaggtccccaaatccagctatggctgaaggtgatgcacccctggacatcctaattcttcaggtcaattcatttagctctctgtctcttgc

SEQ ID NO: 91843 - DNA, 601 bp, Human
tgtactttattaaaagatgctcattaggattattacatcccagccctttataactttattactgactttgaattaatttttgcaacttcaacagacacagctcatccaatgccatttttatgacctgaggtggatcggagggtggggaggggctcctggggccggcctggccatcaggagcgcatcaggaaccgctgtgccgaatctcaggggcagtcctgacagttctctaaactcccacgggatgggctgccccgcggacagatggacgctccagcccaggcctgctcagcctcagccrtgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccccatatggctcatggggagccaatcccactgcaccccagctccaggagtgcccaaggggtc

SEQ ID NO: 91844 - DNA, 601 bp, Human
ctctgggaagcagaaggcaggctcagccccacgggggccatcagcacagagccccactggtgtactttattaaaagatgctcattaggattattacatcccagccctttataactttattactgactttgaattaatttttgcaacttcaacagacacagctcatccaatgccatttttatgacctgaggtggatcggagggtggggaggggctcctggggccggcctggccatcaggagcgcatcaggaaccgctgtgccgaatctcaggggcagtcctgacagttctctaaactcccaygggatgggctgccccgcggacagatggacgctccagcccaggcctgctcagcctcagccgtgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccc

SEQ ID NO: 91845 - DNA, 601 bp, Human
tccagtgcttaggagtccccaaaacgtaagtcctaatgaccgccctgcagagccagaactgccacactgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttacyaaccaagagagagtcgctctgtggctgtgtattcccctaaagataatcattaagatgaaatatgtttatgtggaagtgtaatcaggacacagcagaaagccctgcttggaagcaggcaggctctttggaggctctgggaagcagaaggcaggctcagccccacgggggccatcagcacagagccccactggtgtactttattaaaagatgctcattaggattattacatcccagccctttataactttattactgactttgaattaatttttgcaacttcaacagacacagctcatccaa

SEQ ID NO: 91846 - DNA, 601 bp, Human
ggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgccctgcagagccagaactgccacactgcccagaagaggagagggaggctcagggaattagactaaggccatgatgttggcaaatggccaggccagaatgccagcccagttcctgcacacaagcactgccagggcctgcaggggccaccaccrggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagataatcattaagatgaaatatgtttatgtggaagtgtaatcaggacacagcagaaagccctgcttggaagcaggcaggctctttggaggctctgggaagcagaaggcaggctcagccccacgggggccatcagcacagagccccactggtg

SEQ ID NO: 91847 - DNA, 601 bp, Human
actcactaggggatggcgcaagggggggatgggcacactcactaggggatggcctgagggcagacaggcacactcactaggtaggggatggcctgagggcagacggcacactcactaggtaggggatggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgccctgcagagccagaactgccacastgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagataatcattaagatgaaatatgtt

SEQ ID NO: 91848 - DNA, 601 bp, Human
ggtgtgaggggggatgggcacactcactaggggatggcgcaagggggggatgggcacactcactaggggatggcctgagggcagacaggcacactcactaggtaggggatggcctgagggcagacggcacactcactaggtaggggatggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgcccygcagagccagaactgccacactgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagata

SEQ ID NO: 91849 - DNA, 601 bp, Human
actgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaattgaaagagcagtcaaagaaatgcttccatagaagagtttaaccaaayccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttcaacgactacacaaaaagtagtataatatagtctaaggtctccaaaaacacaaaagaagacctcagtaaatgaagctacatggacataatcctggactggaagttggtcctcctccaaatgaatcaagaaatttggc

SEQ ID NO: 91850 - DNA, 601 bp, Human
gagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaaytgaaagagcagtcaaagaaatgcttccatagaagagtttaaccaaatccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttcaacgactacacaaaaagtagtataatatagtctaaggtctccaaaaacacaaaagaagacctcagtaaatgaagctacatggacataat

SEQ ID NO: 91851 - DNA, 601 bp, Human
ctcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccrttctaataggcctagactaaatagaaaatatacattccactcatggctcaagtagaaaacctgaagaaaccaataacctcagaagaaattgaaagagcagtcaaagaaatgcttccatagaagagtttaaccaaatccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttc

SEQ ID NO: 91852 - DNA, 601 bp, Human
acaaggccacagtgataggagcactgtaatacatttattccagacaagtctgatacagcattaggtagggatagaaactatttgaattaataggaaaacctaacgttcaaacccaacagccagaacacgtgaccttgtcaagcacacacgggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaattgaaagagcagtcaaagaaatgcttc

SEQ ID NO: 91853 - DNA, 601 bp, Human
ttaaaacaagtggggcaaagaaacgtaccatgtaattgccaaccaaggcatttaaggagataaactgataaaacaaacaactcatggaaaaaaatacaaaagatacgaaactttatgctcctaaagcttcaacctggtgcaaggaaggagagacaaggccacagtgataggagcactgtaatacatttattccagacaagtctgatacagcattaggtagggatagaaactatttgaattaataggaaaacctaacgttcaaacccaacagccagaacacgtgaccttgtcaagcacacaygggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataa

SEQ ID NO: 91854 - DNA, 601 bp, Human
aattacttgcatatggcataaccaagtccaaatgaccaggaggagttaaaacaagtggggcaaagaaacgtaccatgtaattgccaaccaaggcatttaaggagataaactgataaaacaaacaactcatggaaaaaaatacaaaagatacgaaactttatgctcctaaagcttcaacctggtgcaaggaaggagagacaaggccacagtgataggagcactgtaatacatttattccagacaagtctgatacagcattaggtagggatagaaactatttgaattaataggaaaacctaaygttcaaacccaacagccagaacacgtgaccttgtcaagcacacacgggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccg

SEQ ID NO: 91855 - DNA, 601 bp, Human
cccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatgcccggagcccttctgtacttcaccagcactgaggggtgatttgcgagaatgagaattgtagaaacaagtatgattagactagagaagagaaaacctgggactgagtctgcaacctcgggagcatcgtgggatggtgygggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaaggcaggtgcagtgagcaggcgtgggtcctgagggcaggtgcagtgggcaggcgtgggccctgagggtgggttcagtgggcaggtgtgggccc

SEQ ID NO: 91856 - DNA, 601 bp, Human
agctccatacccccagcagccatccaatcccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatgcccggagcccttctgtacttcaccagcactgaggggtgatttgcgagaatgagaattgtagaaacaagtatgattagactagagaagagaaaacctgggactgagtctrcaacctcgggagcatcgtgggatggtgcgggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaaggcaggtgcagtgagcaggcgtgggtcctgagggcaggtgcagtgggcaggcgtgggccctgag

SEQ ID NO: 91857 - DNA, 601 bp, Human
ccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatgcccggagcccttctgtacttcaccagcactgaggggtgatttgcgrgaatgagaattgtagaaacaagtatgattagactagagaagagaaaacctgggactgagtctgcaacctcgggagcatcgtgggatggtgcgggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaag

SEQ ID NO: 91858 - DNA, 601 bp, Human
ccacagtgccacagtgcacagggcacgtgggcaagggctgcaactgccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgacttggacaagccacaccaccagagaggaggagtgggcacgcgcccaggcctctgagtccaacgttgtccacatrcccggagcccttctgtacttcaccagcactgaggggtgatttgcgagaatgagaattgtagaaacaagtatgattagactagagaagagaaaacctgggactgagtctgcaacctcgggagcatcgtgggatggtgcgggctctgagggtgggtacagtgggcaggtgtgggctctgtgggcaggtgcagtgggcaggcacaggctctgtgggcaggtgtgggctctgaaggcaggtgcagtgggcaggcgtgggccctgagggtgggttcagtgggcacgtgtgggccctgagggcggg

SEQ ID NO: 91859 - DNA, 601 bp, Human
aggggaggcagcagttctgtccagggaattccatcaggggaacgggtgggtcacagtagccacgggctcatccacagtgccacagtgcacagggcacgtgggcaagggctgcaactgccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgactyggacaagccacaccaccagagaggaggagtgggcacgcgcccaggcctctgagtccaacgttgtccacatgcccggagcccttctgtacttcaccagcactgaggggtgatttgcgagaatgagaattgtagaaacaagtatgattagactagagaagagaaaacctgggactgagtctgcaacctcgggagcatcgtgggatggtgcgggctctgagggtgggtacagtgggcaggtgtgggctctgtgggcaggtgcagtgggcaggcacaggctctgtgggcaggtgtgggctctga

SEQ ID NO: 91860 - DNA, 601 bp, Human
tggtgctcaggctggacaggacaaggggagaagccctaagagcagggggatctgcaatgccctcagacctggggcaacaggagctctggcccagcccccctcctgtcctcctctgtcccaacaagacccggcagtcaggctgaagccccagcttgtcaatcacgagtgccacctcagttttccccacaataagattgaccctgaccctgtcaatcacgagtgccacctcagtttttcccacattgggcttaacccaggccatgaagagactctgaccacatgctggcccttgcagacctgytccccaaatagagccttgctatagggagctctggccagtgggcctggcgtggtcctgagtcgtcttcctagtgatccctttgaagtcaaccttggccttgggcctgcccacctgcactggttgcctacctggtctaacagcccctgttccacttggtccctccaaggcagaagagggctatttgctgctctcccctcctcccctgggagctccctgtgtagcccagccctgctgagctgtggtgactgggagctcacacagcctctgctgtatccctcggcactcaccccgcctggatga

SEQ ID NO: 91861 - DNA, 601 bp, Human
ccaacgaacagagacagctcaccttcagaatcaccttgggaaggagagtgatggcaatttccataggaaaactcttcctccctggggaacaggccgggcgttaccctctgcccttgtcaaactaggggtcacacacgggcggtgccctcggcaaaaccagaccacagaggcactcgttgaggtcacgtggtgccatctggttgatagtatttgaaaactgggagatttcatgttttaaaaatctagaacatccagcttctcttgaggaattaagagatggggccaccccaggggtagccckggtctgtgaattgaggggccacacctggagacaaaacacacagggcttggctcaccaggccacctgcctgccactgtcaatgtcattctggcaccagaaggtatcacagtatgtcctcctggccctaaccccagagtccccatgcagggacccctccagacattccccgtaggagggcatgggtgccgcatcgggacagagctgggctggggcacgtcttgaggctgcttctgccgagcaggcagagtttttaactaaactgtgtgttgcaagcccattaaaaacagcaaaggtttctaa

SEQ ID NO: 91862 - DNA, 601 bp, Human
ggcggtggccaggccccgaggcccctgcagctgagggagaccagcgtccctgctgcaccacctctctacaaagagtcttccagaacaacacttttcacccccaacgcctctctcctgctgcctcttccaggcagggacaggcactccctccctgtgagggtggcccaggacaggccctggaggcagaacaaggcccctgcaggcggcacggccactcggacagtgaggcagcctggtaccaggccctcatcccggcacacgcttcctcacccagtgctgacagcaggccactcggtggacrtggccatttccgttttacagatggggagacccatggcatcccagcatggccgactctcggccagaagctctctccttgcaccctgcagcctggctcagacaagacagactgaacatgaagtttcaggcacaaacctgcagcccggctgtgggcaagaccaagacagacagtggaggtgcgaggcggagggtgagggctgggaaagagaagaggagtaagtggggccagggctgagcagctgctggggttccagtaccttcgggggtccttgtgccacccccagctccacagttctgtgtc

SEQ ID NO: 91863 - DNA, 601 bp, Human
gtctgccttatggagcccagggctggcattcagccatggagaggtcgggaacctcagcccgcactgcctgacgctggagtgggcagagccacccttgcccgcactgcccgacgctggagtgggtagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcraggccccacatctctgggccaggtcccgggccccctccccaggtgaacggtaccgcctctggcctgattgaattgtgcagagaccaagatgaacccctctgtggcagctccgctgcagtcggccctgggcaggcactgacctcctgcccccagggtgtgcccctggccacttggggctgccatcctggggagtctgccccggatatcgtccctgccttctgtgcagtgctgtctctgctgtgttctgtgtcctgcgggcctggagaccaccctggaccaggcttcagttcccagccctcc

SEQ ID NO: 91864 - DNA, 601 bp, Human
cagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccacccttgcccgcactgcccgacgctggagtgggyagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctctgtggcagctccgctgcagtcggc

SEQ ID NO: 91865 - DNA, 601 bp, Human
tgcagaggaagatggcagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccacccttgcccgcactgccygacgctggagtgggtagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctctgtggcagc

SEQ ID NO: 91866 - DNA, 601 bp, Human
aagcgaggtgcagaggaagatggcagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccacccttgcccrcactgcccgacgctggagtgggtagagcccttccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctct

SEQ ID NO: 91867 - DNA, 601 bp, Human; identical to SEQ ID NO: 40404

SEQ ID NO: 91868 - DNA, 601 bp, Human; identical to SEQ ID NO: 40405

SEQ ID NO: 91869 - DNA, 601 bp, Human
gaagctctgtcgcacagcagggctctggaaggtcaccctttctcagaagctcccacttgctcaatgcccctcctccccaagaccaccaaagggtccgacatagcttagatctgtcctcaggactctccgggcatgcagaggctctcagtgaggacgcagggcattcatcgtcagggcaatgccatgctccaggcacggccgcgccttatctccctcgcccacgctgcgctcttgcagtgggagctggggctcagatcagaggcagagaccccccgctgaccctccgccgccggtctcccaygccccgggactctctgccacgccccgccgcctctgcaggacacccccactgtgcccatgacaagcacactgtcaacacgtttgctgaatgaatcagtgctcacttctgtgcaacaggggacaacagacacggcccaaatactttctcaacttctgagacttgtctcctaaaacggtttctctgttgtgataaaactcatctcaatttaagaatttttaaatttctcatgcttttctagaaacgaaccttcccattattcaaaatagggggtacggctggatcactagggtttgaataaag

SEQ ID NO: 91870 - DNA, 601 bp, Human
ctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccaygttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggaggggagg

SEQ ID NO: 91871 - DNA, 601 bp, Human
ccctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggagggga

SEQ ID NO: 91872 - DNA, 601 bp, Human
caaccctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggagg

SEQ ID NO: 91873 - DNA, 601 bp, Human
cacgtctgtccttccatgcttttgctttcgctccagccacggggagccctgtgaccagctgggacttacaagaggagtgtgacaagccactggccaggccttagagggccacttggggttgtggttcgaggcccccatagcacccaagttcagagacagggcacggtaggcagatcctctgtgcacaggcccaaccctgccctgttcagcacagcagctgccagccacactgcggcttccatccaggtgaaaattaatccaaacaaagtactcttcggggtggctaccgtaaaaaagaaaraaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatact

SEQ ID NO: 91874 - DNA, 601 bp, Human
ccctcccccaaacctggaacaggcgatccctatcctacctcttcccacatccttccgttgtcgtgagcctctgctcccgtgatatctccagtgcaccagcccctgagctgtagaaagtggcctgccttcccctacccttcttccttctccatctcctaactattttatttctttcattgcatttgtcattatttgaaatgatcctgtttgtttttcacttcagtatcgtctgtgcctcccttcccagaatgcaaggtagcagggttacgtcctgtcatgctcacagctgcaccccttgccwgacatataatagacgccccataaacaccggcccccgtatgaacggcagccaggggcaccagacagaggaggatggctatgccgagaatccaccccatctcagcagctgaacacaatacaccgcacaccgtgtttccttactcacaccatggcgcggggtgggtcgggagggcccgagcctatgttgcagctgtacctactgggacacatggcttccaaggtttccgtggcaggggagacagagatggaggggactccaagctcttaccagccttggtccacaggtgacccaggtcacttc

SEQ ID NO: 91875 - DNA, 601 bp, Human
aaaccaaagagcccctttctgtgcccaggtggcctcatgaagtgctccatttccaagccgcttcccttctggcaagtctgagatgaaaagggcagcttcatctttcccatagaaaagggaatatcacgtcttgtctttaacatagacaggaagcagcccctccagtgatttccactgctcccggagccacaggcggctcccctccacctctggaagactgcggcggccggccttgccggccccgacttcccctacctgtgccccctgcttgacaggccaggctgcctccattcttccagcmggccccattcctgcctcagggccttggcgccgcctgccccctcccccaaacctggaacaggcgatccctatcctacctcttcccacatccttccgttgtcgtgagcctctgctcccgtgatatctccagtgcaccagcccctgagctgtagaaagtggcctgccttcccctacccttcttccttctccatctcctaactattttatttctttcattgcatttgtcattatttgaaatgatcctgtttgtttttcacttcagtatcgtctgtgcctcccttcccagaatgcaaggtagcag

SEQ ID NO: 91876 - DNA, 601 bp, Human
ccctgtggtcacacacacaaaaatgtaggacatcaaaaactatcccaggcggaataaaacaaaaggtcaacaacaggactgggggaaatatttcccacacatgtgacagacaaaaagtttatctacttaagtacacagactcttcagatgaataaaacacccccaaatcccagcagaatcaagggcatgaataggccaagcaaaaaaataaaataatctctgtttacaaatacacgtatatttttaaatgcaggctcattaacatcaaggaaataacaacttacaacaaaaaaacttatcwccgttgtaattaaattaccactgctcaaaaggactcagtggtgtgaggaggtggggagacagtcatttgctcaatgaagcgggaatagatgaaaccataacagagaacattccagtgtagaaagcttaaaaaatgggcatatctgttggccagagacttcgctttcagcaactcagcttaaggaaataagtaagcacgagcgatagattcaactctatgaacgtgatacagttagtggcatgtctgacctctaatggagaaataagttttgctatgtgaatatgtcatataaataataag

SEQ ID NO: 91877 - DNA, 601 bp, Human
ctcggcttatttttgtatttttagtagagatgaggttttgtcatgttggccaggctcgtctcgaactcttgacctcaagtgatccgcccgccttggcctcccaaagtcctaggattacaggtgtgagccactgcactaagcctatctttcctcttactttgggagaaattcaggtggagggctgctatggctaaacccaagaacagtcagcggttggtgaggaactggagcttgggaagtacagctgccaagtagggcagaaactcagaagattaacttctggggagggcaggaggcatcmaacacatcacccaagggagaagcttttcccctgggaagggaaagactgcaggatctttccctgtggtcacacacacaaaaatgtaggacatcaaaaactatcccaggcggaataaaacaaaaggtcaacaacaggactgggggaaatatttcccacacatgtgacagacaaaaagtttatctacttaagtacacagactcttcagatgaataaaacacccccaaatcccagcagaatcaagggcatgaataggccaagcaaaaaaataaaataatctctgtttacaaatacacgtatatt

SEQ ID NO: 91878 - DNA, 601 bp, Human
tcagggcaggcgtggtggtggccatcccgcccacggctggcaggaaaggggcatgtctggtggatggctggccagagcccgtgtttcggcagaggtgagcctcccgtgagtgacacctgcatagagatgggattggccgtggccatacgctctgggctggagcagtgcaccagtaggaagggggcgtgcctggctctacttccccagacgccctggccagggcacagccaatgtgttcttccaggggtggcaggaagctctcagaccccagtgggtgtgcccttcctgctgggggtgcacycactctgctaggaccccgtacctgaggagcctcccctcggcaggattccactctgtgaaatcctctcttcttcctcccagcctccctgagtctggctgtgcctgtcataaacttctggtcagcctgaggcacccatcagggatcagccacaaaatacacatttgtttaatttcagtgaccccacatagaagctaaatgctctaatatttgcatttaaaatagccatcgcacaatttaaagatgaataagaaattcatgctaataattcaaggttccaatttttgttcacttagaacaata

SEQ ID NO: 91879 - DNA, 601 bp, Human
cgagatcatgccattgcactccagcccgggcgacagagcaagactctatctcaaggaaaaaaaaaaaaaaacaaaactcactgcagagagcctctgtggacaagggcccgccccctgcctgccacaggctcagcacacacccagtgccctcttagcacggctggcttcgcctgggcctcagaggtgtgtggacatgcccaagcagaggctggggaaaggccacagagaacgggagtctgaggtggcatccagggggcacatgcagggcagcaggtgttccctcaggctatggggtctgagygcagggctcaggtttctgggctcgccctagggacaggctgacttcatagatgaccagggcctatcctcagaaggccccgaccttggggcttgaccctctgcagctctgtcttgaagttcttcgtcatctcacccttgcatgtgtgttttgtaagtgaaggctcctggggcaatgcagcatggtcccatctccccaggacaggctttcagctgcccccagcaggggcaggatcaggcatgtattccccacggcatctcagggcaggcgtggtggtggccatcccgcccacggctggcagga

SEQ ID NO: 91880 - DNA, 601 bp, Human
gcatagcatgaacctgtctctaaaacaaatctttaaaaaatgagtcaggcatggtggtgtgtgcctgtagtcccagctgcttgggaggctgaagtttgaggctgcagtgagctatgattgcagcactacgctccagcctgggtgactgagtgagaccctgtctcaaaaaagaaaaaaatgcatatataaacatattacttccacaacggctctgatcttccaaggcattcatccctgcctcccatttacctgagcctgcagaagagtccctgtctgtacctggggacgaaacttgaggtgycacacacatctgagctgcctcctagcatggcagcctcgcctgtcaggcccaagcccactctttaggggtgcccaggcccacacacatggccacagcatctggtttgtgagcagagactagcccaggcgctggcagagcaagtttttgaaaatgtgagaaataccaaagccccagggtcagtatcaggcatgttcagcaatgtcacctgtgtcccagcctggcagcacccagtacttcagggagtatgtttcccaagcaggaaaggtcaaacatgacagtggtctcccaatgccctcgggg

SEQ ID NO: 91881 - DNA, 601 bp, Human
atagaaagcataagccccaaacctcctaagagagaggagtctatctttgtagaccacaaatcaacctcgctcccgctctccaagccccacaagctccagcagggcccaatctgcgcactgcgattcacgatgcggccaggcctttgcgcgcgctgtgccaccaccaggagtcctcattagaggcaactgcggtggcccttgtccgaggagccttccctgaccagccgccccaggcacccttccctgatgaaccaaggtgtaatcacgtgtcctgatcccgctccccatactcctgtgctcygagctcccccagtgcagggatgcggaggccaggagtccagggagtgccgaacatgactgaggacagctcccaatcccagcatgctcctcccacacccgtgctctactgagcactttcctggtgttcaactcgagtggtgctcccaacagccccgggagttggcactgaccagcacagggcgcagcaggacaggcagtcgcctccttccttctaggctggaaagaacactcaggccacccacacaccagacttgtcctgcagccgtgttctgcttcacctgtgcagtgtggcttcttaatt

SEQ ID NO: 91882 - DNA, 601 bp, Human
gttccccacctgctcaccatcactggtctgtcggcctccccagccctgctggaacatgtgctccctgcggtctggatcccgtgctcaccacgacatccccagcacctagggctgctctatccgggtgcactaagggagtgagtgggcaggcgggtgggcctcagaacaggaggacacagtagatctatgcagaagccaaggcaaagcaagaggcagagcggatggcctgcggggagaggcgggtgtggccaggggactccaaatgctgtggggaggtcagtgaggcctgagatgagaaccygcggagcatgctaggggatttgggagctctcgatcttcaggccagacagtaggggaggaccagcacaggggccaccttcccacaggtatgtgactccatctgccgtgctctggccatgtctctctcagtctcagtgacctgatgcaggcaagggaacctcacagggccactggggcaaggtagtgaggtcacaggtgtgcctccttgcacagggccagcacgtgcaaaaccagcaaatgtgagttcccctcctcaggtggggaggggtgtttccaaggatagaaagcataagccccaaac

SEQ ID NO: 91883 - DNA, 601 bp, Human
tggtggggagggtgctgcacatttcaggaggaagcagaggtgagatccacccacaagacccctgttcgagtgttccccacctgctcaccatcactggtctgtcggcctccccagccctgctggaacatgtgctccctgcggtctggatcccgtgctcaccacgacatccccagcacctagggctgctctatccgggtgcactaagggagtgagtgggcaggcgggtgggcctcagaacaggaggacacagtagatctatgcagaagccaaggcaaagcaagaggcagagcggatggcctgyggggagaggcgggtgtggccaggggactccaaatgctgtggggaggtcagtgaggcctgagatgagaacccgcggagcatgctaggggatttgggagctctcgatcttcaggccagacagtaggggaggaccagcacaggggccaccttcccacaggtatgtgactccatctgccgtgctctggccatgtctctctcagtctcagtgacctgatgcaggcaagggaacctcacagggccactggggcaaggtagtgaggtcacaggtgtgcctccttgcacagggccagcacgtgcaaaa

SEQ ID NO: 91884 - DNA, 601 bp, Human
agagattgagaggctcacataagtgggcatgggagtcagtacagaggctctgaggagcaatttggcaaacctgctgcaactagaaactgtatcccgggacctggccattcagacgtcagcatggacgatggagacacagcctctgtcatagaagcgaaggcataaggacacccagccacgaggagttccacacccacagatagagttcatttttatgggagtctctgagatcacagtcgctttatgggaattcatttagtcacttattcattcaaaagagatttactgagcacctactacrtgccaggccttttccaggtactcagtgaaaaatcaggtgggcagaccctctctgggtccgatacaaagtcacctttgtgggagtccctaaccctgctgagacacaccaccaaggagacccctggactggggaggaagacccaggattgcttgactgcaactcagctccaggggcagcctgggaggggcctcagggagtgagagcccacgccaggtcagcccgacagcccggcgtggcacatcatcgcctctgttcttgtggttcagctgtcacctccttgctggagcctgcacaagacaa

SEQ ID NO: 91885 - DNA, 601 bp, Human
acatcatgggccgagtgaacaactgctcgcctcgctggtcggctctgatcttctccgcctacgccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaacctgctgcaactagaaactgtatcccgggacctggccattcagacgtcagcatggacgatggagacacagcctctgycatagaagcgaaggcataaggacacccagccacgaggagttccacacccacagatagagttcatttttatgggagtctctgagatcacagtcgctttatgggaattcatttagtcacttattcattcaaaagagatttactgagcacctactacgtgccaggccttttccaggtactcagtgaaaaatcaggtgggcagaccctctctgggtccgatacaaagtcacctttgtgggagtccctaaccctgctgagacacaccaccaaggagacccctggactggggaggaagacccagga

SEQ ID NO: 91886 - DNA, 601 bp, Human
gcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcgctgtgccaaggcaagcaggtggcccccatgagaaaaaagcttgtccaggacgggagctggctggggctcttcccagacatcatgggccgagtgaacaactgctcgcctcgctggtcggctctgatcttctccgcctaygccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaacctgctgcaactagaaactgtatcccgggacctggccattcagacgtcagcatggacgatggagacacagcctctgtcatagaagcgaaggcataaggacacccagccacgaggagttccacacccacagatagagtt

SEQ ID NO: 91887 - DNA, 601 bp, Human
tgcattcttgctgatgcaacctgggtgctcagtactcccgtgtttccccaggcttcaggaccaaggccaagctcagccgcacgcgccttctcccaccccagcgggctcccagggtggccgagggctggcacctcttttgcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcrctgtgccaaggcaagcaggtggcccccatgagaaaaaagcttgtccaggacgggagctggctggggctcttcccagacatcatgggccgagtgaacaactgctcgcctcgctggtcggctctgatcttctccgcctacgccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaa

SEQ ID NO: 91888 - DNA, 601 bp, Human
ctgctcaggatcagaagggccagcatgggcagcccccaggccaggctccctgccaggcgcgggtgggaggtcttgcaggctgcagccaggtttccttcctcctgtctggctgcagggaagtttcccttgctctgaagtttcctcactctgtgaacattcccacggggcaccctatgctgcctcgggtgctgtcccatcctggtaacttcctggcaccatcgtgatctccagtcgccttcgtttgttagctgtctgtccgtctccactaggcagggactgttctgcattcttgctgatgcawcctgggtgctcagtactcccgtgtttccccaggcttcaggaccaaggccaagctcagccgcacgcgccttctcccaccccagcgggctcccagggtggccgagggctggcacctcttttgcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcgctgtgccaaggcaagcag

SEQ ID NO: 91889 - DNA, 601 bp, Human
catgcatgatgaggaagaagggagaggccctggcagagcaggtatgaacccctcagagactgagaaggcatgacagagggctgcaggccatcaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcgcctcttgggcttggmgggaaacggctttgcccttctgtgcagcaggtcacaatccccctgcaccaccagagtctgtttatgtggcttagctcccttgccagactctggcagatggaaagatagatgaaatcctgcccaccgctacacaggaaacccagaaccaaaggaagaggggccgaattattggaagcacaagggtccgtgatcacttctgctcaggatcagaagggccagcatgggcagcccccaggccaggctccctgccaggcgcgggtgggaggtcttgcaggctgcagccaggtttccttcctcctg

SEQ ID NO: 91890 - DNA, 601 bp, Human
tactccccaggcatccatgcatgatgaggaagaagggagaggccctggcagagcaggtatgaacccctcagagactgagaaggcatgacagagggctgcaggccatcaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcrcctcttgggcttggcgggaaacggctttgcccttctgtgcagcaggtcacaatccccctgcaccaccagagtctgtttatgtggcttagctcccttgccagactctggcagatggaaagatagatgaaatcctgcccaccgctacacaggaaacccagaaccaaaggaagaggggccgaattattggaagcacaagggtccgtgatcacttctgctcaggatcagaagggccagcatgggcagcccccaggccaggctccctgccaggcgcgggtgggaggtcttgcaggctgcagccag

SEQ ID NO: 91891 - DNA, 601 bp, Human
tgtgtgggatgcagcagctcctgctggtgagggccagggcgtgggtagctggcactggctggcagaggctgtagagtggacacccatcaaggcatagggcttggactgggcaggggtccagcatgcctaagtggcccaggcgtcagacccgaccacctcagagcaaagctgaggaggactcaggccagcctccctactccccaggcatccatgcatgatgaggaagaagggagaggccctggcagagcaggtatgaacccctcagagactgagaaggcatgacagagggctgcaggccatyaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcgcctcttgggcttggcgggaaacggctttgcccttctgtgcagcaggtcacaatccccctgcaccaccagagtctgtttatgtggcttagctcccttgccagactct

SEQ ID NO: 91892 - DNA, 601 bp, Human
ggggcagcaagcagctgccggggtggggggcgggctgctgagcccacaccaggcttggagccggagccctatccctaccgctgcccccgccttagggtgagatgcagatagtccccggggttctgggctccacttcccactgagatgagaccctctgctgagggtggaggccaacccacatggtggccaagcaggtggttagaatggagagggatctcatgttaatgaatgggcctcaggcagcacatggatgcccctcgctccagaagggggtgtgtgggatgcagcagctcctgctggygagggccagggcgtgggtagctggcactggctggcagaggctgtagagtggacacccatcaaggcatagggcttggactgggcaggggtccagcatgcctaagtggcccaggcgtcagacccgaccacctcagagcaaagctgaggaggactcaggccagcctccctactccccaggcatccatgcatgatgaggaagaagggagaggccctggcagagcaggtatgaacccctcagagactgagaaggcatgacagagggctgcaggccatcaccttgcactgtgcccctcgacctggg

SEQ ID NO: 91893 - DNA, 601 bp, Human
tgggggtgatatggagagataatgggtgatgcttctcagggctgcttcgagcaggattaggggcagcatggaaacctagagtgggagagattaagctgaaggaagattttggggtaacaggtgatattatggggttgttagaaggagcatttgtcgtatagaatgattggtgatggcctggatgcagtttggtatgaattgagaaactaaacggaagacacagcgtccgaataaaaggagaaaaacaggtattaaaggactaagaattgggaggacccaggacatccaattagagagtgcycaagggggttcagcataattatttgcttggttggcgagtttttgggctctatccttgagtttatgttgtcatacaccaggccagactgatttaggtaaaaacaacacctaggtgattcaaaagctttattgctcacacaaagcctggtggtggtctcttcacacggacatgcgtgacaaaagtgaaatccccagcacctagtacaggctgaatgaaactgtcatcaaattacaggagggtccaacagcccaagctgtttccctgggaccccatgcacagaatggtccacctgggcttcgc

SEQ ID NO: 91894 - DNA, 601 bp, Human
ggggatatgatggcttagcttgggctcagaggcctgacattcctgtcttcttatattaataagaaaaacaaaatgaaatagtggtgaagtgttggggtggtgaaaatttttgggggtgatatggagagataatgggtgatgcttctcagggctgcttcgagcaggattaggggcagcatggaaacctagagtgggagagattaagctgaaggaagattttggggtaacaggtgatattatggggttgttagaaggagcatttgtcgtatagaatgattggtgatggcctggatgcagtttkgtatgaattgagaaactaaacggaagacacagcgtccgaataaaaggagaaaaacaggtattaaaggactaagaattgggaggacccaggacatccaattagagagtgcccaagggggttcagcataattatttgcttggttggcgagtttttgggctctatccttgagtttatgttgtcatacaccaggccagactgatttaggtaaaaacaacacctaggtgattcaaaagctttattgctcacacaaagcctggtggtggtctcttcacacggacatgcgtgacaaaagtgaaatcc

SEQ ID NO: 91895 - DNA, 601 bp, Human
tcaattgattgatcagctagggtggggcaggaacagatcacaatggtggaatgccatcagttaaggcaggaactatctattttcacttcttttgtggatcttcagttgtttcaggccatctggatgtatatgtgcaggtcacaggggatatgatggcttagcttgggctcagaggcctgacattcctgtcttcttatattaataagaaaaacaaaatgaaatagtggtgaagtgttggggtggtgaaaatttttgggggtgatatggagagataatgggtgatgcttctcagggctgcttygagcaggattaggggcagcatggaaacctagagtgggagagattaagctgaaggaagattttggggtaacaggtgatattatggggttgttagaaggagcatttgtcgtatagaatgattggtgatggcctggatgcagtttggtatgaattgagaaactaaacggaagacacagcgtccgaataaaaggagaaaaacaggtattaaaggactaagaattgggaggacccaggacatccaattagagagtgcccaagggggttcagcataattatttgcttggttggcgagtttttgggc

SEQ ID NO: 91896 - DNA, 601 bp, Human
tctctctctgttgcccaggttggagtgcagtggcatgatctcagctcactgccagctccacctcccaggttcatgccattctcttgcctcagcctcccgagtagctggggctacaggcgcccgccagtgcgcctggtttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgsgctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaaagtatcttctcaagggtggggagggtgtatcatacaaagtagattcacaagggcgggtccggcgggggcgggtggcaatatcacaaagtacattaccccaagggcggagagggtgtattgttcacaaattcaattg

SEQ ID NO: 91897 - DNA, 601 bp, Human
gggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggtttttttttttttttttttttttttttttagtagaggcagggtttcacaatgttagccaggatggtcttgatctcctgacytcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaaagtatcttctcaagggtggggagggtgtatcatacaaagtagattcacaagg

SEQ ID NO: 91898 - DNA, 601 bp, Human
tttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggtttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaa

SEQ ID NO: 91899 - DNA, 601 bp, Human
caaacaggctttgtgtgagcaataaagctttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggyttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatctt

SEQ ID NO: 91900 - DNA, 601 bp, Human
ccaaacaggctttgtgtgagcaataaagctttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctgctttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatct

SEQ ID NO: 91901 - DNA, 601 bp, Human
tgactcttgctcaaaatatcaaactaccatgaaacggaaatggccaggatcagaattactaggctcagttcatacatcaaaaagtgaggtggtcagagtcccctccttcaatacccagcgcaggaacactctgcccaaggccaccccctcactcctcaggcgacgtctcctgtgcctgtccacactctgctgatacctctgcagatgcctcagggtggggacggggctcctccacttccaggccagctcatcaatgcacagagcccagcagggtctcaagagatgtgctgcacccctcagkgtggcactccagcaggcacgttgagaagacaggtcgcattacaaaccttcccgggtttgtactaacgacggcaagaggctgcccctccccctctcctgaatttggggggttagcagagtgtgggggggatattcccactctgaggtcagatttcatgggtgccagcatgggctctgccacaatcctgctgcgtgacttggggccagttacttaacctgtctgggcctcagtttctttatctataaaatggagataataatagtccctgtgtctcagggttgtttcaggttgaagcaacaa

SEQ ID NO: 91902 - DNA, 601 bp, Human
atcatgagaatcaacgttcccattgcagatcttcttcaccctcggctcctcagcagatgcttcagagggaatgctagaagaaacgtgactcttgctcaaaatatcaaactaccatgaaacggaaatggccaggatcagaattactaggctcagttcatacatcaaaaagtgaggtggtcagagtcccctccttcaatacccagcgcaggaacactctgcccaaggccaccccctcactcctcaggcgacgtctcctgtgcctgtccacactctgctgatacctctgcagatgcctcagggyggggacggggctcctccacttccaggccagctcatcaatgcacagagcccagcagggtctcaagagatgtgctgcacccctcagtgtggcactccagcaggcacgttgagaagacaggtcgcattacaaaccttcccgggtttgtactaacgacggcaagaggctgcccctccccctctcctgaatttggggggttagcagagtgtgggggggatattcccactctgaggtcagatttcatgggtgccagcatgggctctgccacaatcctgctgcgtgacttggggccagttacttaac

SEQ ID NO: 91903 - DNA, 601 bp, Human
aaagatgcagccaagtttctgttctggaatagacaatgaggaaggagcggctctgcatggcaatgtaaagtttgcctcactggtggcagagttccacccaggggatggtgagccctgggaggtggcctgcggctgctgggcagaggtgactttgtcctctgccaaggtgggggaggggtgcagaaaggggggaaccggtgcaggctccctactggggaggcctactggcccgccagccacagaggagacaggcaggggccctggaacagcagccaccccaaccttcaggaaagttcccatrtccttcgctcagctgagctttgggccaccagaggcagcctgtggcccacctggcaaaaccatgtccaggagcaagccaggcctgaaaagtctgtcagaggcctgggggaggggggcctgctgctctgtggcttctctgggaccccctgaaataagtgaggagaaggctgttctctctgtgccccttcggaggccaggcttggaccaccaggatggaggcagagaagagagtgcagccaggagcaggggacagaggtctgctggcctccgtggaggaagagtttaggcattgcatggtgcc

SEQ ID NO: 91904 - DNA, 601 bp, Human
ggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattgatcctggaatctttaaaccttggggggaaatgttcaaagccgcagccatctctgtgcggagagaggccaagggctctcttgtttggggaaacacattgtaatgcgccttttgcttatgcaaagaygcagccaagtttctgttctggaatagacaatgaggaaggagcggctctgcatggcaatgtaaagtttgcctcactggtggcagagttccacccaggggatggtgagccctgggaggtggcctgcggctgctgggcagaggtgactttgtcctctgccaaggtgggggaggggtgcagaaaggggggaaccggtgcaggctccctactggggaggcctactggcccgccagccacagaggagacaggcaggggccctggaacagcagccaccccaaccttcaggaaagttcccatgtcctt

SEQ ID NO: 91905 - DNA, 601 bp, Human
tctccacctcaggaactttggacttgccgtgcaactgctcccagcagtgtctagcccatagtaggtgctcagtaaacatttgctgaatgaatggagtgaatcactttgaagatatggaataacaggaaatgggcaaaatgtatgacccagcgtaggcctgtgacccctctcatgggggaggcccccagctaagggcctcccctcccctccccccagcagccctgggggcctcctccgcatccaccctacccaaggcctgcgtgtgctggggagaagcagctctcctttcccaggttgcagrgggaggggaagcccagggacaatgtccttgagtactgtctgagaaattgatcctggaatctttaaaccttggggggaaatgttcaaagccgcagccatctctgtgcggagagaggccaagggctctcttgtttggggaaacacattgtaatgcgccttttgcttatgcaaagatgcagccaagtttctgttctggaatagacaatgaggaaggagcggctctgcatggcaatgtaaagtttgcctcactggtggcagagttccacccaggggatggtgagccctgggaggtggcctgcgg

SEQ ID NO: 91906 - DNA, 601 bp, Human
agactcatcctaaaaaatatatctcaaaggaaagaggcagtgacctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgtctagcccatagtaggtgctcagtaaacatttgctgaatgaatggartgaatcactttgaagatatggaataacaggaaatgggcaaaatgtatgacccagcgtaggcctgtgacccctctcatgggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattgatcctggaatctttaaaccttggggggaaatgttcaaagccgcagc

SEQ ID NO: 91907 - DNA, 601 bp, Human
tgcagcccctcaattctttagatatctcaggagcatttgaaaaaaaagactcatcctaaaaaatatatctcaaaggaaagaggcagtgacctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgyctagcccatagtaggtgctcagtaaacatttgctgaatgaatggagtgaatcactttgaagatatggaataacaggaaatgggcaaaatgtatgacccagcgtaggcctgtgacccctctcatgggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattg

SEQ ID NO: 91908 - DNA, 601 bp, Human
tctccagtgccttcggaagcagggcccagcccctcgcctggcattcggagccctctccacgctggccctggctggcttctccatgcgtcacttcagatacctccccacatggcacccttgctcctgacagcccagccagccttccccagagccggctgccctctcctgctgcctgtgctttggttcaggcctggaatcctcactctccctgtgcagcccctcaattctttagatatctcaggagcatttgaaaaaaaagactcatcctaaaaaatatatctcaaaggaaagaggcagtgasctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgtctagcccatagtaggtgctcagtaaacatttgctgaatgaatggagtgaatcactttgaagatatggaataacaggaaatgggcaaaat

SEQ ID NO: 91909 - DNA, 601 bp, Human
ctggggctccctggctgctgaggagctagagagggcatgcctgcaaatgctcccagcaggtagccagggagaaggaggccaggccgcagccaaggccccctcagccctccctccctggtagccttcaactgtggtgcgctctccctgatcctctccccaggaaacctctgtcccttcctcccttccacaccagcacagcacatagttccccaggcatgcccactctctgggaggcaggcctgagcaaggccgtggtggggcttgcgatggcctcctggctcctctgggtggctgctgggcytgggatcctgctccggagccctcaacttggccccctcccaggccaggtctcagcagcccctcccagcagtcaggaaccccatggggcactgtggcccagagaccactgaccactggcctgggtggttctcctgcccctgcgtgtgctatggcaaagtccaacccacagtccggggccgggctccttctgctgtccagcctctcagtccccgtaggttaatatgatacatcaggaacagacatggggggcaggcagggtttgtggggcatgtgagaggcaggggtgctccacagtgtcctt

SEQ ID NO: 91910 - DNA, 601 bp, Human
ccagggttggaagcagcgaggcaccttccaagcacagaggggatgtggaagggatgccccagcagaggaggtgggaggggagcactgaggccagaccacgaagtcaggagaaggattccaaatcctctctaagagcagtgggaggacatggaggaaggatgatggcggggcatttaagaagcttactccaggtgccttacggaaagtagatggaaggggtcaagatgtgggaatgtggggttcagctttggggatgagtgcagagaagggacggatgtgagggatgatgtggattggaatrggggtcatctgccccgcctgagcagggagaggctggggctctggaagggcattccggcagctcccacagggcggagggaggagatgcggggctggccctctcctggctcctggccaggccctgcccctcaggacgcaagatcttcccactctcctagccctacccctggggccgaaggtggcagctctcatctcaagaaggaatcttgtgtccttctgaacattgagcagatctaatcctgctccctgatttgggacaggaggtgaccaaccactccaaaagccccgtcgctgggcatgg

SEQ ID NO: 91911 - DNA, 601 bp, Human
ctcccacctctctttcctataggcaagggacaactcatcagacccacgggagcgtggctggtcaccgtggctccgggctgtaggcgtctggggagggtgggtcagcaacccctgtaggcgctgagggttatcctctagacccccagtgacccatctcgcccctgtggctgacaagatggagctccgaggagggcacccaggtccccaggaagccttgccatttggtcatcgccctccgtttcctctgtaaaatgaggattgcagtccccccatcacaaagctgttgtggggatgaaaccgycatgcaggtgcaatggaatggtgcttgtgcaaacaatgaaacggtttttcattgctggtaaaccatagtgccctgcagctccctgtgaggtcctgggggtagggtatgcacccctaaaccacagaagtccttgcccagctttgagggtcagactagattgtttagtccacgctggcacagtagccttaaaagccagtttttcttaagagagaaggggtttctgtaattgtccacagtattgctttctctatcacgacaaagcttggccagcttggctcatggagtctgaccgagggaagg

SEQ ID NO: 91912 - DNA, 601 bp, Human
ctgtgtgcagaccgagcccaggggctgctgacagctccggacatggccaagacatacttcccggagcctgctgccacgtcaggccagcacacactccctgcactccaatctgtagagcctgcatctgagcaacagtgattgctacctcaaaacagtgggaaggcacctcaggaaacccgagggttcacaaggagaatgacatcatgatggatgggtggacaggcatacagggcgtgcaagacaaggatcccgaggcccgctggcatcggtgctgggaacaaagatggcaccgatcgtgggrcagagttcatgacatgtggaccctgctgagggtaccatccagcccaaacgcagctcctcttggcaactgctgcccagcaaatctacatctgattgtaaatgggctccccacaactcccacctctctttcctataggcaagggacaactcatcagacccacgggagcgtggctggtcaccgtggctccgggctgtaggcgtctggggagggtgggtcagcaacccctgtaggcgctgagggttatcctctagacccccagtgacccatctcgcccctgtggctgacaagatggagctccga

SEQ ID NO: 91913 - DNA, 601 bp, Human
ccactcctcctcgaggccagctcagcagtcacttccccctggaaggccccccgcaggcctgagccgcccctcatcaagcacaaggtgtgttatttctggagccctctgtgtgcccctgtgggctgggcagccacctgcatcctccctgcttgcacgcccagagccaggctaagcagcacctggcaggcactcagggatacccgctgaaaggctgaagccattggcaccatcaagaagtggagaaacagggactggctgtgtgcagaccgagcccaggggctgctgacagctccggacatgkccaagacatacttcccggagcctgctgccacgtcaggccagcacacactccctgcactccaatctgtagagcctgcatctgagcaacagtgattgctacctcaaaacagtgggaaggcacctcaggaaacccgagggttcacaaggagaatgacatcatgatggatgggtggacaggcatacagggcgtgcaagacaaggatcccgaggcccgctggcatcggtgctgggaacaaagatggcaccgatcgtggggcagagttcatgacatgtggaccctgctgagggtaccatccagccc

SEQ ID NO: 91914 - DNA, 601 bp, Human
gaaacagggaggcatcagcgggaaccacaggccctaggactggctctggctctgccaatgggatgacccccacctgctccttcttcttcccatgctttccacccaggcgtcaccatcaactaggagccaccttgtgacccctccctcattgccccctgccctctgcctctccaggctgccaccaccacctgctgggatcactgtagccccttcctgagcaaccccacccaccagcccagggtttcctcacctggggcctgaacatggaacgtgggcagggaaagcagccctacgcttgctrtagcctccagctgaaacacaaccttcccttcaacagtgaacgtgggtgatggacccccgcggcacaggcagggctgggaccggccctggcagaagtcactccaagctatagctggtgggtgtggggattacctacctgcatcgctacttggaaatgggggcggttctaggcccaccaccaggtataatgttttaacgtgttaataaaaagctcatattactgcatccccaatgtgctctccctgttctgttttgatggctggagctcctgcagtcgccgtctctgtatttatcacaatca

SEQ ID NO: 91915 - DNA, 601 bp, Human
gaggcaggcccggctggccacagtgcactcacctttccatagctcaggaggatgatccgcaccaggaccacgttgatgtgggcacccaaggactcgtcatggtagatttcattgacctgaaagaaacagggaggcatcagcgggaaccacaggccctaggactggctctggctctgccaatgggatgacccccacctgctccttcttcttcccatgctttccacccaggcgtcaccatcaactaggagccaccttgtgacccctccctcattgccccctgccctctgcctctccaggctgycaccaccacctgctgggatcactgtagccccttcctgagcaaccccacccaccagcccagggtttcctcacctggggcctgaacatggaacgtgggcagggaaagcagccctacgcttgctgtagcctccagctgaaacacaaccttcccttcaacagtgaacgtgggtgatggacccccgcggcacaggcagggctgggaccggccctggcagaagtcactccaagctatagctggtgggtgtggggattacctacctgcatcgctacttggaaatgggggcggttctaggcccaccac

SEQ ID NO: 91916 - DNA, 601 bp, Human
cctcattacccagaaaactaactcaggaccgctccactccccagagcccactggaattattcaaactggccaaccttaagccagctcaccctgtccccatcggtccttcctgcagaaacaacatggactcaggctgctgtttacccaattccctctgcctcctgaccacccctggtgcctccctgtgtggcccccgtggcctggtatgtctcttcctcttgggatctgggagtaacagactcttttcagtgaacaatagtaatggccacattttaaaacaaggggtgaaagggagcagggwtcttgtttcttataggaacctcaggggagccagggagaggcagggtggttctggcaaacgcacacactctccaaggaggcccatgcctcactcccaggcccctcactccgagggggtggaggcaggcccggctggccacagtgcactcacctttccatagctcaggaggatgatccgcaccaggaccacgttgatgtgggcacccaaggactcgtcatggtagatttcattgacctgaaagaaacagggaggcatcagcgggaaccacaggccctaggactggctctggctctgccaatg

SEQ ID NO: 91917 - DNA, 601 bp, Human
cgcccacctcagcctcccaagtagttgggactacaggcacatgccaccacacccggctaatttttgtatttttttggtagagacagggtttcaccacgttagctaggctggtctcaaactcctgacctcaagtgatctacccaccttggcctcccaaagtgctaggattacaggtgtgagcgaccatgcctggcccctagtaggttttttttttttttaatgttttcaaatgaattggatttttttaggtttataaattctgctgcccccacccctacttttaggcatttcatcagcgaasatggacaaaatcgttttagctgtataaaattcacaatattttctttatgacccaaaacacttctgtaatttttaagtgttctatgattcctcgaaaagaaggttcatctttctttttttctgtagggcaagggaaacagtgatataactactaatttagctttactcattgtgtcattcaaaaattctatgccttattagcatctaatctgtgaaaggcttttaaaagtgtattagagactctcatagttaggtttttgccaatttcccctttgttccaaggatttgttttgggatgttt

SEQ ID NO: 91918 - DNA, 601 bp, Human
tttccttgctctgttacccaggctggagcgcagtggtgtgatctcagctcactgcaacctctgcctcccgggttcaagcaattcgcccacctcagcctcccaagtagttgggactacaggcacatgccaccacacccggctaatttttgtatttttttggtagagacagggtttcaccacgttagctaggctggtctcaaactcctgacctcaagtgatctacccaccttggcctcccaaagtgctaggattacaggtgtgagcgaccatgcctggcccctagtaggttttttttttttttaatgttttcaaatgaattggatttttttaggtttataaattctgctgcccccacccctacttttaggcatttcatcagcgaacatggacaaaatcgttttagctgtataaaattcacaatattttctttatgacccaaaacacttctgtaatttttaagtgttctatgattcctcgaaaagaaggttcatctttctttttttctgtagggcaagggaaacagtgatataactactaatttagctttactcattgtgtcattcaaaaattctatgccttattagcatctaatctgtgaaag

SEQ ID NO: 91919 - DNA, 601 bp, Human
atttgttagaggatgagttttgtcatttggaaactgatgtgatgaactgtatgaatagatttcctgatattaaacaatctccacattcctaggataagccctagatgatcacggtagaagtttctctttatacattattcaattaaactcttaatgccttgggatttttacttctatttttagaagtgagacaggtctgtactttgtcctgacgggctacctttggcatctttgggtataagggtcccattgactacgaaagacacattgggtagatttcagaatacatgagtttacaggrtattgtattagtcttgcctgataaatgcttgcaaatgagtatgaatgcactggcaaaactttggaaaaggtgaagaacttgagttccctccatggttatgggacttatggcatattctccattttttggagtcagctttgaaatattcacatcccaggaaatcctcaatttccccaggatctccgtgtccctggcatagagatcctcaaattctcaccttcagggtttgactctcttctgcaaatgttctgactgtgatcacatactccttctacctacctgaggcagttaaggaaaaaa

SEQ ID NO: 91920 - DNA, 601 bp, Human
ccttctggaagcggtcccctgaggacagagactatgccagtgaatattcccagcacagcacttcccacacagaagcccttcaaacagtatttgttagaggatgagttttgtcatttggaaactgatgtgatgaactgtatgaatagatttcctgatattaaacaatctccacattcctaggataagccctagatgatcacggtagaagtttctctttatacattattcaattaaactcttaatgccttgggatttttacttctatttttagaagtgagacaggtctgtactttgtcctgaygggctacctttggcatctttgggtataagggtcccattgactacgaaagacacattgggtagatttcagaatacatgagtttacagggtattgtattagtcttgcctgataaatgcttgcaaatgagtatgaatgcactggcaaaactttggaaaaggtgaagaacttgagttccctccatggttatgggacttatggcatattctccattttttggagtcagctttgaaatattcacatcccaggaaatcctcaatttccccaggatctccgtgtccctggcatagagatcctcaaatt

SEQ ID NO: 91921 - DNA, 601 bp, Human
tgtgaggggctacggggccgtcacgcccttgccctgccagaggcttcaacactggagccctgaggcctctctcccaggctccccctaggcagcaagctcctcatgcctgcagttgcttctgctacccccagctccagaccccgcagggctccagacccacatccacatcttcttggcctcctccgctgggatggcaccaggtacctctaactgcacatctcagctgacctcttcagcttccctcctgtgctccccaatctcaggggttgataccatcatctacccagctgagagtctctcygccttcacccacctagtgccacatcctctcgaagtggcctcctctgtcctcctgtctgtatccctggacccaggcctggtcccagtccagctgccagcatcccccatttgatggcagtgactgtctcctaagccactgctcccacctgccccttctgcacacaggagccagtgatcttcttagaaatgcacatgggatcgtgtcactgcttaaagctgccctcatgggcaagccaaaccccttggcgggagacgcaggtctgctctgctccttgcgatcggctccttccgacgtctttgg

SEQ ID NO: 91922 - DNA, 601 bp, Human
actgctcggactctcggaggtacaccatgcacagctccacaggaaagtctccgggaaatttcacccccaggaatgcccattttcctttgtttgaccagcattttccagacttctttgaccttgggacccctctatagtcctctgtaacatctactcatatcctaagaattcgctgtgcagaacacttttagggaaatgtgcttctttttccgcctttaaatacaatcttggttgtcctgttgccctctgttactagttttctggggatctggaaaaggaggagtgccctgtgaggggctayggggccgtcacgcccttgccctgccagaggcttcaacactggagccctgaggcctctctcccaggctccccctaggcagcaagctcctcatgcctgcagttgcttctgctacccccagctccagaccccgcagggctccagacccacatccacatcttcttggcctcctccgctgggatggcaccaggtacctctaactgcacatctcagctgacctcttcagcttccctcctgtgctccccaatctcaggggttgataccatcatctacccagctgagagtctctccgccttcacccac

SEQ ID NO: 91923 - DNA, 601 bp, Human
ccattcccaactctgccaaaagtggaagtggggccccagcatggccccagtgaagcagagcttctgcaggtgcatgaggggtgggggtcccagcaaagcagaacttctgcaggcaaggcgcatgaggggcaggggccaaggaggccctggccaggagggtggtgcctgctaacccaggggcgtgggcttctcatgcaggggagaccacgtacctatggcagcctgcgtcctcactccaagatttcccatttccttcaggtggacccgctgcaggtggaccccctgccccagccacaggaarcgtgagctagcgcccatagggtggaacacagaaacctcattactcctccccagcccactgcagagatgacgtgccaagggaaagcatgaattctctttgatgtcttcattgaaatcagaaataaaggactgagcgtgacagagccctgtggcatgccaccggagacctttctccagagtgctgaattcagtcaaacggcatcatttggatcctaccatttttaaatgattttttaaaaaatcatttaaaaaatttaaatttcacaaatttaaaatgcagtgttttgtttataaaagaaac

SEQ ID NO: 91924 - DNA, 601 bp, Human
attcccggggtctgacagagggaccggctgtgtgttgtcctccaagctaggctgaggggcctgggaacaggcactggggtgtcctgggtcccacacccctcacaacccagcactgcctctcccctgcctcctcagctgcgggtccactgagccctcggggccgggggtaagctggttccatctggagttagctctggaagcgtgcgtccagcttccggttctgtcttccaatccctcaccaccatcagttctcaagccccttcccagcaggaggcggaagcaaggccagcctcagttcacytatgtcctctctgttctctttgtacctgggtcgcagaagttgcccggtgcccaccacaggcatgagctgccctggtttgctggctatggatctcagcacccccagggcctgcacatgtccccatgttgtccctgggaagagcaggctgcacctgacaaccggtcccctgcccactgccccattcccaactctgccaaaagtggaagtggggccccagcatggccccagtgaagcagagcttctgcaggtgcatgaggggtgggggtcccagcaaagcagaacttctgcaggcaaggcgca

SEQ ID NO: 91925 - DNA, 601 bp, Human
aaacagtcacttgcacgaacgcctttatgattgtcgtcattcctgttgtgtgctggggtttcacagacctcctcttatgggggaaactaaggccccatgatgttaaattgctcaccaaaggtcccacgagtatggacaaagccagaatgaatggcagggacaaggtcccaccatccctgctctgtgagcacatgttctaccgtgccccccagctgagtgcaaagtgggctcccccaaggctggaggtctcttgttccaggcagggcttacagatcaaatctcatcacgacagagaaccacragagctggggcaggaggcgtgcacctcatttctctgccagaactcccatatcgttccagcattttgtttccagccatcttccccaaagcctgggaagctattcccagagagagccaagctgccagaacaggattctcaacttgagccttcccaggcatgagccagtgcaggcctgtggggaggcagaagaggggcctcctgctagaatctgaatgttgtgtcccccacatttgaaaggttgaaagctgagaaccaatgttatggtattaggaagtgtggtctttgagaggtcattaggtc

SEQ ID NO: 91926 - DNA, 601 bp, Human
gccgcacccgggctcccggggccccagcggccccaagacagcctctgggcctcaccctaaatacatcaattatgacctgagcaaaaagttctgttccaatcgttgctctccgacatttccattgtttgctctggaaggagctgaattatctatgctcttccctccttcagtcaaggagacgtgggaggaaaccgggatggggatcagcagcctggaggccgcctccgctggaaccgcgcccgccccgccaggaggctctgcctgctgggcaaggcgcactcagccagccccgcaggccgcyacgcgaccgaggctcaccaagtccactgcaggtggcaggtgaggtcacctgggcagctctaggcccggccgaaatatctcatctgctctgttcttgggcaagttaccttacttgtccccacctgcaaaatgggcacaactgcagctccgagcttggagctggggggcttccgcccatgacagttcaggcagggtgcagtcagcgcccacaaatgtcccttgtccttgtctctgccgtgctgttgatactgatggagtataacaccagtccctggggactggcctacccgctggggctggc

SEQ ID NO: 91927 - DNA, 601 bp, Human
gacgagtaggctgcgtccagctccaagtcccagccccatcctggccgcgggaccctggctctgagctgcccgccgggtccctcctcctgcgtgcgatcggtcacctgccagatggggcacctactggggatgtgcctgttgctgtcgctggcctctgagtcactaaagcctaagctccttgagggccgggtggttgctgggcccgagtctgtgccccagccctggcccacgcctgccctcagtagccccactcctcccttcacggagcaatcccggcttctgctctccatgccaggatgasgcagcgaacgcggccagaggaccccggctgctgggcgctcagtgatgaaggaatgaacacgagcaccctcaggagccaggctgggcagggagggaggcgccggctgcggggacgttctcgggaggcctggggaagtgagcccaaagggccgccccggcagatgctgaccccagcaggaagtcaccgtccgcaaggagcgccccgctaggctcaggcttggcacacgacacctcgcttccacttcattttcctaccttccggatgacgaactgcgtctcagacaactgaaaggactcgcct

SEQ ID NO: 91928 - DNA, 601 bp, Human
ggagagggcagatctgagggccttagggaggcaagagcttgatggccctcaccttgggtcagaaggtcactttgctgaatgctccccagggctgtcaggaggcttggccagggcaagggtgaggaaacactgcgggcccctgaacctcaggcccagcctgcaggggtctgggtaaccccacgggcctcagggaacagccaggagcttagggggcccgtgggccttgggtggacgagtaggctgcgtccagctccaagtcccagccccatcctggccgcgggaccctggctctgagctgccygccgggtccctcctcctgcgtgcgatcggtcacctgccagatggggcacctactggggatgtgcctgttgctgtcgctggcctctgagtcactaaagcctaagctccttgagggccgggtggttgctgggcccgagtctgtgccccagccctggcccacgcctgccctcagtagccccactcctcccttcacggagcaatcccggcttctgctctccatgccaggatgaggcagcgaacgcggccagaggaccccggctgctgggcgctcagtgatgaaggaatgaacacgagcaccctc

SEQ ID NO: 91929 - DNA, 601 bp, Human
tgggctggccgtggacagggcaaggccctcgctactggaggcagtcggaacccaagggaagagccaagctcaggtctctccgctgagacctccagccaaggatactgtcctgacatgcagtgaactcccctgtgggtcacttgggctccagcgggaccacctgctgggatgcgacctcctttgctcctctgccacctggcctgcatgcaggaggccagatgggtccctgctgcctggggcaccccagcccccaccatcctgtgcccttgctatgtatcaagcctgggaactgtgcttcccytgagcgagaagaagacacatttctcatatatggatctcctccagaagtgagggaggctgcactgcttgtttccactgaggagtctttcaccagctcgccctggtcatctacgtccctcccagtcctgaatgcacctgacttccagctgcctgctcggctctgcacggctcctctaggaaagtctgtctgtgtgactccacctgttcctagctgtgctgagggggggaccaggagtgagccgtagcaccctgggctctgcaaagggggtggctgcaggaccagccagggactttacagggc

SEQ ID NO: 91930 - DNA, 601 bp, Human
ctgcttgtgcttcctctctctctctgccaacgtcccaacatctccaaggtcccagcctatctctgacgggcacagaggagcccaggggcagagatcttgtccttgctgggtctggagcattcaagggctatggggtacccatgaggcccagacattgaccttgtgcccagaggccagggcaaggtctgtgtgcattcttaaaacagccctttgggtcagtgaggaaggagtggggatagaaggggacagtgtggcactgagatgcatgcaggtgtggctggtgccacgtcaggagggtcargacctggtggcaggagctgagaggcatcagggctgcagggcgggagcaatgaggcagagacggcaccagtgtctggctttggggattggtagcaaggcagaagaggcggcgcgggaaggggacggcaagtgccagaggaagagcgtggggtccgcagtgcaggaaacatggtcacggcaatgtctttcctggccagcttgctcgttgggaagagctgggctgttttgctttgggagctctcccacttctgggggtgcagcccttgtgggtgatcagtcccaagccgtagctgggacccat

SEQ ID NO: 91931 - DNA, 601 bp, Human
gcaaacccaggtgcccaggcacagctgaagggagcaacatccgcccagtgctggcaggaacagaggcccagagctgctggatcagatttctcaggtcaatcgtgaaatctggattctacagacacctacctaatagtaaacactggctcaaattgaaatcagttatgcagacaaaacaacgcatcctccccgtcaccactttattccagaaccctggaataagagccctgcagtgggcagccccttctccacgtcctgcagactggatccactctggccgatcacctctctcctcccagaygctggcttctgtggttcagcctgggttcccagcccgtcttagcagccaaagtgatcttgctgctgcggcaagacaatttattgaaatattgatttgtgtttttgttcttgcctcgctttgttctcggcccagtccaagaaggcagcctgccactttcgttctccaaccccaaggaggttgtgctgcagggtccagagctaaaggggtctatgacccccttctggctttggggttctgaggagactccctgaggagggggcagaggggagggctggggtgcatgggcacagggaggggaag

SEQ ID NO: 91932 - DNA, 601 bp, Human
agacaacaagagaaggcacctcccctacagaagccacagtctgcttttgatagaatctcagtcccgcctaccgcagggcatggacattaagagactgggtcactggcggccatcacgaaggctgcctgccactgacgggtgtcatttatgcctgaagaagttcctctccttgtgaaagccaattctgagttgtgctcttgtcacttgcagcgaagagaatctgagccacgtgcttcctcctttgggggaccacagggaccccagtcaggacactcgctggcccatgaaagatggcgtctgrtctgggggcagctgatatgttctgggggcagtttatatgcttctcagtgggagaagggccctggccaagtctttgaggaggagtcaagagtccagccagaaagacatgccccaatatcaggaccagaggcaggaatgaggctagtgtgtaggacagagctgcgggaggagccaggctgaggcaggctgggggtgtgcagggaggtccgctatcctagtgtgtgggcttgtggggagtaccgggaggatgctagaaacccaagcgcctacaggagcaaggcaggtgacaagtcaatgaggc

SEQ ID NO: 91933 - DNA, 601 bp, Human
gagaaccgagagcccctctgagtcctgggcatgttcttttcccctttaaggatttatctggccataaaatagagatgtgcattccttggaagctacgtatgcaggtgttttttctcttgcataaatgtatccacaaagtagagccacgtatttctctttgtgtctataaataacaaaaagttggccgtgcgcggtggctcacacctgtaatcccagcactttgggaggctgaggcaggtggatcacctgaggtcaggagtttgagaccagcctggccaacatggtgaaaccctgtctctaytaaaaatgcaaaacttagtctggcttggtggcgtaatcccagcaacctgggaggctgaggaaggagaatcgcttgaacccgggaggtggaggttgcagtgagctgagatcacgccactgcactccagcctaggcgacagagtgagactccgtctcaaaacaaaacaaaacaaacaacaaagggtattgttagcaagccagttagttccagaagaagggagcacaattcaaggctaggtaagacaagtcgttcccaggggtcccagtcaatgactgacaagatggcagaccaattcccaag

SEQ ID NO: 91934 - DNA, 601 bp, Human; identical to SEQ ID NO: 40406

SEQ ID NO: 91935 - DNA, 601 bp, Human; identical to SEQ ID NO: 40407

SEQ ID NO: 91936 - DNA, 601 bp, Human; identical to SEQ ID NO: 40408

SEQ ID NO: 91937 - DNA, 601 bp, Human; identical to SEQ ID NO: 40409

SEQ ID NO: 91938 - DNA, 601 bp, Human; identical to SEQ ID NO: 40410

SEQ ID NO: 91939 - DNA, 601 bp, Human; identical to SEQ ID NO: 40411

SEQ ID NO: 91940 - DNA, 601 bp, Human; identical to SEQ ID NO: 40412

SEQ ID NO: 91941 - DNA, 601 bp, Human; identical to SEQ ID NO: 40413

SEQ ID NO: 91942 - DNA, 601 bp, Human; identical to SEQ ID NO: 40414

SEQ ID NO: 91943 - DNA, 601 bp, Human; identical to SEQ ID NO: 40415

SEQ ID NO: 91944 - DNA, 601 bp, Human; identical to SEQ ID NO: 40416

SEQ ID NO: 91945 - DNA, 601 bp, Human; identical to SEQ ID NO: 40417

SEQ ID NO: 91946 - DNA, 601 bp, Human; identical to SEQ ID NO: 40418

SEQ ID NO: 91947 - DNA, 601 bp, Human; identical to SEQ ID NO: 40419

SEQ ID NO: 91948 - DNA, 601 bp, Human
aaagtagttttcagaaaaataaagtgttaccctaggtcaaatgaaataaccaaagtaaatgtgtaaacagaaagctcagaacttcttagaggacaaaaatacattatcatgtcagacgatcaatgcaatcaaattcatcatagcttatattttaattataatagcccagcctgtactgccagacaactcaccttccactattcgtccatatttgccaaatactgcttcaagagctttctcatttgtttccgtattaagcccaccaatgaagagctttcctgggcgatctgcttcaaccatktttttttttttttgggccggtgagtctgttgaaaaggaatagtattacctcactgcaaaaagttcctcaagtttattggacacttttactttcgcacatttctcatattttccactaaaaccattgttccttaataactaaagaaaacgataacgagctaagcctcagccacagtaggaagcaatttgaactaagtagtttagtaacactgcaatttacataaaactggttaaaagggccaacttaacttttaccactacccttgatcacccttagctgttcttaagcaacagctgctta

SEQ ID NO: 91949 - DNA, 601 bp, Human; identical to SEQ ID NO: 91948

SEQ ID NO: 91950 - DNA, 601 bp, Human
gacacttttattgaagaacaacaactagaagaagagaagctattggaaagagagagggaaagattacatgaggagtggttgctgagggagcagaaggcacaagaagaattcagaataaagaaggaaaaggaagaggcggctaaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatrgtaccacatggcaaaacccagaaccacccgtggatttcagagtaatggagaaggatcgagctaattgtcccttctacagtaaaacaggagcttgcagatttggagacagatgttcacgtaaacataatttcccaacatctagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacg

SEQ ID NO: 91951 - DNA, 601 bp, Human
taaaaaatggctagaagaacaagagagaaagttaaaggaacaatggaaagaacagcagaggaaagagagagaagaggaggagcagaaacaacaggagaagaaagaaaaagaggaagctgtgcagaagatgctggatcaggctgaaaatgatttagaaaatagtaccacatggcaaaacccagaaccacccgtggatttcagagtaatggagaaggatcgagctaattgtcccttctacagtaaaacaggagcttgcagatttggagacagatgttcacgtaaacataatttcccaacatcyagtcctacccttcttattaagagcatgtttacaacgtttggaatggagcagtgcaggagggatgactatgaccctgacgcaagcctggagtacagcgaggaagaaacctaccaacagttcctagatttctatgaggatgtgttgcccgagttcaagaacgtggggaaagtgattcagttcaaggtcagctgcaatttggaacctcacctgaggggcaatgtatatgttcagtaccagtcggaagaagaatgccaagcagccctttctctgtttaacggacgatggtatgcaggacgacag

SEQ ID NO: 91952 - DNA, 601 bp, Human
caacccacattaggggttcatgaccattgtatagacagctgtagccagctgttcacagcccagacagacttgccctatctagacagccccctcctcccagctcagggactcgtctggctgtgagcttccaggaggtctcaggggtgtgacctccctccctccttccctccccactccctacctcctccctccaccccaggctataaagctgcccaggcttggctctcagcacatccagctgcctgagaccctcctgcagccttctcaagggacagccccactctgcctcttgctcctccarggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgaggtgaggccctccctccctgctgcccctggtcccatggggca

SEQ ID NO: 91953 - DNA, 601 bp, Human
catcttgctgtgctgacgccttcccaacacaacttcaaaaacaagaggaaaaccgtgtcctcaaactaggagtccctttactcacccgtaatgaaaataaaccaaagtccgtcttcatttgccctgaaatccaacttcctttccaaattatcctcattgcataagcccttctaagcaatgtttatcagcagtcaaagcaaaaccatgtggatctacagtttggttcccacagatcccaacactgccttcaatccataattaccaagaacaagcggcaaacaggagtttccatcagtaccasttagaccccatgaccggaggccctctcagagagcaatgggagattaaaacagtatcttttgatcaaaagcagtaatgtttccccccatgacgcccttgaaaatgaaactcccaccttacccttcattccaaatttggaccgtcgaccatatttgttgatcatgacgaagagaaccaccaacaggacacaggcaaaagcagcaagtccaactgctatggatacctgtgaggaaccagaaacagagagtcagcaacaatcacagaaaacccaatttccttgaaaataatgtgtgtgcccaga

SEQ ID NO: 91954 - DNA, 601 bp, Human
ttaacccctttcatgccagtccccttacccgagccttggcaaagagccatatcccaccaccccaccctgccacagtggagtggagcactgtatgtcatggaagccagccagcagatttagaaatcatgttgctcttggcatccactctgggactctgtgtagagctacgtgctgagatcccattgcatgggcagcttttcaatgccggagtctaccctacatcttgctgtgctgacgccttcccaacacaacttcaaaaacaagaggaaaaccgtgtcctcaaactaggagtccctttacycacccgtaatgaaaataaaccaaagtccgtcttcatttgccctgaaatccaacttcctttccaaattatcctcattgcataagcccttctaagcaatgtttatcagcagtcaaagcaaaaccatgtggatctacagtttggttcccacagatcccaacactgccttcaatccataattaccaagaacaagcggcaaacaggagtttccatcagtaccagttagaccccatgaccggaggccctctcagagagcaatgggagattaaaacagtatcttttgatcaaaagcagtaatgtttc

SEQ ID NO: 91955 - DNA, 601 bp, Human
tctgagaccaggcaggtggatgctaattcaccatgttaacccctttcatgccagtccccttacccgagccttggcaaagagccatatcccaccaccccaccctgccacagtggagtggagcactgtatgtcatggaagccagccagcagatttagaaatcatgttgctcttggcatccactctgggactctgtgtagagctacgtgctgagatcccattgcatgggcagcttttcaatgccggagtctaccctacatcttgctgtgctgacgccttcccaacacaacttcaaaaacaagargaaaaccgtgtcctcaaactaggagtccctttactcacccgtaatgaaaataaaccaaagtccgtcttcatttgccctgaaatccaacttcctttccaaattatcctcattgcataagcccttctaagcaatgtttatcagcagtcaaagcaaaaccatgtggatctacagtttggttcccacagatcccaacactgccttcaatccataattaccaagaacaagcggcaaacaggagtttccatcagtaccagttagaccccatgaccggaggccctctcagagagcaatgggagatta

SEQ ID NO: 91956 - DNA, 601 bp, Human
ggatgacaattaataggaaaaatctgctcttacagcactgccaagcatgtcgcagggtctcagctggtggtgcgcctcctcaggggaagagcaacaatgccccattcttccctttggtcaaggccctgatgttttctcaggtggaaggaggaagagctataaaagctccctgcatggtaggaaaactttgcacaggcaataatagtgccagtcctcaaaaccaggagcccaagaattatccaaagattgaaagctgtgcgctcactcagtggtcgtctcatcttctagatctagaaagccytgtttggcatgttgtgtttgcagataagacatctccaatctaggtgcctaaaagtggtctgattttgtttaagtcatctggattccagccaaacttccatccacctttataatttgcctgcacatgtctttctcttggtcaaaatatctcagatgacttaagaaaaactagcttgctttgctgtgagttgatcaggttcatcaagagcagagagtgcaaaggcagaaatcttctggaaacagggcaccctgtacccattttttgtttgttgtttgtttttgagacagggtctttctttgt

SEQ ID NO: 91957 - DNA, 601 bp, Human
caggggctgggagaagctctgaggacagctgaggggaggaaccaccctgggtgctgcctaatccatccgacatggggacatgctgttccagaaacaggatgacaattaataggaaaaatctgctcttacagcactgccaagcatgtcgcagggtctcagctggtggtgcgcctcctcaggggaagagcaacaatgccccattcttccctttggtcaaggccctgatgttttctcaggtggaaggaggaagagctataaaagctccctgcatggtaggaaaactttgcacaggcaataatastgccagtcctcaaaaccaggagcccaagaattatccaaagattgaaagctgtgcgctcactcagtggtcgtctcatcttctagatctagaaagccttgtttggcatgttgtgtttgcagataagacatctccaatctaggtgcctaaaagtggtctgattttgtttaagtcatctggattccagccaaacttccatccacctttataatttgcctgcacatgtctttctcttggtcaaaatatctcagatgacttaagaaaaactagcttgctttgctgtgagttgatcaggttcatcaa

SEQ ID NO: 91958 - DNA, 601 bp, Human
gaacctatgaaggtttatacataaagaaaagaagggagaaatgttcccatggagcctttttatatgccagttacacatagatcttgacactcacagcaacccagtgagggaggtagtattattaccattctggagttgaggaaacagaggcactgagaaggtagtaactttgctgaagccaatgagcaattaagtggtatcgtacattctcacccagacttgaaaattcaaaactgagactggggtggatgtgaagagacaaggctttccctaagtaaaaggtagggaacttctggtaccsgtgtcatcactctttatccaagactgtgatgctcgctggcaataaaagatcaaaggttaatgcagcttgaggcatttgcttatgtcaaagaaaagagtcaaactcggtaaaataattgaagagatttattccgagccaaatatgagtgaccaatggcctgtgacacagccctcaggagatccttagaacatgtgcctaaggtggctgggccacaacttggttttatgcagtttagggagacataaggcatcaatcaatacatgtaagatgtacattagttccgaccagaaaggcaggaca

SEQ ID NO: 91959 - DNA, 601 bp, Human
ttttttattattaaaattaaagtcattcatttctaaattcaacaagcaattgtcaaatgttgcgtggtgttttcaggcatactaggctgagtgatctgtgatttctgccataggtcgctcctggtcaagtaggacagacatatggtctaccagcaaagaaatgacaatgtactgggattagcgtataataaaggcattttactaaatattgtgcaggacaaaagagggcatgattgcgtcttggatgggcagccctttttggaaggcaataaaaggaacctatgaaggtttatacataaasaaaagaagggagaaatgttcccatggagcctttttatatgccagttacacatagatcttgacactcacagcaacccagtgagggaggtagtattattaccattctggagttgaggaaacagaggcactgagaaggtagtaactttgctgaagccaatgagcaattaagtggtatcgtacattctcacccagacttgaaaattcaaaactgagactggggtggatgtgaagagacaaggctttccctaagtaaaaggtagggaacttctggtaccggtgtcatcactctttatccaagact

SEQ ID NO: 91960 - DNA, 601 bp, Human
tatgacaaggaaataaagcaagatgcaagttactcagagtataagcatgaatataaattaaaacactcacagagtaatgcattttgtaagtatactgatatatatgcatgtctgtgtgtctacatatggatatacagagacatatgcatatatgtgtacatatacatataggtagaagtatgaaaatgaactgtttaccagccttagccactcatctttcatgtagtagaggtggttgctaatttggcagtctgggaggtgtgagtttatctgggagacagccatgaggggagagacagcygacagagacacacagagacagagatacagggaaagaagcttcagtcagtgaactggaggatgctgaacttaggctagtggctgcctatggagatggggatgggaataggaccagggggatgactaaaggggttttagttttagtcatattttatatcttcccaaactaaagcagtaaatgcaaatataagacaaaacagtaagtcatttattctaggtggagggaatatgggtgtttgttatattaatctttgtctttttctgtattttttttatttctcagaaggaagtaaagctccta

SEQ ID NO: 91961 - DNA, 601 bp, Human
aaataattatgatgctcaccttatactttctattaaataattttgatgctcaccttatatgaaaactacagagcaagttttattattgttcagacacactaacacctattgcctggttattgttctaatgacgacgtgaaatgatgatggtgcactatggatgtggacagtgtgcagccaagacaaaggagtcagggcatttgtgttgctgtggaaagaggttggagctaaaactcagccaaaccaaagcaagtcacttccttgtctgggcctcggtttcttcacctggaaatacggatamaggagagcccagccagatcactgtcatgatcttttaatgcctaatttaacaatattttatgagaatgaatttgtcctaaattctgaaccatctcacttccaggcccaggatgcaagggtacactctagttagttgttaaaatgctgaaatatttttatatgtttctgtagctgcagtaaatagcccatgccctgaaccccacaagtacacacctcccaaccaccctggccaccccatgatctgacaatcaaagagttaatgtctagcacagtggggacctccagggccctgctccagcag

SEQ ID NO: 91962 - DNA, 601 bp, Human
ttagaatttgtcaaatactaggcatttttgaggaagcggggtggttggaaggtctgtcaaatgtcagaaaagagagggagggcatgcaaacatttgttaggagaatacgaggaccctgggatcacaacacaggaaagaagccagaaaccactctcaacattatgttcaaagagtcatcttacaccaggaatcccaagtacaggatcatggcaagggccaaaggtaccctcctcccttgcacatgtcaattcagaggaggaaatagaaaaagaagtcaagaaggaagaaaacgaggaggagsaaagaatggacacatcttgggaagccaggaaacccaattcctttacccagtttcatttccgccttgcactgctcttggttcccgaccccctgctaaatgtagtcaaataagtgtattgtgcagggtgaaagaaactattttactcaacaataccaatagtgctttcatccatggtcccagccccctttcagtcacctcggatatctcctatcacacaccacacttccagtaccaattcccctgctctgcacacatggctaagacatagggacactctgttccagctgagaaagaaatgcc

SEQ ID NO: 91963 - DNA, 601 bp, Human
ccacattctagaactcagtcatcaagtggggtgggcctttgtctgcagtcagagcctcccattgaagttcaaagcagagaaggagacgcagaagacccctggcttctataaatttatgtcctgcctgtggatctgctacaaacctaacctctttaatttagaatttgtcaaatactaggcatttttgaggaagcggggtggttggaaggtctgtcaaatgtcagaaaagagagggagggcatgcaaacatttgttaggagaatacgaggaccctgggatcacaacacaggaaagaagccaraaaccactctcaacattatgttcaaagagtcatcttacaccaggaatcccaagtacaggatcatggcaagggccaaaggtaccctcctcccttgcacatgtcaattcagaggaggaaatagaaaaagaagtcaagaaggaagaaaacgaggaggagcaaagaatggacacatcttgggaagccaggaaacccaattcctttacccagtttcatttccgccttgcactgctcttggttcccgaccccctgctaaatgtagtcaaataagtgtattgtgcagggtgaaagaaactattttac

SEQ ID NO: 91964 - DNA, 601 bp, Human
gggaattccctttgaataggagagtcgatgcaagggaacagttggttccctggagtcttcagagcaagttcagcctccacacgaccaatggtgaccgtgtagggacttctatgatgattcactgcacccctgcaaagctcccacaaaggacagggcagcaaaagcatgccagaaaaacacacatggctttacagccttctcaaagctccaagcaccacattctagaactcagtcatcaagtggggtgggcctttgtctgcagtcagagcctcccattgaagttcaaagcagagaaggagamgcagaagacccctggcttctataaatttatgtcctgcctgtggatctgctacaaacctaacctctttaatttagaatttgtcaaatactaggcatttttgaggaagcggggtggttggaaggtctgtcaaatgtcagaaaagagagggagggcatgcaaacatttgttaggagaatacgaggaccctgggatcacaacacaggaaagaagccagaaaccactctcaacattatgttcaaagagtcatcttacaccaggaatcccaagtacaggatcatggcaagggccaaaggtaccctc

SEQ ID NO: 91965 - DNA, 601 bp, Human
ttttcttccctagtccaaaaacatgttttctggttagcagttgttttgatctctctgttttgctgtctttggtttccagggctgctctttggccatcctaaagccctctgcagagttcacaggagaatgagctgcataaacgcgggtcttgggtactgcagccacatgacagcttctcattagccaaagcctatcatcatgcctcttccgcgcaagtgaaagcttccaagacccagaggagaatatgcagagagagaaagaatgttccatgagaagagaggagggggtctgttggagcagyttccacaacttgactttacagggggtaaaaaacatttggaacaaagaaggatgctagaaagtcaaagctggcaaccccagcccctcttggttttccatcctgtaccatgatactgtaggataactggatcagtgaggaagtatgtcaccatgatttttggtgaaaaataaattactaaagtttgtgactttttaaaagccaaaaatcagtttgaatttactattattcttagcttttaaaatctcatttactaactcatcttctgttatagtttcctaaggtgtaaaattactgtgagag

SEQ ID NO: 91966 - DNA, 601 bp, Human
aggagttcgagatcagcctggccaacatggtgaaaccccgtatctactaaaagtacaaaaatttaaaaaaaaaaaaatggtggttatagtttgtaatcttatagtcacaaaatcccagcctatagacctttgaggtaggttcattttgcaactggcactcaggaaaaaacaaaaagcagagaggtgatctaagttcccaggtcgcaggcctgaagtatttaccagtaactttaccccttattacttaaagcatggtccacagagcagcattgtctgggaccttgtaacaaatgttgactckcagccttccccagacctattgaaccagaatccacatttttaacaagatccccagaatcttccaatattcacttgcatgttcaagtttgagaagtaccgttcatgttatcagccattgtctctctacagatataggatggtggttcctaaaccccagcaatcattcaggatcactcagagaaattgcttgtaccccaatcaccccaagtttgattcagtgggtatggggtaaaccctaggcaactgcacatcgaacaagctcccagcattatcagatgagctggtctgcagactacataaa

SEQ ID NO: 91967 - DNA, 601 bp, Human
ctgaaatcaactggggcagcagaccttacaagtcccgtcatgtggaaagaggtggcagtttggtttcgaaccaaggaagccactatagaaacagttttaggaaagaagagaggcatatttacccaaagaggatagaactgaaatgccttacaagtagtggttatagaggcccggtgtggtggctcatgcctataatcccagcactttgggaggcccagatgggtgcatcacctcaggtcaggagttcgagatcagcctggccaacatggtgaaaccccgtatctactaaaagtacaaaaatttaaaaaaaaaaaaatggtggttatagtttgtaatcttatagtcacaaaatcccagcctatagacctttgaggtaggttcattttgcaactggcactcaggaaaaaacaaaaagcagagaggtgatctaagttcccaggtcgcaggcctgaagtatttaccagtaactttaccccttattacttaaagcatggtccacagagcagcattgtctgggaccttgtaacaaatgttgactcgcagccttccccagacctattgaaccagaatccacatttttaacaagatccccagaatcttc

SEQ ID NO: 91968 - DNA, 601 bp, Human
cccagactccttcagtgggggcaacagtgttgattgacctgacagtttactgaaatcaactggggcagcagaccttacaagtcccgtcatgtggaaagaggtggcagtttggtttcgaaccaaggaagccactatagaaacagttttaggaaagaagagaggcatatttacccaaagaggatagaactgaaatgccttacaagtagtggttatagaggcccggtgtggtggctcatgcctataatcccagcactttgggaggcccagatgggtgcatcacctcaggtcaggagttcgagaycagcctggccaacatggtgaaaccccgtatctactaaaagtacaaaaatttaaaaaaaaaaaaatggtggttatagtttgtaatcttatagtcacaaaatcccagcctatagacctttgaggtaggttcattttgcaactggcactcaggaaaaaacaaaaagcagagaggtgatctaagttcccaggtcgcaggcctgaagtatttaccagtaactttaccccttattacttaaagcatggtccacagagcagcattgtctgggaccttgtaacaaatgttgactcgcagccttcccca

SEQ ID NO: 91969 - DNA, 601 bp, Human
aatgactgtcacagcagctcaaggagctctgagctgggaatgctggctacccactgcctgctagcctctctgagcttctgcccagactccttcagtgggggcaacagtgttgattgacctgacagtttactgaaatcaactggggcagcagaccttacaagtcccgtcatgtggaaagaggtggcagtttggtttcgaaccaaggaagccactatagaaacagttttaggaaagaagagaggcatatttacccaaagaggatagaactgaaatgccttacaagtagtggttatagaggccyggtgtggtggctcatgcctataatcccagcactttgggaggcccagatgggtgcatcacctcaggtcaggagttcgagatcagcctggccaacatggtgaaaccccgtatctactaaaagtacaaaaatttaaaaaaaaaaaaatggtggttatagtttgtaatcttatagtcacaaaatcccagcctatagacctttgaggtaggttcattttgcaactggcactcaggaaaaaacaaaaagcagagaggtgatctaagttcccaggtcgcaggcctgaagtatttaccagtaacttta

SEQ ID NO: 91970 - DNA, 601 bp, Human
caggtttgcagggctgctccagcacagaggcccctttgaattcaagatgcctgtcaggtagagaggctcggcatttccaggacttatcagtcctggaaactgctctggtcttctgccaactatgcaactcttattctgcagtaaattggagggcagggcaggctttcagtgtgaataccaaccgccagagcagcaagactgggaagaatgggattccagccaccacctagggcagtgtctctgaggccggcgggcagcccgggcagcccaccaacttaacccatggggcttcctccgcccrccgacagacccactccgagccactccggggcctgccagcacaagcttttccggttttttatagccctcaacatttcattccagatcaggggtgggagggagagcaaacaggataaagaagtttctaaggaaagagaggaatgactgtcacagcagctcaaggagctctgagctgggaatgctggctacccactgcctgctagcctctctgagcttctgcccagactccttcagtgggggcaacagtgttgattgacctgacagtttactgaaatcaactggggcagcagaccttacaagt

SEQ ID NO: 91971 - DNA, 601 bp, Human
ctgcccctgcctgggaacaggtttgcagggctgctccagcacagaggcccctttgaattcaagatgcctgtcaggtagagaggctcggcatttccaggacttatcagtcctggaaactgctctggtcttctgccaactatgcaactcttattctgcagtaaattggagggcagggcaggctttcagtgtgaataccaaccgccagagcagcaagactgggaagaatgggattccagccaccacctagggcagtgtctctgaggccggcgggcagcccgggcagcccaccaacttaacccayggggcttcctccgcccaccgacagacccactccgagccactccggggcctgccagcacaagcttttccggttttttatagccctcaacatttcattccagatcaggggtgggagggagagcaaacaggataaagaagtttctaaggaaagagaggaatgactgtcacagcagctcaaggagctctgagctgggaatgctggctacccactgcctgctagcctctctgagcttctgcccagactccttcagtgggggcaacagtgttgattgacctgacagtttactgaaatcaactgggg

SEQ ID NO: 91972 - DNA, 601 bp, Human
tcagtaccccccccaccaccaacaacaaccacacacacacaccaccatcaatgactgtcaagcatgtggcatgaggcaacattatgggaatcctgctctgtgcagtcagcaatcctaagtgacaccagagccgtggctttcaccacaaaggggcagatggatcctgggtgggggaatgagtcagcctctggatccactgagggaggaacagctcccctgtcctcatgggtctcacatctgctttgctttgtttttaaggttcaatacagaaacctcagaagacatcaaaaaagatgaaatwaaaaaaatcccaaatcccaccacccaaagataactactgtttacattctgacttataattccatatgatcctagtatttttcctaggtatgtgtataaaaatattttctctttattttacaacaacaaaaaaaaatggcattagagaaactgcttggagtcttttctcacttggaaatatattgtaaacatgttcacatgtcaatacatattgctaaaatatcattcttggtatgcaactataaaaatagaatgcagtagatctctatgaactgatactaactcatctcaaagacaggct

SEQ ID NO: 91973 - DNA, 601 bp, Human
ggtgtaggttttgtctggaaactgccaggcttataataatcacttaattaattgtagctattaatattatgacctgcttcttcaaatagaaggagctcttggtagactcccccacctgctgatcaatttcttttttttttttttttttttttgagacagagtctcactccattgcccaggctggagtgcagtggcgtgatcttggctcactgcaacctctgcctcctgggttcaagtgattctcctgcctcagcctcctgagtagctgggattaaaggtgcacacgaccacgcccggctartttttatatttttagtagagatggagtttcgccatgttggccaggctggtctcaaactcttgacctcaggtgatccagccgcctcagcctcccaaagtgctgggattataggcatgagccaccacagctggtctaactttttttttaagggtaacatgaaactatggggtctgaaactatggcctgcaggccaaatctggcctggcacctgttttttataaataaagttttattggaacacagccatgctcattcatttacatattggctatgattgttttcatgctacaacagcagcct

SEQ ID NO: 91974 - DNA, 601 bp, Human
aaatcattctttcccaaagaccagaaagtaacagaactgtggcattaccgctttcttccccaagtctgcattcagaccaacccagtcattactgatcatgtaagcttgggctaatcactttgttctttcaatggccttgttggtatagctactatgcagggctgtattaaggtgtaggttttgtctggaaactgccaggcttataataatcacttaattaattgtagctattaatattatgacctgcttcttcaaatagaaggagctcttggtagactcccccacctgctgatcaatttcttttttttttttttttttttttgagacagagtctcactccattgcccaggctggagtgcagtggcgtgatcttggctcactgcaacctctgcctcctgggttcaagtgattctcctgcctcagcctcctgagtagctgggattaaaggtgcacacgaccacgcccggctaatttttatatttttagtagagatggagtttcgccatgttggccaggctggtctcaaactcttgacctcaggtgatccagccgcctcagcctcccaaagtgctgggattataggcatgagccaccacagctg

SEQ ID NO: 91975 - DNA, 601 bp, Human
gaacaaggctggcaagagtggaaaccctatagctcggtgagactggggacatggcaggagctagactcctgggcccaattttcatttcagaaccaggagtctactacagaacccaattttcatttcaaagtcctgagtctgctactgtgattacagagcagggcacacactgaaggggccaggtccagagccatgtgggaggagcccagatggaatggtggggtggcagtgtgcaaagagagaagggacaacttcaggagatatttaggtcacaaagacaagactgggctgtgcaagagcrtggaggggtaaagagatggggactgggcaagaagacatgtcaagaatgactcctatgtctctagtttacaggaaattcactgagatacagatgatgagcgatggggtgggggttcaccccgggcatggtttggggctcaatggctgaggcatctatccaggctgctgcttcacacctgcctaagctgcctccttgaacctggatagggtccttccaaggcaagtggctagtcacgacctcaggtgcaatatggaattgaggtttctaccaggaggtgttatgttgtttcccgaagtacta

SEQ ID NO: 91976 - DNA, 601 bp, Human
cctcagtcttagggagcatggaacaaggctggcaagagtggaaaccctatagctcggtgagactggggacatggcaggagctagactcctgggcccaattttcatttcagaaccaggagtctactacagaacccaattttcatttcaaagtcctgagtctgctactgtgattacagagcagggcacacactgaaggggccaggtccagagccatgtgggaggagcccagatggaatggtggggtggcagtgtgcaaagagagaagggacaacttcaggagatatttaggtcacaaagacargactgggctgtgcaagagcatggaggggtaaagagatggggactgggcaagaagacatgtcaagaatgactcctatgtctctagtttacaggaaattcactgagatacagatgatgagcgatggggtgggggttcaccccgggcatggtttggggctcaatggctgaggcatctatccaggctgctgcttcacacctgcctaagctgcctccttgaacctggatagggtccttccaaggcaagtggctagtcacgacctcaggtgcaatatggaattgaggtttctaccaggaggtgtta

SEQ ID NO: 91977 - DNA, 601 bp, Human
actaatcaaatgttcctgtcaataactgtgcaaagtgctacagagggaaggtgcatgaggaacctcagtcttagggagcatggaacaaggctggcaagagtggaaaccctatagctcggtgagactggggacatggcaggagctagactcctgggcccaattttcatttcagaaccaggagtctactacagaacccaattttcatttcaaagtcctgagtctgctactgtgattacagagcagggcacacactgaaggggccaggtccagagccatgtgggaggagcccagatggaatggwggggtggcagtgtgcaaagagagaagggacaacttcaggagatatttaggtcacaaagacaagactgggctgtgcaagagcatggaggggtaaagagatggggactgggcaagaagacatgtcaagaatgactcctatgtctctagtttacaggaaattcactgagatacagatgatgagcgatggggtgggggttcaccccgggcatggtttggggctcaatggctgaggcatctatccaggctgctgcttcacacctgcctaagctgcctccttgaacctggatagggtccttccaag

SEQ ID NO: 91978 - DNA, 601 bp, Human
ggcagaaagcagagatatcccaatggcaggcaagtagaggaccccaaggtggagagcaagcgacatcctagagatacactgttgggcaggtaggggcagacccagaaccaacagtcaggacatcaggagacgctgacagtagcccataggcaaagaccccagttgctggacacacagtatcaggaagagcaattccaatctgaaagtaacagcaagactccaggttctgaaagatatgccattctcttaagaaaacactgtgctcaccaaggatgaaaagtgtgccttgcttgtatctgtrtcccacagtgcctaccctccatgaaacccacagaatggctaacatccccaaatacactcctgccatttggagaagccaagtatgtgagtcaggaagtaagagtcactgtcactacctgcccggagttcatagtctacgctgggatcttggacacacagcacaaaaggaagttcattgcctattttcctcacttctggcctctcaggattcaaacctggtgatcctaaaaagaatagcccatatatgcaatgggtgctcctgacaactcccacctcccactagttcccatcctcctcactc

SEQ ID NO: 91979 - DNA, 601 bp, Human
gagctttgcagagtaatggaaaagctagagacagggttactgaatgacacggaaggatgcttaagaaagagtgttgtgtgaaaaaaataggtcaaacactgtttgaattgctcaagaccattttcacttaagtgtacatttaaaatatgtatgagaatgggccaggcatgtggctcatgcctgtaatcccagcactttgggaggccaagggggaacggatcatgaggtcaggagttcgagaccagcctgaccaacatggtgaaaccctgtctctactaaaaatacaaaacaattagctggrcatggtggtgggtgcctgtaatcccagctattcaggaggctgaggcaggagaatcgcttgaacctgggaggtggaggttgcagtgagctgagatcgcaccactgcactccaacctgggagacagagcaagactctgtctcaaaaagtaaaaaaaaaaaaaagtatgggaatatagatactcaggtacagatctacagttacatagatatatgtgcatatgtacatatatacatttacatatatgtattcacacatatgatgctaacagtggtcatttctgaataataagattaccactaa

SEQ ID NO: 91980 - DNA, 601 bp, Human
aaaaatctgtaggtttaaaaaagtcttgattactggggtttttaatttgtggcaccctcttaaattttttgcccaaagcgaagggctcatatacctcaccttaatcttgcaaaggtggtaggggtgatgaacgacaagatgtaacagccaaggccacctggagagcacagggctgaaagagcattgtagtgggtggtgtgtaagccttggtttttccagaatagaggctgaagatcatccaggaggctgtgagaggctccagggaggtgaccggtacagtgtattgggcagcttattagtrgaaagatggcagcaacttggaaggaattcacagaaccagggaaagccgtcaaaatgtggagcacgactgactttggaagggaaaaggaaaacatggtccagctgatgaaaagaaaaaagatgatttggagaaggaacatggaagagagaaggtgctttggctacagtacctgctaaaagctaaaaaagtctctcatcaagagaggctggacaaggggaaatgactgcaaagacgtgtattatgaacaggaacatggattcaaaatttagatccttcattttactgactgatctcatccct

SEQ ID NO: 91981 - DNA, 601 bp, Human
gcctaaggactttctccagcacagtaagagcaagcttggccttaagcaggtacaacccagaagtgtggggtaattaataccactggaacaacccataactaattaatggaggacaggagtcactaaatacatgttccagtccctgcatctgcagtggagagcaactttgaggcaggtgccacccagtttctcagacggtccccagcaggactaagctccagttacccactgcagcaatccactcactgtcacgctctttcttgactttatcatctccctttcatattgcccgcttgctccmtaatgcatcctggaatcacctcccaaataaattacctgcacatcaagtccttatctcagagttgacttttggagaaccaaaactaagattgaaaagcaaagaaggatttgacagcctttctaaacaaaagaagagagtctggtagtgctttaggcttatggctcaaagctgtgctatccacaacagtggtcactaaccacatgtggccactgagcacctgagacttggctagtgacacaggctgacatgatagcatctctgatatattgggctaaataaaatatagtattacaatcaatt

SEQ ID NO: 91982 - DNA, 601 bp, Human
aaagaagtcggccgggcgcggtggctcacgcctgtaatcccagcactttgggaggctgaggcgggtggatcatgaggtcaggagatcgagaccatcctggctaacaaggtgaaaccccatctctactaaaaatacaaaaaaaaattagccgggcgcggtggcgggcgcctgtagtcccagctactcaggaggctgaggcaggagaatggcgtgaacccgggaagcggagcttgcagtgagccgagattgcgccactgcagtccgcagtcccgactgggcgacagagcgagactccgtctcaaaaaaaaaaaaaaaaaaaaaaaaaaagaataaaaagaagtctgccagcagcgtccccaaagcagacccctcccaccctccagagacagctgagaaggaagaatgagatcatactcatgaaactcatgaaatactcagccttcttgggaagaaggatgacatgtagaatgtgagcctgggctttctcctagggctgggccatgcacagatttgcaagccatggcctggggaccatctgatgtctacagccctagctgactgagcaaggccccagtgccctgcagacgtgaatgtccctcct

SEQ ID NO: 91983 - DNA, 601 bp, Human
taacttcagaggcatgagatgtttttgctcatccttttgcccctgcactctgctatgaggaaaacgtggtcttgtcccttccacctggacaccagaatgagcaacaaggagcatgggaatggtaataatatagtattcatagtaatgatgtacagcaataatagtagtaattgtaataacatgttgtaacagtaatgtaatatatataaggttagtgtatataatactatgcatataccagcatatatattaccattatcatataatacatagtcatagaagtaatatggtaataataatrgtaacaattatttttaaagctgcaagagtgcagaagctgtcagaccaaatgtggactgtgaagtgaatcagcagcctatatgagctagtatttataattcaagggactagtgggcatagttcctatcttggaaggccctatagctgggaatggttaagaatgaaggtattacacagggctcattcctggcttccccgttctccagctgtgtgaccctgggtaggctgcttaacctctctgaccttcagtgtccccaggtataaaatggaactaaaaatattactgctcttaggttcctct

SEQ ID NO: 91984 - DNA, 601 bp, Human
cggaaagggtaggaggcaagggctgtgtgggcagtgcccccttccttctgagcccccagaatcctcttcatgtcaaaatggcgcagagaggggcaaaagtggtctctccataaatggggctgaagtacctgagacagggctggttcccatgcccgcttgttcctccatatggtaacagcccccaacctccagggccctgccaaaccctccccaaccaccttactgtgcatttctcatgaggctgaggccattcgatcagagcccattcaggtgcactcaactctgctgtggccctctgtgycaccaaaaccctgctttgctttttctttccaagggcaacccttcttatgccttgctccccctgggctctgccctcattcctacaacaatctccaagctcagactctaaaaggttcacctccagcactttgggaggctgaggcaggcagatcacgaggccaggagatggagaccatcctgactaacacggtgaaaccccgtccctactgaaaatacaaaaaaaattagccaggcgtggtggcgcacacctgtagtcccagctacttgggaggctgaggcaggagaatggagtgaacccggg

SEQ ID NO: 91985 - DNA, 601 bp, Human
ggcaaggaactttaccctgtttgtaaaataacaggtgggtctccttcccagacacacaacttagaaacactggcaccaataaccacacaacacagccaactgaggacagagcagtgtgggctgcaaagacagaatctcacaggaaatctcggatcatgtcctaacaggccccacaggcctcctgggctacagggatccagccagcagctcccattggtttgagaatggcagcaaagacagcaaccccctgcccaggggccatgcctctaagaatagaggacaaacacattcagagttggamagaagcttgaatctataaggtgtatacatcatgtccttgaacagatgggtctcttgacatctcggcacctcctcagctctgtcctcttagcatgggctcagggtctgttgcaatgtacaccctattgtatgttctgggggtagaggtacagcaatacagaaagtccctgctctcagggagctttgtccttattggcgaagaagcacatacctcacatggcacgtcccaacaggtgcttcgataatagtaaagtggggttaaagaaaagtggggtcaggcctggtgcggtggctcacgcct

SEQ ID NO: 91986 - DNA, 601 bp, Human
atgtacctcaaaattccctccacccagctgcaatttctcttgcttcggttccatgatggttatttgcaacaacagtagatactgttttgtaggccacaaagtagagggaccctgagcaccacttggtgggggcagggggtgtcacatgagagtcccaattctactacttgctgaccatgtgcctggggacaaattattcagcttccttgggcttcagtttcctcacctgcgaaataaggatagtcatacgtactttctatgagatcatgtatgtgaagcactaaactcagagcctggcacrcactcagctttcagcttaggctagacactggttttgatggtggtggtgctattgttgtagatttaggaagcatcacagagcatgtattagtctgttctcatgctgctaataaagacatacctgagactgcgtaatttataaagaaaaagaggtttaatggactcatagttccactttgctggggaggcctcacaattatggcagaaggctaaggtggaagcaagatatgttttacatggtggcaggtaagaggatgtgtgcaggggaactgccctttataaaaccatcagatctcatgag

SEQ ID NO: 91987 - DNA, 601 bp, Human
tatctgcatgacgtcagcccctgtctagccgggaactcagcgaggatgtcaaaaatcaaattaattttgccttcaccagtatgactgtcaataaaaagttattattcagtcagtagatgttttaattacccaaatgtcaagcactgtcaccctccattagcagcttaacggtcctaatagacaacgccctgaaaggaacctcaggagaatcctgagccccactgtgtccctaaagaggaccccagcagagccacttcaccctaaccattcacattcccttcttataagtctccaaaggagaagtctcccttttttctttatgtttgttgttgttgttgttgttgttgctgtatttctaaaagtctctctctcgaagagcatccatgtacctcaaaattccctccacccagctgcaatttctcttgcttcggttccatgatggttatttgcaacaacagtagatactgttttgtaggccacaaagtagagggaccctgagcaccacttggtgggggcagggggtgtcacatgagagtcccaattctactacttgctgaccatgtgcctggggacaaattattcagcttccttgggcttcagt

SEQ ID NO: 91988 - DNA, 601 bp, Human
ggactaagtattatactcaaagtcatacagcttggaaataaaagcagtgtcctctcttgtcttgctgccggaaagaaccaggtggcctctggtccagctccatccattagaatgatgaagtgcatggcactgcccaaaatggtggccactggccacatgtggttactgagctcttgaaatgtggctacttcttctgagaagctggtttttaagttttatttcattttagttaatttaaattgcccacacacggctagcagccatcgtattggagagtgcagctctagaccactggtgagtycctgtctctgacatcaggctgatcctgtcccctggatgactcaagctccgagagaagtggagacaggattctcacccaggccctaatcatggaaagagcaacaaacaccctttggcttgggtcactcccacccagcatcctcttgctagtaaatgatgacatcaatagccgtatatgatgtggttttcctgtggctctgccaaagaaaatctctcttttcctggaccatcccatttctaccatcaaactagagaaattcatcttgatatacaggttccttgggattcgaattgacagacc

SEQ ID NO: 91989 - DNA, 601 bp, Human
tactgaatccaagagtcaggggtggggcccagaggcgggtgttgtcacaagcctttcaggtggctcataagcatgctcaagctggacaaccatgggccagtttacatcctgccgccccttcttccaggaagggagggcagtataagcaaagaaaacccagagtgctttcctgtgggccattaacagccacccttaggctgcccaggtacaaaataatggagattctataactcattaacaagctccaggagttaaatagttgaacttgttatctttgcctgaaggacaaagagagaagaargcaagagagaaaatctaaggatgcaagccctgggggagggtccagagtgctgcaacacccccccgccccaccccgcagggaagaggaaatagagaggcttggtaggatggcaagacaggggtgttcatgggggaagactgagaaaaaagcatgtgtctccaatggtttgttttctgtttttatttctttgtttgtttctttgtttctggtattatgtattccagaagcaaccaggcaggaagatgtgtggcctcaggtaactcaccaaatggaaactgatctgtagaagaaatataccag

SEQ ID NO: 91990 - DNA, 601 bp, Human
agtcacatttaagcaagacagccaaaagctccaggccatctagaaataaacacagtttattcttattgtaacacagttaatgcacaatttgatgagacacccttggtttgaagaattcagggaagttgtaccaagagggcagaggtatgatgggcacttgaaggctgagaggtttggcaacctggcttttgggggagaggctaataaggactgccaggctgaggagcaagagagggaaagcgggcagtgctggctgggccacagcaggaagccatcatgggccaatccggagttatgcgtrttctttttcctggcagcccagcatcagcccagtcaagacagctcaccttcagaggagagaaaaaccaagcatttattaagcatcaaccattagtttattcaatcctcacaacaatcttagaagcccatagttcccatttgacagatgggaaaaatggggctcaggtagcttgagggtcacggagtggtgagacaggctttgctctcatgcctgacagatcccagagctattaataacattggtgtaaagacacctgcggttctcaaagcctggttctcagaccagcagcatcagcctcac

SEQ ID NO: 91991 - DNA, 601 bp, Human
cagaagtaggaattagcaggcagagaatttttgtttttgtgtttgctcttctgaggccccatactccttgcctctgtccagcttttgagtcctcttttggtgccttggctcttagtagttcctgccctggcagagtaacacagtccatggagaatcctggaaagatttccagggttccagggttctcacagaccccaggcaaaatcaaacatctttttttttttttttttttgagatggagtcttgcactgttgccctgactggagtgcagtggtgtgatctcggctccctgtaacctccrcctcccgggttcaaggaattctcctgcctcagcctcctgagtagctgggattacaggcaccgccaccatgcctggctaattttttgtattttcagtagagatggggtttcactatgttggtcagactggtctcgaactcctgacctcatgatccgactgcctcagcctcccaaagtgctgggattacaggcataagctaccgcgcctggccccaaacatccttttcatactcccctcaggggctctcgggagtcccagagcagagtgacgcagaccagctcagctcagggctgattttgg

SEQ ID NO: 91992 - DNA, 601 bp, Human
cctgggcctggaatgatttttttctcttgctgtagtaatgatctgattagggttcaatcctactgcattcttcatgtcctaactcatcttcactgagtctaaactgcccagggaagaaggatggcagtcatgcaggaggcagctccgattaagtcccaggcccgatgaactgaggattgcacatacctccttgcacctgaggcccgaggactcactgcatcccagcgatgagggcagaagcgggtgctactttcctcctgactgactctgcagggagcagcctggctgggaggcctctctycaccttgcctgcttccttcctgagcacaagctgcaggtggagggagccacagtgcctgctgccgagatttcaacctgtcacttctgtttgggtttctcttccagtgtgtcagtctcacttggccaaggccagaataccagggaagttatatgggctggcacaagctaatgcatccaagagcagcacctttatctctgaacagctacatcagtgcttctgatacagctgagataaggaaaaaggaacagatatttattgtgcacctattatggttaggcagcatactgcttgattttatga

SEQ ID NO: 91993 - DNA, 601 bp, Human
gagatgccatttactggctaacaatggggtttgtctcgatggggaagcaaatggagccaagaggacccaggtatcagaggagaccaagagattagaggtcaaggtagggtacaaaaaggaaagtagagcaggaagaaggaagaaagagaggtaggtacgtctggattgaagagaaattccaagccacaaagcaagccaagaactggctattatggggctgtaatggagtgtacatgaaggtcaccggcaaggaaggcttaatcatggggagatgaagactgccaaaagttatcaacattgyagcctcagatcttgaaacttcagtcccactctcaagtcctacagtagaagcatgaaactttaggacaaccttgcagaaagagatcaatcataaccacctctgggcaagttcctcttgccttctcaatccaaagtggcatcaccatataaaaggttgtcagaaaggaggctgtatgagctcatggtagagcaccccaaagacctatgattattatttcaagtcctggtttgctaccatcttgatgagtcacattcaacaagtttttccagagtagggaaagaattaaaggtattaattaag

SEQ ID NO: 91994 - DNA, 601 bp, Human
tgcatggcagatctgcactgaacccacttagcatgggcccgtggctatcctgctcagcaactcaggacagtagggtaggggtcgtcaaagcaggcagagcaagaagggcaaggagggagcagattttggggctccagggagatgccatttactggctaacaatggggtttgtctcgatggggaagcaaatggagccaagaggacccaggtatcagaggagaccaagagattagaggtcaaggtagggtacaaaaaggaaagtagagcaggaagaaggaagaaagagaggtaggtacgtctsgattgaagagaaattccaagccacaaagcaagccaagaactggctattatggggctgtaatggagtgtacatgaaggtcaccggcaaggaaggcttaatcatggggagatgaagactgccaaaagttatcaacattgcagcctcagatcttgaaacttcagtcccactctcaagtcctacagtagaagcatgaaactttaggacaaccttgcagaaagagatcaatcataaccacctctgggcaagttcctcttgccttctcaatccaaagtggcatcaccatataaaaggttgtcagaa

SEQ ID NO: 91995 - DNA, 601 bp, Human
gaatactttgactaccagcactgggcagcttcatgttcaacaaagcatgcaagatattaactgagactttaaaagccaagatatagggctcagaaaggatagacaaggcaagcagctgctgtgaggtcaacaaaagctgaatcaaaggcctgccaaaaagcagcaaggggtcttgctggggtttgcatggcagatctgcactgaacccacttagcatgggcccgtggctatcctgctcagcaactcaggacagtagggtaggggtcgtcaaagcaggcagagcaagaagggcaaggagggrgcagattttggggctccagggagatgccatttactggctaacaatggggtttgtctcgatggggaagcaaatggagccaagaggacccaggtatcagaggagaccaagagattagaggtcaaggtagggtacaaaaaggaaagtagagcaggaagaaggaagaaagagaggtaggtacgtctggattgaagagaaattccaagccacaaagcaagccaagaactggctattatggggctgtaatggagtgtacatgaaggtcaccggcaaggaaggcttaatcatggggagatgaagact

SEQ ID NO: 91996 - DNA, 601 bp, Human
gggcgagagagggaaactccatctcaaaaaaacaaaacaaaacaaaacaaaacaaaaaaacactattaaggtttagaaaaaggaatactttgactaccagcactgggcagcttcatgttcaacaaagcatgcaagatattaactgagactttaaaagccaagatatagggctcagaaaggatagacaaggcaagcagctgctgtgaggtcaacaaaagctgaatcaaaggcctgccaaaaagcagcaaggggtcttgctggggtttgcatggcagatctgcactgaacccacttagcatgrgcccgtggctatcctgctcagcaactcaggacagtagggtaggggtcgtcaaagcaggcagagcaagaagggcaaggagggagcagattttggggctccagggagatgccatttactggctaacaatggggtttgtctcgatggggaagcaaatggagccaagaggacccaggtatcagaggagaccaagagattagaggtcaaggtagggtacaaaaaggaaagtagagcaggaagaaggaagaaagagaggtaggtacgtctggattgaagagaaattccaagccacaaagcaagcca

SEQ ID NO: 91997 - DNA, 601 bp, Human
gactatcttaggaaagagaattacctacatgtatattcctacctcaggaatagagtggatactgggcaaatgtttaatgactaaacataactacctagactctttctttaagtgatacaagaaagaaaaggtgaggatacagaacactattaaggtttatggccaggtgcagtggctcacgtctgttaccccagcactttgggaggctgaggagaggggatcacttgaggccaggagttcgagaccagcctggacaacatggtgaaaccacatctctactaaaaacataaatattagccakgtgtggtggtgctcacctgtaatcccagctactcaggaggctgaggaagagaattgcttgaacccgggaggtggaggctgcagtgagccaagattgtgccattgcactccagcctgggcgagagagggaaactccatctcaaaaaaacaaaacaaaacaaaacaaaacaaaaaaacactattaaggtttagaaaaaggaatactttgactaccagcactgggcagcttcatgttcaacaaagcatgcaagatattaactgagactttaaaagccaagatatagggctcagaaaggataga

SEQ ID NO: 91998 - DNA, 601 bp, Human
aaggaaggtggggagaaaagaggccaaagttggtagaatctaaatgcacattctgggttcaaatcccagctctacctcttatttgagctctcagtctcaattttctataaaatgagaatcctgtaagtccctaagtcacaagattgaggtcaagattaagtgtaatatacatgaaaagtccttgacacaggacttgatggagagcaagtgctcattaatgaagactactgctcttcacatgttgttattatcctcattatgttgttataccttttacagcagttttttacaggatccacaycttacgggctgtgactatcttaggaaagagaattacctacatgtatattcctacctcaggaatagagtggatactgggcaaatgtttaatgactaaacataactacctagactctttctttaagtgatacaagaaagaaaaggtgaggatacagaacactattaaggtttatggccaggtgcagtggctcacgtctgttaccccagcactttgggaggctgaggagaggggatcacttgaggccaggagttcgagaccagcctggacaacatggtgaaaccacatctctactaaaaacat

SEQ ID NO: 91999 - DNA, 601 bp, Human
gaacttgggaaaaccaagaggtcagagaggacgtgggagggggctgaaggctctctagacctgccctggatgagtccacccatttgaaggaaggtggggagaaaagaggccaaagttggtagaatctaaatgcacattctgggttcaaatcccagctctacctcttatttgagctctcagtctcaattttctataaaatgagaatcctgtaagtccctaagtcacaagattgaggtcaagattaagtgtaatatacatgaaaagtccttgacacaggacttgatggagagcaagtgctcaytaatgaagactactgctcttcacatgttgttattatcctcattatgttgttataccttttacagcagttttttacaggatccacatcttacgggctgtgactatcttaggaaagagaattacctacatgtatattcctacctcaggaatagagtggatactgggcaaatgtttaatgactaaacataactacctagactctttctttaagtgatacaagaaagaaaaggtgaggatacagaacactattaaggtttatggccaggtgcagtggctcacgtctgttaccccagcactttgg

SEQ ID NO: 92000 - DNA, 601 bp, Human
gcttgttcagcagaaacatatgaacttgggaaaaccaagaggtcagagaggacgtgggagggggctgaaggctctctagacctgccctggatgagtccacccatttgaaggaaggtggggagaaaagaggccaaagttggtagaatctaaatgcacattctgggttcaaatcccagctctacctcttatttgagctctcagtctcaattttctataaaatgagaatcctgtaagtccctaagtcacaagattgaggtcaagattaagtgtaatatacatgaaaagtccttgacacaggacytgatggagagcaagtgctcattaatgaagactactgctcttcacatgttgttattatcctcattatgttgttataccttttacagcagttttttacaggatccacatcttacgggctgtgactatcttaggaaagagaattacctacatgtatattcctacctcaggaatagagtggatactgggcaaatgtttaatgactaaacataactacctagactctttctttaagtgatacaagaaagaaaaggtgaggatacagaacactattaaggtttatggccaggtgcagtggctcacg

SEQ ID NO: 92001 - DNA, 601 bp, Human
ctaccatccctcctggatctattttcatgtctctctctgtctatagtatttatctctattttaacatgactgcctattttttttaaccctcaaactgggacagttcccagggggatgggttttgcctgcagttaaaagcacgatgtgattctacacgtgctcagcagctaaatttgtggtgggtcagagcagcagtgcttgttcagcagaaacatatgaacttgggaaaaccaagaggtcagagaggacgtgggagggggctgaaggctctctagacctgccctggatgagtccacccatktgaaggaaggtggggagaaaagaggccaaagttggtagaatctaaatgcacattctgggttcaaatcccagctctacctcttatttgagctctcagtctcaattttctataaaatgagaatcctgtaagtccctaagtcacaagattgaggtcaagattaagtgtaatatacatgaaaagtccttgacacaggacttgatggagagcaagtgctcattaatgaagactactgctcttcacatgttgttattatcctcattatgttgttataccttttacagcagttttttacaggatcca

SEQ ID NO: 92002 - DNA, 601 bp, Human
tctatgcccatagctaccacattgtaacttccagtgccccctccactgcagtccagagcgagagggtggacatgacagaaccaaggagctttcaagaagagcctaaacttagctcaaaagaggttatgggggtctctgctgctgaggtcccagtcccattctagactcagtgtctgttcttcactttagggctccctgcctccttcacccttacccacatgcaatgggctaaatgaacctcaacacatagtttcctgacagttgagagggaggaaggaattgtaagtaagaataatacttkcagactgagggctttctaagcacagagatctcatcttgcttttcttcgtatctccaaagcctggctcatttgcaggtacataacatatgcttgataacaagtttttgtactgaatcaagatctatgacaactatgtgacgataactaaccccagtatggctcagtagtgttccctgaattttacaggcaccaattcaagctccaggattgtatttcctctacccatgatagaaagagggtagaggtcaccttagcacctcactgataggaggccaaccaagcactgaaagttctggccct

SEQ ID NO: 92003 - DNA, 601 bp, Human
cactaagtctcatggaggttggtgaatttgctccatcatgcatggctaggactctggtctaggtctgtctggtttctatgcccatagctaccacattgtaacttccagtgccccctccactgcagtccagagcgagagggtggacatgacagaaccaaggagctttcaagaagagcctaaacttagctcaaaagaggttatgggggtctctgctgctgaggtcccagtcccattctagactcagtgtctgttcttcactttagggctccctgcctccttcacccttacccacatgcaatgrgctaaatgaacctcaacacatagtttcctgacagttgagagggaggaaggaattgtaagtaagaataatactttcagactgagggctttctaagcacagagatctcatcttgcttttcttcgtatctccaaagcctggctcatttgcaggtacataacatatgcttgataacaagtttttgtactgaatcaagatctatgacaactatgtgacgataactaaccccagtatggctcagtagtgttccctgaattttacaggcaccaattcaagctccaggattgtatttcctctacccat

SEQ ID NO: 92004 - DNA, 601 bp, Human
gtctacttgacccccagtggtcagaagggacacggaatgcttgtgctgccctccacaaggtgtggggtgggtcagcccgtggctgctaagagcatcttgaatgcaggcccacaacaggttagaataggctgataatacagagaagcggcacagagcaggagcaggagcagagtggcagccggaacccatgtggcatgcctggctggagaggatgggcccacggacactcacgcccccgcagggcgagggctcactaagccagtccttcccacttcctgcttcttcatctggtgcctggcarggtggcgaactcaggccagagcagacgtcagagaggctgggctggttccagggcccggaggctccgttctggaaccctttcttagagtcccctgtgaggcaggagagcttcatggagaaaatgccagtctgtggaggcactcagagctgggcttgggactcagctctgcctcttcctcatgctgtggcctcagtttcctttctgagcctcaggccccttatccatcaaacgggggtaataataggacaatcgaccttcggtatctgtgggttccacatctgcagattcagccaaccgcag

SEQ ID NO: 92005 - DNA, 601 bp, Human
cagggaagcctgttctccatggtgggaagcacacgtgcaaagtccccagggaaacaggaggctgcatggtcaaggaacagtgagggggctagcgtgactgaggggaagtgaccagtggcaagataagggggagacagggtagagaggcagccccaagccaggccgtgcatgaccatggggaccatccagaagagcaggcactttgatgggaagcccttggaactgagcacgggggaacagcaggagctaattgtcccttacatcacatggctcaggctgctgtgtgcagaacagaccatgrgttggggtagaagtggaagcaagaagccccagtcacaggctattttcatcacccaggaaagaaaagaaggaggcataatccaagtgtaagaagttatttttgctcaaaaaatatttacttttagccattggtatcatcttaaatttactatcaatatatccccaaatttcaaagtgggttatttttgcaccttgatatcagacaagggttgtctgatgtttctctcctctttcctctttccctttttttttcaactattaaaatagtcttcactaagaaaaaaaagttgtttttaatttg

SEQ ID NO: 92006 - DNA, 601 bp, Human
ttgccgtgaaggagggcaccctgtggctgggtgaggtggctcacgcctgtaatttgggtggccaaggcaggaagattacttgaggtcaggagtttgagaccagcctggccaacatggtgaaactccatctctactaaaaaaaatacaaaaattagccaggcatggtggcagttgcctgtaatcccagctacttgggaggctgaggcaggaaactcgcttaaacccaggaggtggaggtcgcagtgatccaagattgcactattgcactccagcctgggtgacagaatgagactccatctcaaaaaaaaaaaaaaaaaaaagtagggggccctgagaccatctcagggaagcctgttctccatggtgggaagcacacgtgcaaagtccccagggaaacaggaggctgcatggtcaaggaacagtgagggggctagcgtgactgaggggaagtgaccagtggcaagataagggggagacagggtagagaggcagccccaagccaggccgtgcatgaccatggggaccatccagaagagcaggcactttgatgggaagcccttggaactgagcacgggggaacagcaggagctaattgtccctt

SEQ ID NO: 92007 - DNA, 601 bp, Human
tcaaaatgtaactggatttggagaaaaggtctttaaggggataactaggttaaaatgaggtcattagggcaagccctaacccaatgtcactggtgtccttcttagaagaacaggagtttaggactagacagacacaaagggaaggccatgtgaagatacaatgagaagagcccagaagagaggcattcgaagaaaccaaccctaccactaccttgagcttgaactccagaatagatttctgttgttaaagccaccgagtctggaaggtcatggaagcctcctcacggaggtgacatcttakcagaggcctggttgccgtgaaggagggcaccctgtggctgggtgaggtggctcacgcctgtaatttgggtggccaaggcaggaagattacttgaggtcaggagtttgagaccagcctggccaacatggtgaaactccatctctactaaaaaaaatacaaaaattagccaggcatggtggcagttgcctgtaatcccagctacttgggaggctgaggcaggaaactcgcttaaacccaggaggtggaggtcgcagtgatccaagattgcactattgcactccagcctgggtgacagaatga

SEQ ID NO: 92008 - DNA, 601 bp, Human
ccccaggcacctcaatcaacacaggacaaggaacatgctgccgggaagtttgcaccattttccataacacccatcgtgtgtgcagtgagacctgcttctacccagagctatggtcgggggataaagaggacactaggtgttacaagctaaattgtgaccccccctaaaatttatatgttaatgttataacacccagggcctcaaaatgtaactggatttggagaaaaggtctttaaggggataactaggttaaaatgaggtcattagggcaagccctaacccaatgtcactggtgtccttyttagaagaacaggagtttaggactagacagacacaaagggaaggccatgtgaagatacaatgagaagagcccagaagagaggcattcgaagaaaccaaccctaccactaccttgagcttgaactccagaatagatttctgttgttaaagccaccgagtctggaaggtcatggaagcctcctcacggaggtgacatcttagcagaggcctggttgccgtgaaggagggcaccctgtggctgggtgaggtggctcacgcctgtaatttgggtggccaaggcaggaagattacttgaggtcag

SEQ ID NO: 92009 - DNA, 601 bp, Human
atacaatgattttgtaccccaagccaggagttcacttggtaagcagtacacacatcctacatgttcatttcattgttgctcctctatcacctataaacccctagttataggcacacacctgaaacaaaatgcacattattccaggcccatataaatattctccatgcatgcttcactctgcacatgctccactcatattccactctgtgcacagctccaaactctctggcaagcacccccaggcacctcaatcaacacaggacaaggaacatgctgccgggaagtttgcaccattttccakaacacccatcgtgtgtgcagtgagacctgcttctacccagagctatggtcgggggataaagaggacactaggtgttacaagctaaattgtgaccccccctaaaatttatatgttaatgttataacacccagggcctcaaaatgtaactggatttggagaaaaggtctttaaggggataactaggttaaaatgaggtcattagggcaagccctaacccaatgtcactggtgtccttcttagaagaacaggagtttaggactagacagacacaaagggaaggccatgtgaagatacaatgag

SEQ ID NO: 92010 - DNA, 601 bp, Human
tctgctgggagacaagagtccagaacatacaatgattttgtaccccaagccaggagttcacttggtaagcagtacacacatcctacatgttcatttcattgttgctcctctatcacctataaacccctagttataggcacacacctgaaacaaaatgcacattattccaggcccatataaatattctccatgcatgcttcactctgcacatgctccactcatattccactctgtgcacagctccaaactctctggcaagcacccccaggcacctcaatcaacacaggacaaggaacatgcygccgggaagtttgcaccattttccataacacccatcgtgtgtgcagtgagacctgcttctacccagagctatggtcgggggataaagaggacactaggtgttacaagctaaattgtgaccccccctaaaatttatatgttaatgttataacacccagggcctcaaaatgtaactggatttggagaaaaggtctttaaggggataactaggttaaaatgaggtcattagggcaagccctaacccaatgtcactggtgtccttcttagaagaacaggagtttaggactagacagacacaaag

SEQ ID NO: 92011 - DNA, 601 bp, Human
ggtcatgttcaggaaagcaatttaagagctacatgtcagattccagaaatctcaatgtcattgcacatgggatgatgatgatgataattatcatgatgatggaggcagtaaagggaggacctagttgtcagccaagtgtccaccttcattctcctctgagccagcagagaaaaatgtggtactctagcttcttccagagatttagatgttcaccatcagcagcaagctaattgcaaagctgcaagaaacatggaaagcccacagaaggtgcatggcccctttatttcactcacacacaaacacacacacacacacacacacacacacacagccctctggctacagccatttagagctctcctggaaaagagaaaatcttccagcagcaatggcaagcagagggcaggaaaggggcttgtgccactccaagaatttgatgagcacccgatatcaacagcataaataagccctttaataaattagagagctatccatttaaatggattctgcagtcccttcggtgccagctaatctgtaattcagatagatcagcgatggctctgctgggagacaagagtccagaacatacaatgattttgta

SEQ ID NO: 92012 - DNA, 601 bp, Human
cagggtcatgttcaggaaagcaatttaagagctacatgtcagattccagaaatctcaatgtcattgcacatgggatgatgatgatgataattatcatgatgatggaggcagtaaagggaggacctagttgtcagccaagtgtccaccttcattctcctctgagccagcagagaaaaatgtggtactctagcttcttccagagatttagatgttcaccatcagcagcaagctaattgcaaagctgcaagaaacatggaaagcccacagaaggtgcatggcccctttatttcactcacacacaaacacacacacacacacacacacacacacacagccctctggctacagccatttagagctctcctggaaaagagaaaatcttccagcagcaatggcaagcagagggcaggaaaggggcttgtgccactccaagaatttgatgagcacccgatatcaacagcataaataagccctttaataaattagagagctatccatttaaatggattctgcagtcccttcggtgccagctaatctgtaattcagatagatcagcgatggctctgctgggagacaagagtccagaacatacaatgatttt

SEQ ID NO: 92013 - DNA, 601 bp, Human
atgtgtcctgagggctgggtgcagtggctcacacctgtaatcctggtgctttgggaggccgaggtgtgcggatcacttgaggtcaggagtttgagaccagcctggccaacatggcgaaaccccgtttccactaaaaatacaaaaaattagccgggcgtggtggcaggtgcctgtaatcccagctactcaggaggctgaggtgggagaaacgctggaatctgggaggtggaggttgcagtgagctgagattgtgccactgcactccagcctgggagacagagcgagactccctctaaaaagaaaaaaaaaaaagaaagaaatgtgtcctgagcaagggctgttctttgagtgtcttggccaattccagaaggtggagcaacgggaagctcctggtgaccttcaaggagagcaaaggtccttctacattgctattgactacaacctcaggggagcatcagggaaatatgatcagtgccttccagtgccctgctctgcccctgggggctgtgagctgccgggaaaaccctgactcccacttccagccacccagggctgcacccatagcctcttgcagaacaccttttgagctgttcctagtcct

SEQ ID NO: 92014 - DNA, 601 bp, Human
agaaatgtgtcctgagggctgggtgcagtggctcacacctgtaatcctggtgctttgggaggccgaggtgtgcggatcacttgaggtcaggagtttgagaccagcctggccaacatggcgaaaccccgtttccactaaaaatacaaaaaattagccgggcgtggtggcaggtgcctgtaatcccagctactcaggaggctgaggtgggagaaacgctggaatctgggaggtggaggttgcagtgagctgagattgtgccactgcactccagcctgggagacagagcgagactccctctaamaagaaaaaaaaaaaagaaagaaatgtgtcctgagcaagggctgttctttgagtgtcttggccaattccagaaggtggagcaacgggaagctcctggtgaccttcaaggagagcaaaggtccttctacattgctattgactacaacctcaggggagcatcagggaaatatgatcagtgccttccagtgccctgctctgcccctgggggctgtgagctgccgggaaaaccctgactcccacttccagccacccagggctgcacccatagcctcttgcagaacaccttttgagctgttcctag

SEQ ID NO: 92015 - DNA, 601 bp, Human
acctgtttcaagaattaaaataatctcacatgaatttcaaatatgacaaaaagactgcattttcacagaaatgtgctgctcactcgttccctccttccacaaagccttagcatggttccgcatggtctgagaatctctgaggcaagatagcctgtccggaaaaccctttggcactttctcagtatctccccattggggtgactccacagagagtcgacaacatgttcttcctggttggcttagggttgtgacaaagtcccttctgatgatcagcctcacttaagcaataatctcattcatrtggtatcaagaacacaaagaaatgtgtcggccgggcgcggtggctcacgcctgtaatcccagcactttgggaggccgagacgggcggatcacgaggtcaggagatcgagaccatcctcgctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaac

SEQ ID NO: 92016 - DNA, 601 bp, Human
tgagatcataatttagagctgagaagaaacctgtttcaagaattaaaataatctcacatgaatttcaaatatgacaaaaagactgcattttcacagaaatgtgctgctcactcgttccctccttccacaaagccttagcatggttccgcatggtctgagaatctctgaggcaagatagcctgtccggaaaaccctttggcactttctcagtatctccccattggggtgactccacagagagtcgacaacatgttcttcctggttggcttagggttgtgacaaagtcccttctgatgatcascctcacttaagcaataatctcattcatatggtatcaagaacacaaagaaatgtgtcggccgggcgcggtggctcacgcctgtaatcccagcactttgggaggccgagacgggcggatcacgaggtcaggagatcgagaccatcctcgctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactg

SEQ ID NO: 92017 - DNA, 601 bp, Human
ctgcagaggaactcgaagctctttgccaacagtctctcttcaccctccccacctctctattggaaagagattaaagaagatctgtgccacttaaaaaattaaactgggaggagtagacagatggggacatgtggcatcttaatgaccacatccaaacagtgccactggtgaatcattggcagttctaggagaaaaagcacttcccaatttttggactggactcaaactcagattctaataatgcaatttcatatgaacaatcaaataacatatttcctggaaatatgaaatatattcattyaatgacccttgaaaacatcatcatcattataatcttcatcatcacagcatctccttagatttgcatagcgcttcatggaaccaagcactttcacattcactggctcattgcttccctctcccaatcactctctgacatagataaggtaggtgacaagccgccctttcaatcggtgatgaaactaagacccagtgaattgcccaagttcactcaatcaaccaaacaacatgagaacccaggatttccagtgtattcacccaatactgaggcaccagccctctctggttccatgctgcaaaa

SEQ ID NO: 92018 - DNA, 601 bp, Human
gggtaatggaggtggagggtgtcagggaggggagtataggtgcagaagtttgctagcacatatgacaggccaaggaggtgcagcaacggaagcactcacccatcgaacaggttgtcacattccaggtattttaggaacaaggagctgaaaatattaagagaatttgggcccaaggggttatctatcagctgatcagtatggaagccttattagctgtgtaactttaaataagtggcttaacttctttgagccttggtttcctatctggaaaactgggaaaatgagcctcccctcaacagtrtccatttatcagattctcaaaacatttattaggaacctactatgtgccagacactgttctaggaactggggatacaaaacaaagcccttgtttgatggcaataacattctaaggggagggcaacagaatgtggataactaaaccaataaatatatgtcatttgtctagtggtactggcagccacaaaggaaggtgcagcagggtaagggggcagagagtaatgaggctaattttatataggtcacaagggttataggagttcagagattcaaagggcctgtcccacagtcagtgtgtgga

SEQ ID NO: 92019 - DNA, 601 bp, Human
aatctttgggtaatggaggtggagggtgtcagggaggggagtataggtgcagaagtttgctagcacatatgacaggccaaggaggtgcagcaacggaagcactcacccatcgaacaggttgtcacattccaggtattttaggaacaaggagctgaaaatattaagagaatttgggcccaaggggttatctatcagctgatcagtatggaagccttattagctgtgtaactttaaataagtggcttaacttctttgagccttggtttcctatctggaaaactgggaaaatgagcctcccctyaacagtgtccatttatcagattctcaaaacatttattaggaacctactatgtgccagacactgttctaggaactggggatacaaaacaaagcccttgtttgatggcaataacattctaaggggagggcaacagaatgtggataactaaaccaataaatatatgtcatttgtctagtggtactggcagccacaaaggaaggtgcagcagggtaagggggcagagagtaatgaggctaattttatataggtcacaagggttataggagttcagagattcaaagggcctgtcccacagtcagt

SEQ ID NO: 92020 - DNA, 601 bp, Human
tataattttaagaaaacttaggaaacaatatgataagagagcatatataatattttccatgggtctgttgcagaattttcatcaaatttactctctaataccatttaggtgtgtcttcattcataaacatgtacaaattgggtttgacattcaaagaccgtggtcatctaattatttcactaaccacatctcctaccagcaattgagtaaaagtacacgtctgctgttccccaaatacacaatctacatttccacctctgccacacctgtgctccagcccaagacatttgctttgatgcckacaacccacctgcccaaccctacacctcccaggaaccagctcaatccccaccactcccttgaagcatttcttgaacctaactctccctcctctttctccccactccacccactcacagttatttcttcctgtagattcgtgcagctcttctgaagatcaaggtttgcctattgcctctctgtctctcgctagtgattctctgcaacccaagaataaggcttaacagggaaggaagttgttgtgactccatgcttttattcctcttgactaagaaaaggcaacagtgtttatcacaatgag

SEQ ID NO: 92021 - DNA, 601 bp, Human
gtctcctgctcaaatggaccgcatgcaagaggcatggaagtgatgcttcgaatacttacatagtatgcctagtctattttaagtccttaacagtttatttcccctagttttcaagagtttatgttcccagggcagcaggcataattttgaccctgtgaggttacagctatttaagcaggtttgctttattattttttaattgcttaacaatattgtttgttggtgatctattaaaaaccccacagtgttttataatggaatttaaaattcatgtaattttaaagtgtccacttcagaatgktgtgtgtgtttatggggttcactaacagctaatattaattagctgatcctgacactgacctaagcatttaagctaagcaaaatgatatatgtaaaaggtcagtatgtagcaagccttatctgaataatgtcaaccctggccaagaggctgttgtcaatattatctgaaactgctgagttcccaaacacactcagaacattggcctaatatgcaaatgtgtgaatcaggggattcctcccaaggtgcctttaaatagcaggccctttaaagacactgtggtgcagctgagggtattttaag

SEQ ID NO: 92022 - DNA, 601 bp, Human
gagacagaaaagcaagtcttgtctcctgctcaaatggaccgcatgcaagaggcatggaagtgatgcttcgaatacttacatagtatgcctagtctattttaagtccttaacagtttatttcccctagttttcaagagtttatgttcccagggcagcaggcataattttgaccctgtgaggttacagctatttaagcaggtttgctttattattttttaattgcttaacaatattgtttgttggtgatctattaaaaaccccacagtgttttataatggaatttaaaattcatgtaattttraagtgtccacttcagaatggtgtgtgtgtttatggggttcactaacagctaatattaattagctgatcctgacactgacctaagcatttaagctaagcaaaatgatatatgtaaaaggtcagtatgtagcaagccttatctgaataatgtcaaccctggccaagaggctgttgtcaatattatctgaaactgctgagttcccaaacacactcagaacattggcctaatatgcaaatgtgtgaatcaggggattcctcccaaggtgcctttaaatagcaggccctttaaagacactgtggt

SEQ ID NO: 92023 - DNA, 601 bp, Human
aagaaaatgtcaagataaaatgtaggctatgtatttaaatttaactcctttgcagagtcaggggaagacttgggattattaaaatgaaaatcaagatcttgtaaaagtcaaaccatcttaccaggaaaggagatttatcctggaaggcaagagcaacagatggatgccacaagggtcctgagttctaatccaagctcttaccccagcactgctgtaaatacaactgtgtgcaatcgggaaggtgtcaccttatctctgtgaggcttcaagttcctcctgtaaggtcaaccgtaacctcccrctaccctacaacactgacgaaatgaaatgccagcagtgtcaagggcaaatgaggaatcagagaaggatatattttaagatctggtgaggtgtgtagaaattgcttttcctctgtgcctgatagaagatgcacagaagcaaccctggagctgagaatgcagtgcaaggtggtgctgaagagacagaaaagcaagtcttgtctcctgctcaaatggaccgcatgcaagaggcatggaagtgatgcttcgaatacttacatagtatgcctagtctattttaagtccttaacagtttatttccc

SEQ ID NO: 92024 - DNA, 601 bp, Human
ccctggtgggcgagagcttcgcatcaacaaatctgggagcaggaactcataaaacggaataagtggaagcacaacaaacacaattaaaaatccagccatgctcagagagggattccatttactgtctcataaaaagaggctggtcctcagaggcaaacaaaagaaaatcaatttcttaatttttattggcagatgtgggacagaggccaagtgaacacgggctgtgctcaagaacagacctggggactagtcatggccttctgttcctagacttgttcctctgggccctcccctctctgcstcctccggcttccagacagactctgccctctgtggtctccggggcacatggggtcctgcaggcagcacagcaaggcctgccctccgcacttctccgctcctctccctgaatcatttcccaaaagataagctttattctctggctcgaattccctcccagcctcttacaggaaccaaaggcgttgttcatgcctcgcagcattcatagcttggaggtatcacttggtgattgaaaatgatgttgctcatcaaccagcccaagaacacgcacttaaggaaggggaaggcaggatgggtattt

SEQ ID NO: 92025 - DNA, 601 bp, Human
aaaaggaaagatggagggaaaataaaactgacattaattaaataccaactacatgccagatatgttgctgggcactttcttctcatctcatttgatcctcaacaactaccattattctcatttaatcaacaacaaaacctatcctcaaataagtttaagtcattttcaaaaatcacctagtcaggaagtggtggaacctgtatttcaagccattttgtttgactccaaagttctgcgtcttcacaccaaactacccattttctcaacagtatggctgacaccaagtatttttcacaaacaragagtgcttggtgtgaatacatgagcctatatacagaaggcgatatgccagctcccctgtgattggggctaaatcagtgcatctagggatggactgccaaatattttcagggttggaccagcccacataaaatagctctgggctgacaagtccaacagatagacttaaattgtacaattccaactccagaatcgattcctgtactccttcctttacacttgtacttccttccaaagtagggttggggggcagcaatctcacttcccaactcagaagccctcttgggagctgtggtaagca

SEQ ID NO: 92026 - DNA, 601 bp, Human
tgaagagtccttggaaattacgatcgtcaaaattttaaagttaaaggagagtggaagataaagccaagaaatcttccagaaaattaaacaaagaggaaagaggtggtaaataaaaaaggaaagataagaaaatcaaaggtttgataaagagatccaccatctaattaaaagaaatcccagagagagagagacagggaaaatgaatatgaacagaagagatgaatggaaaactgaaaaacttttggaaatttcacccaaattacttacccagtttccagcacaattaacacaagtgcacaamtatgaatgtatgtgcacatacacgcacatacacacacacacgtatatcaaggcacacaattacaaaatgccagagccctagagataaagagaagatgctaagagcttccaggcaagagggatacatttataaaggaacagcaatcagaaagacaatggaatcattctctataacaataccactattgttattctacagagcaattccttcaacatttggatggggaactttttaacctggaaatctacacctaaaaaaaaaaaaaatcaatccactctaagaacaaaataaaagtatttg

SEQ ID NO: 92027 - DNA, 601 bp, Human
catctcatgattttcctctgataaggcattgtttgttttcccctgctccttcaagtctcatcagtaaacctgctgccttcccattttcaccaaccttttcttgtttacactgaagaaccgtctggatcctgagaatagccactttgaatcacaaatctagagggctctagaaggaagacttcctccacatggtttgcctagtgggatgagtccttggctatgctttgttttgacaccaaaggatgttcaccaggccccatagctctctccatggctcccaggcttccatggggacacttaytctgaaggcccagaggaaacttgcctccaacacaccagagagtcatcccatctggcaactgtgcggataacctggtatcaggagcttctgtgagcagatatgatcacgagatcatattctgcaccaggaatccagagcttccactaaagaggacagagggatcctcattattcacagattctgtatttgggaattcacttactttctaaaatttatgtgcagtgccaaaaccaagactcaaggcactttcctggtcatttagggccatgtgtagagtgacaaaatgtgaccttagaggca

SEQ ID NO: 92028 - DNA, 601 bp, Human
gaagaggaaaggaaggattgattcccttataggtttcagagggaggatggccctgtcaacaccttgatttcagactttgggcctccagagctgtgagataaaaaatttctgttgtttggggccacccaacttatggtactgtattccggcatccctaagaaactaacacaatgcttttcactaagtgaggaaataaaaactgtaatacagccatacaatgaagtactgctcagtgataaaaataaatgagaatcgcttgaacccgagaggtggaggctgcagtgagctgggattgagccatcgcactccagcatggggacaagaaagactttgtctcaaaaagaaataaaataaaataactgagctatcaggccaggcacggtggctcacgcctgtaatcccagcactttggaaggccgggacgggtagatcactaggtccagagattgagaccatccttgctaacacggtgaaaccccttctctactaaaaatacaaaaaattagccaggcgtggtggcgggtgcctgtagtcccagctactcaggaggctgaggcaggagaacggtgtgaacccaggaggtggagcttgcagtgagcca

SEQ ID NO: 92029 - DNA, 601 bp, Human
ttgtaccaacatttagggaactcagacatcagcacccagcagagattaatatcttgaggctgagactctgtggacaagcttgtatgtatactaaagttcaagcccatgggcccaggacttatttgcttggctcccaagatatctcattctggcaacatccagctctttctacaaagaaagaatactagtaatgtcttcagactcatccctccctccagagaccttgggcttaccaaacctagcatcacagaattcctgggggtctcctagttattctaactgaatctgaagataagattgaagaaaaatcagagggagacaatactaatttatgtccatttaaaatgttttatgaaacactgcctaccaagcagggcctggagatactgaactggtgaaaaaggttaaagctaaatgtttccattattaaccaagagtcaccaagattcatcttatggttcccctagagtggactgtcaagatccaaccaggagaataaaagaggggacccatcagaatcccccacccaccttggtcctatttctctcccatgtcacatctagcagagcctgcctcctaaaacaaccgcaggaagctaaca

SEQ ID NO: 92030 - DNA, 601 bp, Human
tctgtcaaaccagccatgatttagttaaagctcctaagtaacaaatccccacaaatccccaagcacatatttaaaatctattttcagaattacactgagcataattcaaccaatcaatgagccattaggagtttaatcccaacacttcttcattaccagtggcatgagggctgctcgactcagcagaatccaatgcgaagagttgctatatcaccagcaattctaggtctggggacagaagcttatacattgcctgctgagaggcccagccacaatctgggtgacaaatcaagctacagawccaccagcgacaggataaaaggagactcggccaaaaataggtcaacttggatccaaggacttctgctcttctccttcaagggtagctcttgcatcaccaccaatgcccatctctagctggaccctgcttctgggaggcctgcctcatggggatctgaagctccaaagagcctcctggggtggacacacggagggggatgactacataggagctaaagtgctagagaggaattgccttctgctgcctcactggtgagcaccatgggtcacccaaactggtatctgtctgaaagtctccaag

SEQ ID NO: 92031 - DNA, 601 bp, Human
ccagcacattttcctgactttggggaatagggggagaggggtcacccagagatgaacatcacatcccaggcacaggctccctgtgttgatgtctctgtcaaaccagccatgatttagttaaagctcctaagtaacaaatccccacaaatccccaagcacatatttaaaatctattttcagaattacactgagcataattcaaccaatcaatgagccattaggagtttaatcccaacacttcttcattaccagtggcatgagggctgctcgactcagcagaatccaatgcgaagagttgctrtatcaccagcaattctaggtctggggacagaagcttatacattgcctgctgagaggcccagccacaatctgggtgacaaatcaagctacagatccaccagcgacaggataaaaggagactcggccaaaaataggtcaacttggatccaaggacttctgctcttctccttcaagggtagctcttgcatcaccaccaatgcccatctctagctggaccctgcttctgggaggcctgcctcatggggatctgaagctccaaagagcctcctggggtggacacacggagggggatgactacata

SEQ ID NO: 92032 - DNA, 601 bp, Human
tgaagttatttagaagttgaggaatagaaatgaattccctttatgatctgacagcattaagtaacatgaaagcagcctgggaatcaaacagatgcctagcttcaagtttccttccttttcaatgccagtaggaactcagacacccttctaagagatccttcaagtgcagacaacatttcagatcatgtacaaaaaatcctgtagcagggcctgacttggccaggcactgtggctcatgcctataaatctagcactttgggggactgaggtaggtggattgactgagcccaggtagcaggcrtggtggtgcgcctgtagtctcagctagttgggaggctgaggtgggaggacagattgagcccaggagattgaggctgcagtgagccaatatcacaccactgcactccatccaacttaggcgatacagtgagaccctgtctcaatttttttaaaaaaagacttaagatagtaacactgtatctcactaggaagccagtgcagcaaagtggcagtgccccttgaaagtttactaaaataacaaaatatcgctccaaaggaaaacagtgatatctgaggttcttagaatttgtaaaagtgttgg

SEQ ID NO: 92033 - DNA, 601 bp, Human
tgccttcctcatgcgtgaaaaagcaactgagacccatctcaggagagtctgctcagctgggagaggcacagggagcacttgtgcccacctgtgtcaactgacaccacatgaggacaaatggaggccatggcaaggtttagtacaaaaatgaaaaaacctagcgtgaggagagacatgacccccggcctccaaaatgtggacaagcctgaaccaaggggttgatgtgctgggatgtgctctaggtatgatacaatgatagcttgagttatattcataataactatcctatatgggcattctrttatccttatttacagacaaggaagcaaggcttaaagaactgaagtgactagtccaagacacataaccagtagtcggcagggtggaaccaaaacccagttgtgcccagcatcaaatcctgctcacaataccatactgttggctaagtggtttcaggcagaacaatcaggaccagggaatgggtccccaaaaagatgattcttgggccaggataggacaacctttttcacaattagagctgcctgaaaggagactggacactctggaaagagtgacttttggtcactagaaaaacgatctg

SEQ ID NO: 92034 - DNA, 601 bp, Human
tatcccactgcctaagggccagagcacagaaaaaggtgctaggaggcagtctccctctcttaccaaaataagcctgagaccctcccccatctaccccaacaactacacagtctacacttcaatttccataacattccattccccttcaacaaagtttttacccttgaacattattagcaacctatcagagatagggcaatacatttgaggaaatctatcttcacatcaatatggtaaatccaaggataaccagagcataagaggtttctgtaggaaggatctctcatcccctcaaatgccgatgtgcactggggctcactaggaggcagatggtatttacagcccttcccaaacttatttagtggaacactttttcaagagcttctcacaggaccatatcagaacacttgtaatttacagcatctgtagctgtcaaaatagcctctgactttaaggagaaagtaaaaatgttcattaccaaatccagcaagcaccagggtggatgattaaactagaatatttcagtcatccccaaaaaaatttttcccacaacctctcataattattctaggcttttctctccttctcttccacccccacc

SEQ ID NO: 92035 - DNA, 601 bp, Human
tgcatggaacagaccacctcaaatctctccaaaggagagatttcaacaaatcctggaatacctgacatctgtatatcccactgcctaagggccagagcacagaaaaaggtgctaggaggcagtctccctctcttaccaaaataagcctgagaccctcccccatctaccccaacaactacacagtctacacttcaatttccataacattccattccccttcaacaaagtttttacccttgaacattattagcaacctatcagagatagggcaatacatttgaggaaatctatcttcacatcratatggtaaatccaaggataaccagagcataagaggtttctgtaggaaggatctctcatcccctcaaatgccgatgtgcactggggctcactaggaggcagatggtatttacagcccttcccaaacttatttagtggaacactttttcaagagcttctcacaggaccatatcagaacacttgtaatttacagcatctgtagctgtcaaaatagcctctgactttaaggagaaagtaaaaatgttcattaccaaatccagcaagcaccagggtggatgattaaactagaatatttcagtca

SEQ ID NO: 92036 - DNA, 601 bp, Human
catgaaaatcttcaaaagagtaaataggcacaagggtgtaaggaaccaactgttatgatatatttggattttttttttttttttttgcactaagattccactcaatggctatttttaagatggaagtctccatggtaattgagatgtattctcatggatggagaactggtcaaagagtctcttgaaaaccctttcccattcaagagcagaatctcctgcttcagggccacgcacccataagaaagaaaagacaggacaatgagcctctctcttggtctaactggcttgcttggggtacttytgtttgctgtgcctctgacttgattctaggctttcccttacctctcttgtctttcagcacctgtgccctcctccacctggtggagctttagagctttacaatttgtccagtatcactccttcactattcacctgatctctccatccttaatgcccctcctggcatccctgatctccaagagggactatgccagagtccctctgagatgatcctaagctattccaggtaatataaaactaaaacaaaagttataaactataggaagagcccaagagacttttgcatgtgctgtaaacaaga

SEQ ID NO: 92037 - DNA, 601 bp, Human
tagagagaggttaagtaacttgccaatgttacatggttaccaggatgcagagctgagatttgagcccaggtaggatgcctccaacaatcacacagctaactactacaatgcactgctccgctgagaagaaagaggactgtggaacaaagtttcaaccagggaatcactcattgctaagccaatataacatatggaggaacaaacactttctccataaggaaaagtcaaacctcatgaaaatcttcaaaagagtaaataggcacaagggtgtaaggaaccaactgttatgatatatttggattttttttttttttttttgcactaagattccactcaatggctatttttaagatggaagtctccatggtaattgagatgtattctcatggatggagaactggtcaaagagtctcttgaaaaccctttcccattcaagagcagaatctcctgcttcagggccacgcacccataagaaagaaaagacaggacaatgagcctctctcttggtctaactggcttgcttggggtacttctgtttgctgtgcctctgacttgattctaggctttcccttacctctcttgtctttcagcacctgtgccc

SEQ ID NO: 92038 - DNA, 601 bp, Human
tactttcttcacatcctcaccaatactttttactgtccaacattttttattgtaaccattccagtgggtataaaatgatattacaatgtggatttgcatttccctaatgactaattataatgagcaacttttcctgtgcttattggctatttgtatatcttctttgagaaatgtctattcaaaccatttgcccattttttattgggttgtctttttattgagttgtaagtgttctttatatattctggatactactcccttatcagatatgatttacaaatattttctaccattcagtggrttgcctcttcattttcttgttggtgtccactgaagcaaaaaagttttcaattttgatgaagtctgatatatatattttttcttttgttacttgtgtttttggtgtcatatataagaaatcattacctaatccaagtctacagaaacttgcacctaagttttcttctaagagttttattgtttcaatgcttacatttaggtcttagatccattttgagttaatttttgtatatggtatgtggtaggggttccaagttcacaatgagcacgtgaatagctcattgtcccaggactatttgtt

SEQ ID NO: 92039 - DNA, 601 bp, Human
gattatagatatttgggtgaagcatacagtgcttcatacaattgtctggcaacaattggcatgaattacattccaattccaaatgcgagctgtaaacaatattcaacaagacagccgtgagtgtcctaagaagagagagaaggcgatgaagcatcaatgagacatttgctatgcattctctgtggtagagtctcctccttctatatatccttcaaaattctcaggcaacgaggatgtgaatacaactgcattcttaccaccctgcatgacccttctcccgcttgttattccactaaattgrcagggcctggagggaaatcttacctgcaaatatatcacaaacagacacacagattttgagcagtaaatattttttttatatgagttctctttggcagatcatatactcttattctaaaaatctcaagtatcaagtgtcaaatgtgatcaagtgttatcattatacaatacttttgatggatatgtgttctttgattcctagggaaaaaatatgaaattgaggtacgtttcttacgtaagaaacctggggtcatagtttctccagagatgtgccataggcacttagataacacttgtgccc

SEQ ID NO: 92040 - DNA, 601 bp, Human
agaataatgtacctacactcatttcttacttgtgacaaatgtatcatggtgatatagaatgattacaataggagaaactggatgagagatataagggaatgctcggtaccactgttataacttctatatgtctaaagctattttaaaataaaaagctgatttaaaatagaaagttatactttaaattttcattcagaatttataatttaatggtgtttagggaagacgttgatttttgtttattgatcctatattagcaaatttgctggactccctaattagttctaatgattattttatraataccctttgatgttctatgtagggtgatcagaatcttcacaataaggataatctgtctttccaattcttttatttcttttatcttattgaagtggctagcattacaagaatattactgaataaaagtcatacataataacaaacatgcttatcattatatttttttcatgtgtttcatacttttttttatttttattttttttagagagggtctggctctgtcacccaggctggagtgcagtggtgcaatcttggctcactgcaactttcacctcctgggtccaacagtggagaaata

SEQ ID NO: 92041 - DNA, 601 bp, Human
cagcaaaagggaaggataggaggaggggattaacttaaaaccctgcatggtcagagaaactggaaacactccattttgctgcagcctccactgaactgaggaagggaagggagcaaaacctttgggggcttggccttggattgtcatggaagaggaggagaggtctcatctaagtgggtctcagtctataagcatctttctgaaaggaggagaccctgacgatgagctgaggggtgtgtcggagaaggggtatgcactgtagggtcacttaggggctaagggatgggaggagaaggctatsctttcccagaactgacactctttaaggataccagaggggcatttctaattctaggagctaaaattacacagaccacttctgaccacaccaggaggtgggggtgctatactcccaagcctacaagctctttctcattgaccttttcgcctcacaccacaggtctgtggaaggtttagagagtaacggctgatctctgagccttgccatctttccaaatcttacaggggaggaaaataccctggaggagtaacactggtggccccgaggccacgtgctgcctcgagcaaggaggacttccat

SEQ ID NO: 92042 - DNA, 601 bp, Human
ataaagtaaaaaccaaaacccccaaagaagatcaaaactaggaggggaaatagagagggagcttgaaaggggaagaactgtcagcaaaagggaaggataggaggaggggattaacttaaaaccctgcatggtcagagaaactggaaacactccattttgctgcagcctccactgaactgaggaagggaagggagcaaaacctttgggggcttggccttggattgtcatggaagaggaggagaggtctcatctaagtgggtctcagtctataagcatctttctgaaaggaggagaccctgaygatgagctgaggggtgtgtcggagaaggggtatgcactgtagggtcacttaggggctaagggatgggaggagaaggctatgctttcccagaactgacactctttaaggataccagaggggcatttctaattctaggagctaaaattacacagaccacttctgaccacaccaggaggtgggggtgctatactcccaagcctacaagctctttctcattgaccttttcgcctcacaccacaggtctgtggaaggtttagagagtaacggctgatctctgagccttgccatctttccaaatct

SEQ ID NO: 92043 - DNA, 601 bp, Human
aaataaagtaaaaaccaaaacccccaaagaagatcaaaactaggaggggaaatagagagggagcttgaaaggggaagaactgtcagcaaaagggaaggataggaggaggggattaacttaaaaccctgcatggtcagagaaactggaaacactccattttgctgcagcctccactgaactgaggaagggaagggagcaaaacctttgggggcttggccttggattgtcatggaagaggaggagaggtctcatctaagtgggtctcagtctataagcatctttctgaaaggaggagaccctkacgatgagctgaggggtgtgtcggagaaggggtatgcactgtagggtcacttaggggctaagggatgggaggagaaggctatgctttcccagaactgacactctttaaggataccagaggggcatttctaattctaggagctaaaattacacagaccacttctgaccacaccaggaggtgggggtgctatactcccaagcctacaagctctttctcattgaccttttcgcctcacaccacaggtctgtggaaggtttagagagtaacggctgatctctgagccttgccatctttccaaat

SEQ ID NO: 92044 - DNA, 601 bp, Human
actgggcaagaacttggaaagcctcatgtttttaaaccccatggaggcatttgcagaatcgggctgggatcctgacacgaagaaccaccatccacaggacccaagaagtaaaacccttaagtgggaatccaaactcccagttaaatttgccaaaggcatagactctattctctactagtgtgcaacaccaccccaaaacaacggtgggttaaaacaaccacctttttcccccacaagccccccacaggatgctcccagtttcatgctctccaccattaggtgggcagcctatgctgacttsatacaatggaggccccatgggccagtggagctgggagccagaagtctactccaccaatgagtcagcaaatacgggagagtttcaggccctacaaatgtgcctttcctactgaagaagggaaagtcacccccttccctctcctcagtggatcaagttgaaaatgggggaagcgagccccctctttgggagagggtggccatggagtaaggcatgagtcaaagcaagcaaagtaaacacacatattgaccagagaacaggaggacacttccattggtgccatgagaggggctggaggaggcc

SEQ ID NO: 92045 - DNA, 601 bp, Human
gagtgtgtctctgaatgacaagtgtgttgacctgtacgcccaaagccccgtctttccttgggcaaggtcactttcccaacatccacagggaacatacaaaaccactccatcctagggacagccccactggctttgctggtgcaccaaagataaaggatccccaaccccactctcagacccccatatatcagctctcaagagaagatttctgtgagccttggctgctcagacaacagaacattccccagctaccaaaggagtgagggtctcagtggcctgagtagtgtctgtagaagtcagrtttgaatcttgctttcacctctcacactgtgtgaccctggatgaaccattcaacctctctgagcctctaattctttctcaatacgatgaaaaagcactttactgtatgagcctaagctatctggaagactctcaatgaaagcaaccaatggaacagattgtgaacacctttgtaaacaaagaacttaactaagaaacttctttaaaagagtaacaggaaaacaggaaaaaatgcaggtaacctggaatttctgtattttgaatgtttttgcaaaatttccaaataagaggtctgattcag

SEQ ID NO: 92046 - DNA, 601 bp, Human
tttggcctctccctcctggcagcccacatgaaacttgccatgagagtgtggctcacctgagtgtgtgcatgaaagggagtgtgtctctgaatgacaagtgtgttgacctgtacgcccaaagccccgtctttccttgggcaaggtcactttcccaacatccacagggaacatacaaaaccactccatcctagggacagccccactggctttgctggtgcaccaaagataaaggatccccaaccccactctcagacccccatatatcagctctcaagagaagatttctgtgagccttggctgttcagacaacagaacattccccagctaccaaaggagtgagggtctcagtggcctgagtagtgtctgtagaagtcagatttgaatcttgctttcacctctcacactgtgtgaccctggatgaaccattcaacctctctgagcctctaattctttctcaatacgatgaaaaagcactttactgtatgagcctaagctatctggaagactctcaatgaaagcaaccaatggaacagattgtgaacacctttgtaaacaaagaacttaactaagaaacttctttaaaagagtaacaggaaaacag

SEQ ID NO: 92047 - DNA, 601 bp, Human
tcaaatctctcctatattaaaaatgaaagttctccctcgaaccagtgcatgtcctcatggtccccaggacagcctcaacccttcaggcatccctgttccaactctttctccttggaaccctcaagaagagataaatgccgagcttggtctacccctcacccaggccactctagagagcaggagcttccatttggcataagggggtctcaaaccaaactagacttaaatagaagataaagcaactgagggtatatagaaaagcaccaacctagcctgatcaacttcctgtcagactggaacrtgagctcttccacattactttacttgtctcatctctactgcctcaatgactgagctccatcagggattactggggcccagtgaagcattcagatccacccaggagccttttcccggcccgcattctccactcttgctccatctctcctgcatacagggcctcacggtgtcctctcctcctgaaaggaagagggcaagttacagggagcatttcaactcttctagctgtgtcactgccagggtccaagggtgcacagatgtgccagttcatctaagcattttactctttggcctctccctc

SEQ ID NO: 92048 - DNA, 601 bp, Human
gaaaacggaggcctagactccaatcgcagctggttcctcattctgcccagcaacctttccatagatccccatagtcgtccatagtctcttccccgtcaattcagatgttccaactctccttgggtcttctcactagcagcacaaggccttgcctcattctttataggaaaaatggaagccaccagacaagaactccctcacttccttgccctatcaccttgaaaagacattccacatcctttcctctttttgcctcctgctctatgggaagagcactccctccatgaggccaatgctatcycttcctcctgagctgtggatacttttccttcccatattctcaggggccatctttatctattatctcttctcccatacactgataggctccaagcatcagaaaaaaagaaagctcaaatctctcctatattaaaaatgaaagttctccctcgaaccagtgcatgtcctcatggtccccaggacagcctcaacccttcaggcatccctgttccaactctttctccttggaaccctcaagaagagataaatgccgagcttggtctacccctcacccaggccactctagagagcaggagcttcc

SEQ ID NO: 92049 - DNA, 601 bp, Human
gtggccaaaagcattttgaggtgtcaggcagtccccctgtcagtcctggttctgccagtttcaagctgtggaaacctgagctagttattcaatctttctgagcttcagcttccttgtgggtaaaatctgactggttctgagtaagtgcttcataagttacatagaattattactattaatgccccacagtaaacccattcttgggaggttggcaaccagttccaggacctcatcatgtaatgctagtaaaaaagtccagcctctccagggcatgtccctggaatgtgttagatcgaatttyaccttgtttctacaagatcttattggtacagttgagtttctcattctctgagcttcagaaccagcacctgtcaaccaagtctctagaatgaagatccagggagcgcctggcaagcaccctgggttcgtgaactgagtcagctgtcaatctgtgcagcaaaatcccgcaggatcaaaatgtaagcttaaggtctgacaaagctactgtgaaatcctgttggtgacattcgaatgcaggaggtcagggagctgcaggactggctggttccctgagccaccctaagctgaggccagtccaaac

SEQ ID NO: 92050 - DNA, 601 bp, Human
cacccttagaacagatgaatgaagagacccgcatgtgtcctggaggcaagctgagagctgtttgggtaaggaattctggtttaggaaatgaaacattgtctagaagggaggtggggtgcaggctccagatggtcccttctcatggccctaggacttttggcagctaaaggagggccctaaaaagtggggaggtcccctcttacccaagactagtgaatactggactgtattgtctctagactggggtttctcaacgttaatactgttagcatttggggctggatcattctttcttgtgggragctgtcagaagcacccaccctcagttgtcacaaccaaaaatgtctccacacatgtcccttaggggacaagatcacccccaattgaaaaccagtgcaggagacaataaagctcttgatgacaggaaatacaactgactcacttagtagcagagtgtgtggcacagagtggatgccccaaatatgtttgaagaatgagtcaattaagcaacatttgctcatgatctcagaggtattccttgaaagaccctattccggtgggtttgtgaaataatcccacagaagggcagttcttgctcccc

SEQ ID NO: 92051 - DNA, 601 bp, Human
cctgttcccttctcttccacccccatcttccatcccacagtgaaaggggtctcgcgtacatatgtgtgcacactgagcctgcaactccatcttcctctaaccgtcccaccctgacactctcgatgttcccactgcccccacacagtaatcctttggccaactcttgggcttagcagtacacgtacctgcagcgtagcccacccttagaacagatgaatgaagagacccgcatgtgtcctggaggcaagctgagagctgtttgggtaaggaattctggtttaggaaatgaaacattgtctasaagggaggtggggtgcaggctccagatggtcccttctcatggccctaggacttttggcagctaaaggagggccctaaaaagtggggaggtcccctcttacccaagactagtgaatactggactgtattgtctctagactggggtttctcaacgttaatactgttagcatttggggctggatcattctttcttgtggggagctgtcagaagcacccaccctcagttgtcacaaccaaaaatgtctccacacatgtcccttaggggacaagatcacccccaattgaaaaccagtgcaggaga

SEQ ID NO: 92052 - DNA, 601 bp, Human
tacaaactttattgagacattattttacataccataaaattcacctattttaatgtaaaattcaacaacttttagtaaatctactgaatggtataatcaccagcataaaccagttttcaaacattcatcaccccaacaagaaccctgggtccatttatagttaatccctgcttccaaccccagccttaggcagccactaatataatttctgtctctccgtatttgcctcttcttgacattgcacacaaatggcatcatagaaaatgggatgttttgtgtccagctacttagcatgtttctytgagattcattcatgttgtagcatgtgtaagtgcttcattcctttttattgctgagtagtaatccattctatggttacaccacattttctttctccattcaccagtcaataaacattgcgtttttctgctcttgaccattatgaaaaatgctgctatgaacatttctgtgcaagtttgtgtgtgtgtatatgtgtgtatttttttaaccatgtggtgaatatatcacttccacaaaaatttttaacattgcaaaagatcagttaaattgcaaatgcaatcttatttttaaaaaaaggtag

SEQ ID NO: 92053 - DNA, 601 bp, Human
tgtgaagaaattaaataaatttgagtacatcaatataacaggatagtatggatctctaaaacaacaatgagggagttctctaagagctccaagaaactggggtggggaagggattatcctaaaaagtgcacaatagtatgtatgacacagctgcagttgtacaaaatagagaaaaaataaacaacatacatttatatctgtttgtatataattggcttagatataattcataaggacactcaataacagaggttacttatctggtaatggtagcggtgctaggaacaacttgccaatgagraacaggtgtaaaaaaggggagtgctctcattttatagacagatagatcaatctgtagcagtaatttggataaataatgataatacttcaataaagtttacatatattatatatgtttagtttatatattatatatttactatgtattatatacaagcatcattgagttcatacatgcaaactttattttacatatttattatataacttattttgtatatatatacaaactttattgagacattattttacataccataaaattcacctattttaatgtaaaattcaacaacttttagta

SEQ ID NO: 92054 - DNA, 601 bp, Human
accccatatggccaatatatacaaaacagatataccaaatagcttataggggtcatacggctttatgttaatattatatttaggttcaaccacatttatttagtttcaatatatttaggatcaatccatttccgtgttttataagagcaaactgttgtgaagaaattaaataaatttgagtacatcaatataacaggatagtatggatctctaaaacaacaatgagggagttctctaagagctccaagaaactggggtggggaagggattatcctaaaaagtgcacaatagtatgtatgayacagctgcagttgtacaaaatagagaaaaaataaacaacatacatttatatctgtttgtatataattggcttagatataattcataaggacactcaataacagaggttacttatctggtaatggtagcggtgctaggaacaacttgccaatgaggaacaggtgtaaaaaaggggagtgctctcattttatagacagatagatcaatctgtagcagtaatttggataaataatgataatacttcaataaagtttacatatattatatatgtttagtttatatattatatatttactatgta

SEQ ID NO: 92055 - DNA, 601 bp, Human
aactgtaggctaatgtcagtgttctgagcacatttaaggtaggctagtctaagcgatgatggttggtaagttaggtgttattaagtgcattttcaacctgtgatattttcaacttatcatgggtttatcaggacatagcctcatggtaaattgaggagcatctgtattactcttggggtacacattggtatcaccccatatggccaatatatacaaaacagatataccaaatagcttataggggtcatacggctttatgttaatattatatttaggttcaaccacatttatttagtttcawtatatttaggatcaatccatttccgtgttttataagagcaaactgttgtgaagaaattaaataaatttgagtacatcaatataacaggatagtatggatctctaaaacaacaatgagggagttctctaagagctccaagaaactggggtggggaagggattatcctaaaaagtgcacaatagtatgtatgacacagctgcagttgtacaaaatagagaaaaaataaacaacatacatttatatctgtttgtatataattggcttagatataattcataaggacactcaataacagaggtt

SEQ ID NO: 92056 - DNA, 601 bp, Human
agaatggaaaaataaaacaatccaagttttcaaacacaggggactagacaaataaatctggtatgtccacacagtggagcatgacacagtcattaaaagtcaagccatgaccctctgtttattaagactgtggggaatctcattctcatatatggacagtcccccactgaacgatggttcgacttgggacttttcaatttcactatggtgtgaaattattctgcttttcactttcagtatggtattccataaattacatgagatattcagtactttattataaagtaagctttgtgttacrtgattttgcccaactgtaggctaatgtcagtgttctgagcacatttaaggtaggctagtctaagcgatgatggttggtaagttaggtgttattaagtgcattttcaacctgtgatattttcaacttatcatgggtttatcaggacatagcctcatggtaaattgaggagcatctgtattactcttggggtacacattggtatcaccccatatggccaatatatacaaaacagatataccaaatagcttataggggtcatacggctttatgttaatattatatttaggttcaaccacattt

SEQ ID NO: 92057 - DNA, 601 bp, Human
ccctctccactctacccaatgcccttccttctcttctgaaacattccaagctcagggccaccttagagccatgacagcagccactacctgtctgtgaacgcttgctctccaaccactcagtggaaaggagtcacttctagcctagcacactgtttcagttctcatggctcgaactgccgccgtcggataattatcttcctgacttatttgtttgtttatcatctggtcccctagtgggcagagctctggctccttgcgtctccatcagtgctgtacccagcacctccgccaccacctggtrgacagtggtgctcaataagtattcgttaaatagatgagcggctgcctttctgggttttattgtcattactccacaggctcctgtgactctctggaaacatcaagcgagagctggagatccagcaccaactgagatggctgcagcttcagcagatccgaattctgaaaccaaggcaggcgtgctagttattaaatcagggcagtgcccaacaggacatcaatcacagctctgagttcatatcgagcttaagacgacagccatctaagcatagattctaccagcaaatacctaaacgtttaa

SEQ ID NO: 92058 - DNA, 601 bp, Human
gcctacagtcccacagcgggagcatctacacactacatccctgtgggacattgtgtggcttcattaagagattgggctggactcccacccaggttccactgcccctggctgtataacctctttgagcctcaatctcctcatctgcaaaatggactcataagatgtcctatagcacagtgttgtggtaggattgcataagatcctatatggaaatcatttggcacagtgcatagggaaaaaaaggagctcttggaaaatagagtggctacactataattacgttaacacagaggaaacaaatgtgcactgtgaatccaactgtagtcacttctgtaaggtggggtgacagacttcacagaagtgagaaataagtctttttactgctgcctctgcttctcagagactatgaaagaggactgaatcattttaagcttctaccagttctttgtgctgctggaagttacacctgaagtcggtggcccattgtttagcagagcacattaattagtctgtgtaaattcaaaagtaggctcaacctgggaaaggaaagaactaaattgctctggaccttagagtgtagtggctgaattcctccgaggag

SEQ ID NO: 92059 - DNA, 601 bp, Human
tgtattttttagtagagatggggtttcgccatgttggccaggctggtctggaactcctgacctcaggtgatccacccgcctcagcctcccaaagtgctgggattacaggtgtgagccacgctgctctgttttttagggcaggggtggggtagtcatttagggaaacactgtccagaaaagcccaccttgttctggttatcgtttatcaattctcagggccgtgactaagacatctctgcactgggggcggagcagtgggttgtattgcctcctcacccaatcctcttagctccagccaacyccactcaacgtgacccatggagccagactgtctgggatcaaatccagcctacaccaatcatttcactctgagatcttagaaaagttacctaacatttctggtcctcagtttccttagctgtaaaatggtataataatactagagcctgcctcatacaattgttttgcatacaaatgtgttagcatgtgtaaaacacttagaaaaaatacctattaggtaagcatcaagtctcagctatcatcaccatggcaattgtcttcatataattatcaccaagaagtacattattatgacgcctac

SEQ ID NO: 92060 - DNA, 601 bp, Human
cccaggagtgtggtaaggaggagtgtgaactatgagactgggcattcccagctctgctactaactagctatgtgacaccagacatcttactcaacctctctgacatgacattgcatttgggaagtgtgatctactgctaacatttgtaagcaaatgagttaatattcatctgtaaatcccttagcatagtatcaggcatggagtgcatgctaaaaataagattcatttctgctctgttacccgaggctgctcagtttgagctgccttgtgcccgtggacacagagacgagtataaattcaraggtcctccctcctttaataacacacctactccacctgcccacctgaagcaggaatttgtctgcagaagttctgcctgccactttgagctatagagaactctgactgccctaggccataggtgtttaactggggcctttgctcagcttacagaggctgtttgttatctgctgcacgctacagagggtcaggagatttggggacacggcatggctcagggaacctggagggcagccgacaacaaatgataaactcacagcaggtggaaggcacacagagtgaccttgctgagtgccgttca

SEQ ID NO: 92061 - DNA, 601 bp, Human
gcaacagagcaaaaccacttgataaatgtttcattgaagagacttcccccagaaaagtttctagctggccagggtttgggaaatggaatttgctgttcagtgcccatggttactaatttaacatgtgtgaaaaaccatgtcatcttttcacctgctgtgctgtctacactgttttcatctagtggatgctaaaaataaacagatcaataaataaaatcatctataagtgcacccataaattccctgacagccacagcgtctgtcttttttagtaagtcctttcatttctcatgcacaagtwgcacaattctttggccatagatttcccaggagtgtggtaaggaggagtgtgaactatgagactgggcattcccagctctgctactaactagctatgtgacaccagacatcttactcaacctctctgacatgacattgcatttgggaagtgtgatctactgctaacatttgtaagcaaatgagttaatattcatctgtaaatcccttagcatagtatcaggcatggagtgcatgctaaaaataagattcatttctgctctgttacccgaggctgctcagtttgagctgccttgtgcccgtg

SEQ ID NO: 92062 - DNA, 601 bp, Human
acttacatggatggtgctttggaccagaagacgattctttatcgttttcctggtactgacagaaactgagtcacatagagaagtgtgaggtttcaatgatgtcaatgttatttgttcttactagtctctgggaagatcccagacattggaggtcaagtggtttctgggactgacggtcagtggaaaatagagaagggagaaatcttcactgaatatcactagacctgtgcagctaatgaatggccacctcttattgataggcctggacctctttgggtggccccagaagaaccaaggtgasgtctctggggcatcagcctcaggaacccacatcaaacacactcaggagccccaaaaggagccatccttctatgctctgcagaaggaccccaactcccctttcttatcagcctggcggacatttcctctctgctttttcagaagagattgctgcttcatatggtgacatctacacattgtctgcaggctgtggcctccttgggaatagaccactccactttctctgctttccctgggaacgagttctttctagcccccttgcccatctgcccctcctccgtgcgggttatcgacctccatt

SEQ ID NO: 92063 - DNA, 601 bp, Human
aactgagctgcttcaggcagaataaggagaaagagcatcatttggtctataaaagagaggcagcagcaccccccaaaatacaacagacacgaagaaaagaagaaaggacaggaaggggaccttgggagcaaacaccaggatcagagtaaggggactgagaaagaacatggctttggaatgagacagaactgggtataaattcacactcaaggacacatcctcagaggccgcatttggcaatttactaaaccagtctcaaatgttgttttcatgagcgaaattaagaaaatatccacctcaytgacttgccatgaggattcagtgaaatcatgtgtacagtcgtacatttggagcgtgtcgaaggagctaatgcccataaaagttcgggaaggaatatgccaatttcttcctctcacctgctctctgctcaaacctgcaaggattctcccttattattgttacggttattattaaagtgcttactgcatggagttttgatatctttaaatgaagagattaagtgtttaaaacagttgggaggcacacagtaggtgctcaataggccttaacatagagtatccatgtcttcaggacagttttt

SEQ ID NO: 92064 - DNA, 601 bp, Human
ggtccaagataaaactgagctgcttcaggcagaataaggagaaagagcatcatttggtctataaaagagaggcagcagcaccccccaaaatacaacagacacgaagaaaagaagaaaggacaggaaggggaccttgggagcaaacaccaggatcagagtaaggggactgagaaagaacatggctttggaatgagacagaactgggtataaattcacactcaaggacacatcctcagaggccgcatttggcaatttactaaaccagtctcaaatgttgttttcatgagcgaaattaagaaartatccacctcattgacttgccatgaggattcagtgaaatcatgtgtacagtcgtacatttggagcgtgtcgaaggagctaatgcccataaaagttcgggaaggaatatgccaatttcttcctctcacctgctctctgctcaaacctgcaaggattctcccttattattgttacggttattattaaagtgcttactgcatggagttttgatatctttaaatgaagagattaagtgtttaaaacagttgggaggcacacagtaggtgctcaataggccttaacatagagtatccatgtcttc

SEQ ID NO: 92065 - DNA, 601 bp, Human
catataaataagacaccctgctgtttctggaagcagtgaagagagaggatcagcagaggactgtctgttctggggcaatttccagttcacatttcctgacacaagaagttcagaagctgaggctgaagttcagaagtgtccctgctccccagtgctaccccaccatgctccaccgccatgagctcagacaccaaccaacacccaggctcccaacatcagcctccctaccacagtacgcctgccctttcatacccacttcctggtctctatattctgttggcctttcccgtggcaagagtgyctctggctctcattaagcagtgactgcttgagccaagaataaagagaaaaagaactccccaaggagagccatctggaattgtgaagttaggtgctgaaagatgaatctcaggctccgactgagaatgtgtccctctgacaacttgctgggccccctccttcctctgcctcttctggcctgacagtgacaaaccctcttcaaagtgcccatatgagggtcacatcccacctctcaatctccccagaggcccttcctttccagctactacccaggaatgctgccttggcctctcattcctgg

SEQ ID NO: 92066 - DNA, 601 bp, Human
ctttctaagagaagacattttgaaggctggagatctaagacaaaaactctgcagaatttttttagaggtctagaatttaaaaattagtaatcaaggccaggtgcggtggctcacgcctgtaatcccagcactttgggaggccgaggtgggtggatcacttgaggtcaggagttcaagaccagcctggccaacatggcgaaaccccatctctgctaaaaatacaaaaattatccgcactcagtgccatgtgcttataatcccagctacttgggaggctgaagcaggagaatcgcttgaaccygggaggcggagattgtggtgagctgatattgcgccactgcactccagcctgggcgacagagcaagactctgtctcaaaaataaataaataaaataaaaaataaaaatgattagtcaaatggggtaacaatgacttgggaatggattccaggttgaatgaccaccagccctgattgttcctgttgctgccctgggaccaggttggctcaggattttttacctaagaataagaacctggatctttctgctggccagtccatgcctcgtccctaggccttctctggattagggcttccctcac

SEQ ID NO: 92067 - DNA, 601 bp, Human
tgccaccaccagcagccctgagggctggcccctggtggcagctcctaaccatcctgccctcccctcttccctggctcatgttgatactcagttcctaactagttcctgtcctcatcactgagacctcacagatctttcccttgtggattccatctcgctctgcactgctcctttagctcgttgttatccctctgtgcccttattaataataaaaataactgccatcaattgagcacttatcctgagccagataccaggctgagcacatgatacctttacagctctgtctttcgtgggttctttttttttttttttttttttttttgagatggaatctcgctctatcgcccaggctggagtgcaatggcgcaatctgggctcactgcaacctccgccacacaagttcaagcaattctgcctcagactcccgagtatctgggatttcaggtgcgtgccaccacacctggtgaatttttgtacttttagtagagatggcatttcaccatgttggccaggctggtctcaaactcccgacctcaggtaattcacctgcctcagcctcccaaagtgctaggattacaggcatcagccaccgtgcccg

SEQ ID NO: 92068 - DNA, 601 bp, Human
tggcctagattgagtcaagtcccttctcagaggcccaactacccatccatgcagtgcagatcatgcctctcttgccttcttatgttctagaaacatctctacaaaaggcaaaacaatatagattttcctgggtccctaagtacaactctgggctgggagacctcaccagctccactcagaacactcactcccagctacaattagtgcaaaatgggaatggaggaactttaaagagaaccagactctgtttttcagctgctgtgcctcggtcacatcttggaatccatccttctcctctccytccctcggcagcaagaatcacaacccctgagagattcagacaagccaagtgggagcagcatccagggagtggtttctcagccctccctcaacatcccagaagagcctggcagcagctgcaaacccctggttgcaggagtggggaagctgtgacagctgtgagccttgaaggtagcagagggcaagtgaccatattactggaagctcatctgctctctgtgagcacatgaaaaagcccaagcagaagcctccgtgggccaaagtgtcttccccaaatgtgcaaatggaactttttccagaa

SEQ ID NO: 92069 - DNA, 601 bp, Human
ccagaagcccaggagaaggtgagacgtcctgggcttagctcaaaggtcctccttccctccttagctgtgtggcctagattgagtcaagtcccttctcagaggcccaactacccatccatgcagtgcagatcatgcctctcttgccttcttatgttctagaaacatctctacaaaaggcaaaacaatatagattttcctgggtccctaagtacaactctgggctgggagacctcaccagctccactcagaacactcactcccagctacaattagtgcaaaatgggaatggaggaactttaargagaaccagactctgtttttcagctgctgtgcctcggtcacatcttggaatccatccttctcctctccttccctcggcagcaagaatcacaacccctgagagattcagacaagccaagtgggagcagcatccagggagtggtttctcagccctccctcaacatcccagaagagcctggcagcagctgcaaacccctggttgcaggagtggggaagctgtgacagctgtgagccttgaaggtagcagagggcaagtgaccatattactggaagctcatctgctctctgtgagcacatgaaa

SEQ ID NO: 92070 - DNA, 601 bp, Human
gaggggcatggctggaagccttggggtagtgtttttttggtttggggattcctttaagaataaactacaggaatctttttcctcccttcagagtccttggtatccccacagtgtcgcagatgatctgcctagtaaggatttgcgagaggaagcatttacagactattattttctcctccccctaggacagacctgcacgttaacagctgctgacgaccgctcctcccaagccacaggctgcaatgcggctgctacacactgcagggctatgccccagtctttacagggaggggattaaaaytggttcccttcttcacactttctgtctctgtttctcagcctctgaggaatggtatttgttgaccttggagggcaaggctaaagagtctcccactgcgagaaaataggaagtcaggccctctctcgggaggccacctgctcctgctacctaatcattcccaggtgactagggatgacacataggttctgcaaggtgagtgtcctggcacggcctgggagtgaagacagggctcacgatggcagctgtacaatgtcaagcccacatctctgaacacgccgggattgggaaggcctgggaagc

SEQ ID NO: 92071 - DNA, 601 bp, Human
aaagccctaagaagtgcattaagaattttagacacattatgtaatttaatccccaacattctaaggagaggatattattattgctattatacagataaggaaattgaggcccaaagaagttgagtgttttgtgaaatgtcccaaagcttatcagtggtagaactgggatttgcacccaggctctttgatgcccatgctatgcctgcactgtattgccttcattcttcgaggctatttgccctctgtggacagaaacaatctgtagatacacaagactatgaatacagagacccaaaagttraagaaacaggaactgcatttgtgatccctcaatgctaaggatgggaccattgtgaggtctgggtgaatgtcttcacggggagccatatctctggcatcggtcagcccacatctcaggacattgcaggctctacactggcctcagaagcctgctcactgcacccaatgaagccactccagactccagagaagggctccagagatctgtgcgtgcctccatgaggctacttgactctttttatgttaaccatgttcaaaaatttgtccaatattggtttacaaagagaagctgttgactgct

SEQ ID NO: 92072 - DNA, 601 bp, Human
tgctgctttccaacaacacaggaagagttgcaatggagagttataaggccctcaaagtctaaaatatttacctttagagaaaaagtttggtgactcctattctagatagtcattgcaagcttggcagatcatatgtcatgtatctaagcacattcagtaatatcaacatcaatgacaatgataatgatagaaacaaatgccaactactttttattgagtctttactcaataaaaagccctaagaagtgcattaagaattttagacacattatgtaatttaatccccaacattctaaggagrggatattattattgctattatacagataaggaaattgaggcccaaagaagttgagtgttttgtgaaatgtcccaaagcttatcagtggtagaactgggatttgcacccaggctctttgatgcccatgctatgcctgcactgtattgccttcattcttcgaggctatttgccctctgtggacagaaacaatctgtagatacacaagactatgaatacagagacccaaaagttgaagaaacaggaactgcatttgtgatccctcaatgctaaggatgggaccattgtgaggtctgggtgaat

SEQ ID NO: 92073 - DNA, 601 bp, Human
ctttcaaagtgggctttccagctcttgagtcaaacctgaagttcttacctaattggccaaacgtagggtatggcaactagggttgggagctgccagtggccctgtccccagggactgatgcaattagaacagaggtgacaggaggagaataatgaggaggaaaatagggccggtgactctctggcccctctccgtggggtccacatttaacatcttcatgtctgggaaacctcaaaatgggtcaccagtcagtggcatgggaaagaaccgatttatcatagttaccaactatcagtgtagagacatgcatcttgccaagaggtctctgaagctggggaggctcctggctcaggcgtttgtatagtatctttagtacaaaaaggagagctagaatttgcccttcttctctccctctctttcttccaaagtttggggacatttccctttcttatcttcccctctacgtgcatcagctgtcatgtccactctgccttggggagagggttcagtaaggctgtttatttggatggaaggaaaataggctagatggcaagaacacaacttctcgacagctcccaactcttcctgggtcattcagcat

SEQ ID NO: 92074 - DNA, 601 bp, Human
cttgcttttagattgtgaaggtatctacatttgcagaggagagtgagcactttgacctctggaagacacctgtgttctcccaataggggtttggaggaagcaatagggtgggaagagtggggcggcagctacgggaatggcagttagtggacagaaatctcagatacactcagggccaggcagagtccttcaaagtcctagtgcaggatggaaaggagcatctgggggccaccagaatgccaccattcagcctctgtcagggtgaaaactcaagtgtgagaaagaggtgcaaaccaggccrcttcctgtagggcccaggaagatgaatatacccaggtagagtgtaagttgtgcatgtggatttcccagcaccagaaggggactacaaggccaaagatgaagcctttgagcacatctgaaggaccttggttagggcactgccatgggcccagcaatgctggccagatggaaaatggtctgtgaagaggagaggccctttctgcatgaggagcagcttatgcaggtgggcgccccgatttctccagcctctccaccctccctatgaggccagaaggcaaatggggcccaacattgagttgtt

SEQ ID NO: 92075 - DNA, 601 bp, Human
ttgaaatatggctactgcaaccaaggaactagtgcgactgaatttttaaaccttattgaactttaattaatgtaaatctaaatttaagtggccataggtggacactgtactgtacagttctagaattagcctgaagaaaatcggtcccctttttgtttcaaccatctctgccacctgatgaattgtaaccttggaccttcttactcatcatcaaaaagtctctagcaggaaggtttccaggaggggtgtaagatactagcctcactttgcaagtgagaaacttaaggcacaaagggagaamgctatttgcaacatcagagaagggtggccctagaatcttggagttgtaagccacaggctgtggggcttccagactccttctggacctattccagaccctgtccattttggaatgaggaagaatagtataggatacttatcatagtatcctcaacttgttttccctacaaaccggggacaaaggcctgaatctggctgctaaggagatcatgtataagaatgaatgtgttcatctaatttctcatcctgagaggaaagtgtttagagggggtagtataatttctggctccagggaaaaccc

SEQ ID NO: 92076 - DNA, 601 bp, Human
gtggtgaaaagtagggcatgccctttgggccccaggggaacaaaaggacaaagtgagggctatcccgaatattgagaaagagtgttgcctagattagaagctaccatggttcacaattctcacaaaatagtaatagtaataacttcaatagcagctaccattggctgatcactgaactacttgcaaaacttgtctaagcattatacatatagtcatttaatactcatagcaacaaccccgtgaagcagttattaatagtcgtgttttctaggagagaaaattaagatttaataacttgctycaatttgcaactaagatgtgacaaatccaagatatgaacccaaatctgtcttatgctaaagacaaagttctccaggaaaggaatccatttcattgtgaatccaggtttagaaggcttagaacatcccacagatgctttcatttcctttagggccatctttatagaaacctgactcataagcagagctccagagagtcctccattccattgcctggtactaactcatttctttgcccctcaaaaccacgacaccctattgaatgtcccacttcaagaggatgcttagcagtttttggtgag

SEQ ID NO: 92077 - DNA, 601 bp, Human
ggaaatcaggaagtaggatctgaaaccagacatgtgactgtaaaaagtgagcttctaaaaggaacattgggagtgcttgttccaagattccctggccctgccccctaggattctgattggctaggtgagcttgctcatttgcatctcccactagctcccagggctgatgctggcagtccacgctcagtggccctgggacactcctaaccactccaccacaccgcttagcactgggtaacttatggccatagcagtgcacagtggagagagcctctgaccttgaagcatgggtctggggtamccccagaacccattccatcccaaatcaagcccggatttgttattctaacaccttgcctgatcatatcagtcacttttagcattcactcttttctctagaaagcccagtgagccgtaaccacacccagggcccttatttatgaagttgtggaccaaggagccctggtgtacagcaaggcctctgcctgctttactgcttctctgatttcctctgaaaagcaccattaagtaggagcacatcccttttactatctccggtgggctctgcctacctcactcctcagaaggaggaaggctgcat

SEQ ID NO: 92078 - DNA, 601 bp, Human
acaaataactctgccatagcccttactatatgctctgattgttttaaatattgtaattcactcaattttcccaccccaattttgaaataaagaaattgaggcacaaaatgatgagattgctcagccaaagtcccagaggtccagaatggccatatgggaaatcaggaagtaggatctgaaaccagacatgtgactgtaaaaagtgagcttctaaaaggaacattgggagtgcttgttccaagattccctggccctgccccctaggattctgattggctaggtgagcttgctcatttgcatytcccactagctcccagggctgatgctggcagtccacgctcagtggccctgggacactcctaaccactccaccacaccgcttagcactgggtaacttatggccatagcagtgcacagtggagagagcctctgaccttgaagcatgggtctggggtacccccagaacccattccatcccaaatcaagcccggatttgttattctaacaccttgcctgatcatatcagtcacttttagcattcactcttttctctagaaagcccagtgagccgtaaccacacccagggcccttatttatgaag

SEQ ID NO: 92079 - DNA, 601 bp, Human
tgtccacttgctatatgaagatggctgccccagactgcacagttctaaaagattcttgtaagaatctggagttataatttgctcacaaaatagggtttctcagcacctctgggactggttttgcaggagggggtcttatagcccacctatctctgttgcagaaaattgaaccatggaatcctggaggctcctaagggtgcatcgagggcatagggtatcaaaggagagactgtgggcaatgggggatccatcccctcacccctgctttgaccacggtagttccactgcccttaagtaagaytggtttggtatcgcagagtgaatcctgagacagtaaaatgtgcattagtggaaaagctggtaaaatccaaacaaagtctgtagtttagttaataatttgtgtcactgttaatttcttattttttgccaaggtaccctggttccatacgatgccaacaggaggaaaaactgagtgaaggatatatgggaattctctacactatttttgcaacttttctgtacatctaaaattactctcaaataaaattttattataaaaatttgggaaaaccacttcctcgggaatggaatacaacgctcc

SEQ ID NO: 92080 - DNA, 601 bp, Human
acaacttaataggtcttagcatttaagttgtttttcaaaattcacctgagatgtgcatatcacgacacccagtcctacagcagatgctcaggtaactaaagctctgagccccacttggaagtctctccagtctgtggccacgtctcctgattagcacaaagcaccctctcccaaagctgaagaagagaacaaacgcatggtttagggctgggaatttaagaagatcccataccttcctctagactcctaaactccagcagagaacagtaactccagccctgtccacttgctatatgaagayggctgccccagactgcacagttctaaaagattcttgtaagaatctggagttataatttgctcacaaaatagggtttctcagcacctctgggactggttttgcaggagggggtcttatagcccacctatctctgttgcagaaaattgaaccatggaatcctggaggctcctaagggtgcatcgagggcatagggtatcaaaggagagactgtgggcaatgggggatccatcccctcacccctgctttgaccacggtagttccactgcccttaagtaagactggtttggtatcgcagagtga

SEQ ID NO: 92081 - DNA, 601 bp, Human
agcaaatgtgcaaatgtgtttggaaactaagcatctaatttaacctcatgagagggaagtgttaactagagttgaggttaagaacactgatctaaagacaatgtcatcaaagaaaccgagtgactgaactgggactcagttctttcagtcccagtccaggaaaaaaagcagtaaagccatggatgtatctaaaaaggaaacttgagtacatcccacaaactctcaacctagtttccatgcagtggcagacaataatgctattggtgtggccagtacttgtgaaaagatgaaaagcctcacacagtgtagaagaaagatgagaaatgtccactttacaaatgagaaactcaggtcctgggcaagaaagggatctgttccatgtcaggagtcatggcagagagactgaatctaggcttcttggcttctactcctgcattctagttcccacatttgtcactggctgccaagagcccaaaaacaaaaatgggagggcacttcccaggactaatatcctcaggccactgcagggagaattcacaaaataacttcatcacttcattgttagagcccggttctttgcacctcaacctcctggtcatca

SEQ ID NO: 92082 - DNA, 601 bp, Human
gaccagccagtctccagttcgtagtcctgagcccatggattctaatggcttctcttccatactctatggctaccactgtggcacaggatctcactgcctctttcctgggccagtgcaatggcctgcctttatggtcttagtttccagcaatctatcccacatgccactgccttatgaattgtccttacacatgacctgattcacacctcaacagatgacaaatcctctgtgactgtccattgactacctaagccaaaatagttggcctttcaaaagctgccatggtggtctttcctttacyaacatttctttccatgcatcttccatagatccttagtttcggccagttgaatcacacaccgttctagatcattcttctggtttccttacctccaagcttcctccatgactttgctcatgctaacctctctgatggagatatcttcctaaaatttaatccagactgccaaccaacccctcaagacccatgccattcctctacttagataagctttagacattcttaactgccttttatacaatttgcctccctttggcttatgatagagcaacacatttttatctgttcttatattcccta

SEQ ID NO: 92083 - DNA, 601 bp, Human
caatcaaatctcttttctttataaattacatagccacaagtgttttttatagcacctcaaaatggatgaagacacatcctgaccctccatttcactgtttttttgtgttttttttttgttttgtatttgtttgtttgttttcatagttgccccttacaaactgcaagtggctttgagcctgtgggaccagccagtctccagttcgtagtcctgagcccatggattctaatggcttctcttccatactctatggctaccactgtggcacaggatctcactgcctctttcctgggccagtgcratggcctgcctttatggtcttagtttccagcaatctatcccacatgccactgccttatgaattgtccttacacatgacctgattcacacctcaacagatgacaaatcctctgtgactgtccattgactacctaagccaaaatagttggcctttcaaaagctgccatggtggtctttcctttaccaacatttctttccatgcatcttccatagatccttagtttcggccagttgaatcacacaccgttctagatcattcttctggtttccttacctccaagcttcctccatgactttgctc

SEQ ID NO: 92084 - DNA, 601 bp, Human
gttcccatgagatctagtcattaaagagtctggcaccactccttcctctctctcttgctccctccctcaccatgtgacactcctgctcctcctttgccatgattggaagcttcctgaggtccttaccagaagcagatgctggcaccatgcttcttgcacagtcttcagagatatgagccaatcaaatctcttttctttataaattacatagccacaagtgttttttatagcacctcaaaatggatgaagacacatcctgaccctccatttcactgtttttttgtgttttttttttgttttktatttgtttgtttgttttcatagttgccccttacaaactgcaagtggctttgagcctgtgggaccagccagtctccagttcgtagtcctgagcccatggattctaatggcttctcttccatactctatggctaccactgtggcacaggatctcactgcctctttcctgggccagtgcaatggcctgcctttatggtcttagtttccagcaatctatcccacatgccactgccttatgaattgtccttacacatgacctgattcacacctcaacagatgacaaatcctctgtgactgtcca

SEQ ID NO: 92085 - DNA, 601 bp, Human
ttctccagtcctctgcactgataagcagatgtcagatgtcagggccattggcagggaatcagatccagctggctttcccttggtgataccagtgcatctttcaaatacgcatactcagagtccccacatactgaccactggtgcccagtgagtgggaaccaatgaggattcatgtaagaagatttaggcaagtggggacattactcttttcccattacaaacatctaatatagtattatgtattttttaattaagtaacttttattaagcatttttaatgtagaaatcactgtgctaaacrtgggtgagctcctttgccttcaagggaacttatgctttattgaggtatggaacaaacatgtacccaagtgtctcaggatgtgaaaaaataaatacaaagatcaggaagttggggattgacccactgggtaaggaaatgaccaactacaagaacaaaccgggctgcaaatcaaagttccaagctggctgaagaggctggaaagcatgactcaatggaggaaggcaaccaagattgtcgtgatgattggcagagttggagagctggagtacagaccaccacctaccagtcaactttggaaca

SEQ ID NO: 92086 - DNA, 601 bp, Human
aagcaactttcacattatgatccagcttcccacatggactagctcactgagaacaaatgctttgatgctatggcctttgaataatgtgattctctgtgtgcaataataaatttccttttggtgctaactccattcttatgggtattttaattattgtgagaccttctccagtcctctgcactgataagcagatgtcagatgtcagggccattggcagggaatcagatccagctggctttcccttggtgataccagtgcatctttcaaatacgcatactcagagtccccacatactgaccaytggtgcccagtgagtgggaaccaatgaggattcatgtaagaagatttaggcaagtggggacattactcttttcccattacaaacatctaatatagtattatgtattttttaattaagtaacttttattaagcatttttaatgtagaaatcactgtgctaaacgtgggtgagctcctttgccttcaagggaacttatgctttattgaggtatggaacaaacatgtacccaagtgtctcaggatgtgaaaaaataaatacaaagatcaggaagttggggattgacccactgggtaaggaaat

SEQ ID NO: 92087 - DNA, 601 bp, Human
aacatccttgccctgatttcttcctctttaagcaactttcacattatgatccagcttcccacatggactagctcactgagaacaaatgctttgatgctatggcctttgaataatgtgattctctgtgtgcaataataaatttccttttggtgctaactccattcttatgggtattttaattattgtgagaccttctccagtcctctgcactgataagcagatgtcagatgtcagggccattggcagggaatcagatccagctggctttcccttggtgataccagtgcatctttcaaatacrcatactcagagtccccacatactgaccactggtgcccagtgagtgggaaccaatgaggattcatgtaagaagatttaggcaagtggggacattactcttttcccattacaaacatctaatatagtattatgtattttttaattaagtaacttttattaagcatttttaatgtagaaatcactgtgctaaacgtgggtgagctcctttgccttcaagggaacttatgctttattgaggtatggaacaaacatgtacccaagtgtctcaggatgtgaaaaaataaatacaaagatcaggaag

SEQ ID NO: 92088 - DNA, 601 bp, Human
cattggagagccgaaaatctctaaattaaatcatctttgcttgctgcgttgactaggcttgggtcatcctgttttcctcctttgccttgaatggccttgccacaaagccttattagaaaaatagatcatggaactcaattattacaagctcacacttctacttaacctcatggagactgtgctgtattggtgtgctctttaaacattctattcacaagtaaactctcatcccttgaaaaacctaacttaaccagaacaccaaacccaattccacccctcatttattgtacagtctggggawtgatcactaatctctctgagctttaatttacttgtctgtaaatagggagaatcatgccagcccattgacctcatagcactttgatggtggttagagaggagcactgaattcacaggaagggagaagaatgtccttgtcttcactctaccactaactaggtgtgtgatcttgagggacatctgctctctctctctctctctggctggcattcaatgtattcacctgtcaaataagtgggtttgaaagatgacctccaacttcatttctagtcaggatttcacaagattgccagtgtagatg

SEQ ID NO: 92089 - DNA, 601 bp, Human
ggcatctgtataatgtggttctaaggattttctagaaacccaatggggatggagaacccactatcttgtaggacggtctgttccattttcacacaataagggtaacttcctgcagcactgtgcttcaccaccctcaggtgtcaactatctctagcgttttccaatcttgccacccctgtgggtgaggaacacattgcagagcccactcattgcaccaaaataatggaggacaacccttgcatacatctctgtactgaaacctggctttgtgatctctgattgttccaaattagggtccttragcatcatcccagatcagtcattcgctgagaagaacacctgtctcctggtttatgtcatttaatgaacatttatgaaatgtctaccatatatcatgtatagtcctaggtacaagggttatataatcagtgaaataaggcatgaatactgcccttaaagaacttctaagctactgtgaatgattatgtgtcaatcaaagttcttgagaatacattttcacaataaacattaaaacaattacttcttgcaacacatttcaaggcaataggacaatactcctcaactctgagcaccacctccc

SEQ ID NO: 92090 - DNA, 601 bp, Human
acccagtaggccagggcaagaaatttatattttggtgaaatgaagatttactcacacaaggctccaaaaacacaggagggatgaggaagttcgaggagccctgggggaagagctccaagcctgaaggtgtgtgcgtggattcaggttttggactgaccaggcatggacccgggcagctcctgccaacgtgcaaagaaaaagtggcactgaggtgctataaggaaagacatagcaggctggtgataaagagacaggttcagaaatggctcccctttgggaagctcccaagagagttttcacrgatgctaacggttgctgaggtgctagcactcagagaagcaggaggaggccatggtgagttttatttaaaacatgccgtgtttcagtctccagtgaactctccaggggaggcttacagattaagcaatcaaagagagaagaagtggaggctgcaaatgtaaatttcaaacagattctgtgtaaaagtaaaaaggggttataaccatgtgagtgcatgaggtttgcaaagcagatgtctaaaatagcagcacccaaacttaaaatgagaggaaggagagaaaccaatggagcagggaaagaa

SEQ ID NO: 92091 - DNA, 601 bp, Human
aatccctgaattcaccactgcttttagggctacccagattccctctcctttccttcctgatttagaaaggttaactcactgaatgtcaccaccatggagcctcagccctcctcctccttgctgtccatggagttaacatttgtgttccccctcaccactcaggaaaaaagctcctaagcaaggcctttcccttgaaagggctcctgagaagtgagaggaggggggtgcatgaggagggactcacagtaacttagcaatggcatttctcaagtgcttccaagtcaagggctgtgtgcaagaracaagagacacagtctctgctctcaattgagtcagaggcagagaagcagcactggaatgacctggaggagaggcagattcatgaagtaacatgtccctgtgcacaaactcatagggtgaggctgaaaagaccatccagtgaagacaatgaaatggggattgctgagtgctgatggcagggagggacgaacagaaagaaagaagacggagatgaaagaaaggacagatgggcagttgggaagagaaggtgtgatggactgaactgtgtgccccccaacacatgctcattatggggaagtcc

SEQ ID NO: 92092 - DNA, 601 bp, Human
aagtgcctctccaaagcctgcaagctgtctgtctgtgtgtggactgccctgcccagccccctggccccagaaatcaaatccagactcactgtggaagctgccgttgctgctagcctctgccgctgccacaccacactgaacgggcccttctggcatggcccttcctgacagtgaatgaggggagagagtgggaagggggagagagaagaaaagggatgaagggagaggaaggaagcatggaaggatgaaaggaggagcatgaggaaagcagggggatctttaactgaatggcgtgtctctyctgggcagggcctcaaacatttgtcctgcatcattagggaggacagcggaagaccgcagcaacccaccttcaaggcccttactctggagtccgcccagaaacacaaggcactcggggctccaccagcacatcatgacaccactcccagcacatgacacccagctgtcttcctctgtgggacatgaagacgcaatgggcttccctccacgagcttggttctactcccagcaggagcctcccagccaacctactgcttggagaggaagtgggttctatctagaattttcagccccttaggtc

SEQ ID NO: 92093 - DNA, 601 bp, Human
cacctaattttagcagattatggcccgccaccccccaccatgctgtctccccatgagacatcccaagcacatcaatggctttggcaggaaacttccatggaagttaaatgatgctccacggtgggaggcaaggaaaaagaggttggaagcaggccccagcccatggaagtgcctctccaaagcctgcaagctgtctgtctgtgtgtggactgccctgcccagccccctggccccagaaatcaaatccagactcactgtggaagctgccgttgctgctagcctctgccgctgccacaccacrctgaacgggcccttctggcatggcccttcctgacagtgaatgaggggagagagtgggaagggggagagagaagaaaagggatgaagggagaggaaggaagcatggaaggatgaaaggaggagcatgaggaaagcagggggatctttaactgaatggcgtgtctctcctgggcagggcctcaaacatttgtcctgcatcattagggaggacagcggaagaccgcagcaacccaccttcaaggcccttactctggagtccgcccagaaacacaaggcactcggggctccaccagcacatcat

SEQ ID NO: 92094 - DNA, 601 bp, Human
gcagggcggcccatatgtaaccagaaaaagaatgactatccttgtcagtttgaaatataaccagacacttctcatctttaccctgattcccagctgggactccacagagcacacatatgcagaagagagaagccaactgtgttgagatgcgttaatattttagaagaaaagctaatttgcttgcttatttgtttctaccagagggagaactcagataagtgaaagtggagtatcctatggaggaagatgaatgatgctttcctcctcagccctcaagtatcaaaatgacgggggaaactagacaagggtccctaaaagcagtaaagaaccaaaacttgatgaggtaaccctacccaatagttagaagaccacagcgagggacatcccagtgcttggagtatatttctgtgatggtaacaatgtaatgaaaaagaaaatccttgccaaatgacaagagtatggcttctctctacccctatgacacatgttgtgaaactaagaaacattgtcttgacatgcatagagaccctgggataaatatgctctaaaactccaaggaaagtatagcatcacaggtagaaaatcttctactttatcacaa

SEQ ID NO: 92095 - DNA, 601 bp, Human
tgttttaaggcatgtaaattgataggttagggtggcacattttggacaatgtgatagaaatcctataaatgtgatttatataaaacactcagaaaagctgaaggggaattttcattcagaaatatctaaatcagcagattcaatgaagtaagatgggaacctacaccagcccagagagcactcataaagatgacatcagaaaatatctatgttcctccatagacagattggaaaaaagaagccagtcatggactttgcttcctgtgtctttctcttggagcttttctctgcataatgtccmgtcccactcttgtagaaatggcactgataatttctcacctcatcagctaggctcctgatggcaaggcctccctgacgaggacaagccttcactactgaacatctaggtcccagataatgtgttcaactgtggcagcatttgtcatcataattttcaaaatacattagccttgattgtttggaaatctatttcccgttaacatctctttctctaagatcatggtcttgggcagacaaagagagaggcagagaatgatgatgaaattatggaaagaagtcagagtagagatgagaaggaaga

SEQ ID NO: 92096 - DNA, 601 bp, Human
aggaccacagacatgaaacagttgataaagtcctttatcttcatttaaaagtggggattcaacttggaaaaaataacagcgttaaattctcaaggaagtctgaggttgggtggtaacagcagtcaaagcactctgggaactgcaaggtgattcatcaaaaaaagaagtaccaccactctttttaagcaccataggtttctagttgggcctttccctgggaaatgccaggaaaggggcatctattaacccagccacacagccctggcaaggcctagaggcatctttagcatcctggaatggrgacaggcagagggaaggtctggcaccaagataaaccaggaaccttagtgaaaagagcactggattcagactcaggtcatctgggttcttgtcccagttctactagtgtgccatcctgtggtcttggcagcccatgttttcttttggtctcaatgttcatacttggaataatgacatagttggaccagagttttgctaagattcctctctgctcaaaaattgcatgagcataattttctcatctgaatcaggacatcaagaacactgaacgaaagctcaactcaaggcccttcctaacacc

SEQ ID NO: 92097 - DNA, 601 bp, Human
gctcagagactgcatattctgtgtgtgaagcttctttttacttttttccacaaaaggcaaacttagctaggaatgggctcactgagtcatcctttaagcgacattaataatatctcttattgattgaatatcccaccagctttaagatgatggcattggatccttgaatcagggattctaggctgggtgctgtggctcacgcctgtaatcccagcacttcaggaggccaaggcaggtgaatcacctgaggtctggagttcaagaccagcctggccaacacagtgaaactctgtctctactaaaaaaaaaaaaaaaaaaaaaatacaaaaattagccaggtgtggtggcacgcacctgtagtcccagctacttgggaggctgacacacatagacattttcaatccagtccctcatcttatttaaatcctggacccagagcacgcttcttgcaaatatttataagcgaacaatactactaacaccataacaactctaattgcaactgttacttactaacatatcttggggcttaccaagtgccagcccagtcattgggatgaataagagttgtaatggtgtcagtagtgttgtataaatatct

SEQ ID NO: 92098 - DNA, 601 bp, Human
cacgcaaatcatgaggtcaagacatagagatcatcccggccaatatggtgaaaccctgtctctactaaaaatacaaaaattagctgggcgtggtggcgcacacctgtagtcccaactactcaggaggctgaggcaggagaattgcttgaacctgagaggcagaggttgcagtgagccaagatcgcaccactgcactccagcctggtgacagggtgagattctgtctcaaagaaaaaaaaaaaaaagaaagaaaggaaagaaaaaaatatatacatgtatatatattacagagtttgactcyattcatcgacagttctatagttttccttctttttatcctggtgtatatagactttgagtcacctggtagaactctgtgttctccccagtttgtgtgggtgcatgccttagggatatattagtttggatatccttttgatttctgatctacaatacatgagtgtgcactcacagatacatgtccatctgtggcctcgccccagttatggaaaccccacagatgaaagctttatacaagaggttatgacttttctacagtgacatcagacttctgacttattaagtcagaattgcttgcctt

SEQ ID NO: 92099 - DNA, 601 bp, Human
catgttctcaggacctcatgagggctgtgtctggccatggccatggtcactcatatttggctcagaataaatctcttaaaatattttacaggccaggtgcagtggctcacgcctgtaatcccagcactttgggaggccgaggcacgcaaatcatgaggtcaagacatagagatcatcccggccaatatggtgaaaccctgtctctactaaaaatacaaaaattagctgggcgtggtggcgcacacctgtagtcccaactactcaggaggctgaggcaggagaattgcttgaacctgagagrcagaggttgcagtgagccaagatcgcaccactgcactccagcctggtgacagggtgagattctgtctcaaagaaaaaaaaaaaaaagaaagaaaggaaagaaaaaaatatatacatgtatatatattacagagtttgactccattcatcgacagttctatagttttccttctttttatcctggtgtatatagactttgagtcacctggtagaactctgtgttctccccagtttgtgtgggtgcatgccttagggatatattagtttggatatccttttgatttctgatctacaatacatg

SEQ ID NO: 92100 - DNA, 601 bp, Human
atcttgcccaaattcctatctaaggggtctggggagtatgccctagaaaccacaaattctcatcacatgggttttatttaaccttgtatatcatgacttattttccaatctgactttggcataacaaggaaaaaaatcaaaatgttttaccccaaaatatatttccttgccataccttgaaattgccctgcaaagtctctcgtgggaaaaatccacattatatggagaatctccttccccctttgttttccttcctctctttccagatctgggagataatcagctaagagccaggcacccytttaggtctgataagaaacattttacaacctgctcgctctctgaagtctgctttctgagagattcctctgcacaatacaacttggtctccacaatcctttatcttttttttttcattttattttattttatttatttatttatttatttttattatactttaagttttagggtacatgtgcacaatcctttatcttaacctgaacattccttcccattgatccagatcttcagataaattcaaccaattgtcaaccagaaaatgtttaaatatacctatagcctggaacccaccctcacc

SEQ ID NO: 92101 - DNA, 601 bp, Human
tatcttgcccaaattcctatctaaggggtctggggagtatgccctagaaaccacaaattctcatcacatgggttttatttaaccttgtatatcatgacttattttccaatctgactttggcataacaaggaaaaaaatcaaaatgttttaccccaaaatatatttccttgccataccttgaaattgccctgcaaagtctctcgtgggaaaaatccacattatatggagaatctccttccccctttgttttccttcctctctttccagatctgggagataatcagctaagagccaggcaccsttttaggtctgataagaaacattttacaacctgctcgctctctgaagtctgctttctgagagattcctctgcacaatacaacttggtctccacaatcctttatcttttttttttcattttattttattttatttatttatttatttatttttattatactttaagttttagggtacatgtgcacaatcctttatcttaacctgaacattccttcccattgatccagatcttcagataaattcaaccaattgtcaaccagaaaatgtttaaatatacctatagcctggaacccaccctcac

SEQ ID NO: 92102 - DNA, 601 bp, Human
ttggttctgaggatgaagctcggaattttttatcttgcccaaattcctatctaaggggtctggggagtatgccctagaaaccacaaattctcatcacatgggttttatttaaccttgtatatcatgacttattttccaatctgactttggcataacaaggaaaaaaatcaaaatgttttaccccaaaatatatttccttgccataccttgaaattgccctgcaaagtctctcgtgggaaaaatccacattatatggagaatctccttccccctttgttttccttcctctctttccagatcygggagataatcagctaagagccaggcacccttttaggtctgataagaaacattttacaacctgctcgctctctgaagtctgctttctgagagattcctctgcacaatacaacttggtctccacaatcctttatcttttttttttcattttattttattttatttatttatttatttatttttattatactttaagttttagggtacatgtgcacaatcctttatcttaacctgaacattccttcccattgatccagatcttcagataaattcaaccaattgtcaaccagaaaatgtttaa

SEQ ID NO: 92103 - DNA, 601 bp, Human
aatgaagtttacattttggttctgaggatgaagctcggaattttttatcttgcccaaattcctatctaaggggtctggggagtatgccctagaaaccacaaattctcatcacatgggttttatttaaccttgtatatcatgacttattttccaatctgactttggcataacaaggaaaaaaatcaaaatgttttaccccaaaatatatttccttgccataccttgaaattgccctgcaaagtctctcgtgggaaaaatccacattatatggagaatctccttccccctttgttttccttcstctctttccagatctgggagataatcagctaagagccaggcacccttttaggtctgataagaaacattttacaacctgctcgctctctgaagtctgctttctgagagattcctctgcacaatacaacttggtctccacaatcctttatcttttttttttcattttattttattttatttatttatttatttatttttattatactttaagttttagggtacatgtgcacaatcctttatcttaacctgaacattccttcccattgatccagatcttcagataaattcaaccaattgtcaa

SEQ ID NO: 92104 - DNA, 601 bp, Human
aaccttggccagaaaagcaatgacttgtccaagtcactaagaatagtaaatgaaacagaactgaagtcccacagtgtctggttattgtttttaatgtaaatgtactactgtactatagcatacatacacaaaggcaaacaaatcagaaatatacagattgagtctctgaatgaagtttacattttggttctgaggatgaagctcggaattttttatcttgcccaaattcctatctaaggggtctggggagtatgccctagaaaccacaaattctcatcacatgggttttatttaaccttgyatatcatgacttattttccaatctgactttggcataacaaggaaaaaaatcaaaatgttttaccccaaaatatatttccttgccataccttgaaattgccctgcaaagtctctcgtgggaaaaatccacattatatggagaatctccttccccctttgttttccttcctctctttccagatctgggagataatcagctaagagccaggcacccttttaggtctgataagaaacattttacaacctgctcgctctctgaagtctgctttctgagagattcctctgcacaatacaacttggt

SEQ ID NO: 92105 - DNA, 601 bp, Human
tgtattccctaatctgcatgggctgagtcatgaagtacatgagaaagcaactcatctactttggaggagacaactctgaagagtggtaaaaccttggcaacatatgttaatgataaatggtctatcaggagattgtcataaagggtgtcatttatggtaagtgccatttttttatttattaaaatttaatctttcttgattccatgtctattcacatagaaaagtggttatgtgcattaagaaaacatgaaaaactaaatctatgccttcgtcattccctgggaagtctggtttcccacaygccccagtggccttggcctgttccaccttgcttggctgtctgaggacggcatcagctatggctagcagtcaccttgaacatgatcccactagcagtcccagcagccaccataacagtctttaaaatcatcggcactcttggtccagagggtttgggaattcacttgcatggctgcacataatgggttagctacatgtaatatacatacacacatccatacactgtggggaggtggtttagatggacatgtgtgtgtgacaatgcatgtgcatcgtgtgtacagtcatagatacagacctg

SEQ ID NO: 92106 - DNA, 601 bp, Human
aattgtcttgctcatttccattgagtgactgcaacttttcttcagttagagggaacccaccgctttgggttaaatagaaactcagctaagttctacaaggttctcaggcttccgcatctaattacagaaggagccagctggtggattccaaaaatcacagagaagcctgcttctcactgagaggttcaaaacatctatactcacacaactccgatgaggcatacaggacacgaagtaacccatattccagataaagaaaccgagacccagcaaagatgagcaagcgtggattcacagggcrtaatatttctggaaccaatggagggattcaagcttcctctgtattccctaatctgcatgggctgagtcatgaagtacatgagaaagcaactcatctactttggaggagacaactctgaagagtggtaaaaccttggcaacatatgttaatgataaatggtctatcaggagattgtcataaagggtgtcatttatggtaagtgccatttttttatttattaaaatttaatctttcttgattccatgtctattcacatagaaaagtggttatgtgcattaagaaaacatgaaaaactaaatc

SEQ ID NO: 92107 - DNA, 601 bp, Human
cattcttataggagcataaacatttcaagaccacaggtacagagactgagcatttaatggtgcaaagttcagagtcctgctcctcttgtctttccccaaggctgtatcgtacccctcctcaagccatcagctctatatactgggagaatgggacaggaggggagcaagagcagcagttccacctccagccctgggatgcctagctgaaacccccaaaccccatctttttcattcaagtccttagggctcacactttgccccactcctcagggccagaaataagtggtgcagaaggtgttcsaagtctagtggctacaaattctcaggctccaggttctacttggggcagaatgccccgcatggcagtgttccactctggggaatctcctacctcccaactcacccaaccacagctgtccctcctcttctaagccagcctttcctgaaaagagaattgtcttgctcatttccattgagtgactgcaacttttcttcagttagagggaacccaccgctttgggttaaatagaaactcagctaagttctacaaggttctcaggcttccgcatctaattacagaaggagccagctggtggattcc

SEQ ID NO: 92108 - DNA, 601 bp, Human
aagtgcactttttatatatacctcatgttatccatacacaccctgaagagcaacagccactgtcccatgggatgaggtctagaatttccgtgccatgtaataggcagagatacagtacagtgtccatgcaagaggtttcaaaccagaatatgcagaacatgaagtctatccagcgtgtactcaggcaaggatagttttgagggactttgcagatgcacaactctcacatggattttttctaaaattaaatgcagagcccctgtgagccatcaatcccttgtccagttgcccccatccccaccacacacacacacacacacacacacacacgcacgcacacaccactctccaaaaggaaggacaaacttctcacccattctaaatctcaggagtgaaaccctacagagtacaatggaaggaactgtataaaatactggtacaggtgttgaaaatgaatctctaatgattggggaaatatctgtttgcaagttggatagttttcaattattttcaaacgactggagagggacaaacttaaaagaattatcagctgagagaagattgaaagtaatttttgataagagtccaatatgtgatttta

SEQ ID NO: 92109 - DNA, 601 bp, Human
atggggaagtgcactttttatatatacctcatgttatccatacacaccctgaagagcaacagccactgtcccatgggatgaggtctagaatttccgtgccatgtaataggcagagatacagtacagtgtccatgcaagaggtttcaaaccagaatatgcagaacatgaagtctatccagcgtgtactcaggcaaggatagttttgagggactttgcagatgcacaactctcacatggattttttctaaaattaaatgcagagcccctgtgagccatcaatcccttgtccagttgcccccayccccaacacacacacacacacacacacacacacacgcacgcacacaccactctccaaaaggaaggacaaacttctcacccattctaaatctcaggagtgaaaccctacagagtacaatggaaggaactgtataaaatactggtacaggtgttgaaaatgaatctctaatgattggggaaatatctgtttgcaagttggatagttttcaattattttcaaacgactggagagggacaaacttaaaagaattatcagctgagagaagattgaaagtaatttttgataagagtccaatatgtg

SEQ ID NO: 92110 - DNA, 601 bp, Human
cttttacttctttaattttatgtttgtgttctttctcatgcagaaaatcttgattcctattaacactcataatattatctgctttatcctaatttgtttaaataatatacagtatattagagagagtttcaaaataacagttcaaatattattactaataatatgattactgaaaacaaccttcaacctacaatctttgcagctctttctgtccttagaatctacctactaggggcatgtagaaaacatagctatgttttaaagtcatttgtagtagctcctttctgtgtggtgaagccaycagtgtaatacacaattaggcttatttgtttcatgtttgcttttaatttttaggacttgctttgttttttattttgcatttgatttaatgttgctttataatgatgtaaaaactgagacactgtttcaaagtcaaaaccacaaaacaaggtacattcaagcaaaattttgtcccatctctgctcagtctcctcaccctgttctcttcctcctacagataaccatttctgtttggttttagtttatctttccattgtttcttacataagcaaatatggatttacattcacttcatccctat

SEQ ID NO: 92111 - DNA, 601 bp, Human
aaagttgcaacaggggccacctgcaaagcctaaaatatttactatgtgatcttttacagagttgggtggcccctgacttagactcaaagggtaggagaaccagagacatatggttttgttgtagtgttatcaaaatactaataatgccttaacaccaaataccattcagtgtcaaaagttcccaaatgttttcaagtgatttttgaaagttggatccagaaaagatccacacatcacatttagtaatgtctcctatggtcttaatctataggattcccctaccttctgccccaactttccttttatttatttatttatttatttatttatttatttatttattgttgatgatcccgggtcacttgtcccaaaaatttctcaaagtctgtttatttcactgtatccccatgggttatttcacctgttcctctacctgccgcatttcctataatcaggaacacttgatgatacctgaccaggtatccagagccctgattagatctaggttcataaatggtgctgtttgcttccttctgtaacacaacaccaggcaaacttctttgtgatgttaagactgatcagtggattcaatctgatatta

SEQ ID NO: 92112 - DNA, 601 bp, Human
cacgttagcagggctgccagattaaacacaggatgcccagttaaatttgactttcagttgaacaacattttaaaaaattatacttatgtcccagatattgcatagaacatactcatactaaaaatatgttggcttttttttttgtctaaaattcaaatttagcaaggtgtcctgtatttttatttgcaaagtctggcaactctggattgcagacctggtgaggaagttgacattatgctccagaacatcctccttttatccgctgggctttctgcacgtgtgcaggctctatctcactccytttggctctgcctcatcctaaagaagactgatgagttagggatacaatgcacagaaaaactttcttctctctcctcctgtgctcttcccagccttctccccctgtttctccttagcatcctccagtggggtgaatgtggcagagaggggacatggcagccaggattttcccctataaacacagctctgctaccttctagctgtggatccctgggcaagtcatttttcctacttaagcctgttttctggtgtgaaaatggaagggataactatattcacctcccagggctgtttgcctgat

SEQ ID NO: 92113 - DNA, 601 bp, Human
gcacttcagtttccttatcttcaaaataagagtgaagcaacagcctgcctaaaatgagattatgtatgtaaaaacccattgagcatcgttaagtgcaaaagtatatacacaaagtacagtaactgttcattgtgtgtgtctttatatgctactgtgcagcataacaaacctaatttcctcaaatttccttatttcccataaaaatccatgctgatcttcctccaaggtgaccaataccattctctggagagaccctgtctgggaaaggtagtggtcaaagccttccccggtaaaaaattaytgacaaatacgtcccatggtaaaacttagccagacataaactagccagaaacagtaatatgaacaataagaatagtgctaattaattaataatgagtgctggccacagcatgttacatacatcccttatttaagctctctccattcctgtgtgatagaagcctctatcatccccaagtcacagatgaagatagggtaccttgcccaagcactgcataagaaatattagctactgacccaagctctcaatgagataattaaggattttaaggctgaaccctgaaaaaagagatgtaagtaa

SEQ ID NO: 92114 - DNA, 601 bp, Human
accaagcagcacaaccaatgtggatgaagtttatactgcattcttccaggaatggactattaataaaatatttcaagaagcctgtgatacaacaaagagcatgatgttggaagtcagaagccctgggttctaaatgtcacttttgacaagcacttaacaccctgtgcacttcagtttccttatcttcaaaataagagtgaagcaacagcctgcctaaaatgagattatgtatgtaaaaacccattgagcatcgttaagtgcaaaagtatatacacaaagtacagtaactgttcattgtgtrtgtctttatatgctactgtgcagcataacaaacctaatttcctcaaatttccttatttcccataaaaatccatgctgatcttcctccaaggtgaccaataccattctctggagagaccctgtctgggaaaggtagtggtcaaagccttccccggtaaaaaattattgacaaatacgtcccatggtaaaacttagccagacataaactagccagaaacagtaatatgaacaataagaatagtgctaattaattaataatgagtgctggccacagcatgttacatacatcccttatttaagc

SEQ ID NO: 92115 - DNA, 601 bp, Human
gtagacaaatttattaatggaacaaactagagagtccagaggcagacccatgtataaatattggaatttaatatatgaaacaatggcttagtaattaaagtgttgggacaatgaactattcattaaaaaaaatacgcttagatacctacctcacaccatatacaaaaatcatttccagatggattaaagagctaaacataaaaaacaaaacaataataatattagaagaaaacttagaaaagtattctttatcctcagaaaaggaaggccttcctaaataagacacatgttcaagaagccrtcaagaataagatttagagatacaacttacaaaaattaaattcttttgcatggcaaaagacaacataagcatagctaaaagacaaatggccaaaaaagtacaatatatgtaacagacaaagaattaaaatccatataatacaaagtgctccttcaaattagttaggaaaagcaacccagcagaaaaatgaatacagggtaagaacagatgatccacaaaaggactagaaatggccacaaacatatgaaaagatgccaattaaaacaacagaaacacatttctgaatgtcaattgggaaag

SEQ ID NO: 92116 - DNA, 601 bp, Human
agaagtgtttaaaacacctcagcataaaccttagcagaaaatgtccaaggttatttaaataaatgcattgaaaaacataaaagaggatctgaacaaatgaaaagttgtgtcatttccttgaataggaagactcaatgttatacatatttcatttcttctttagattaatctgaaaagttaacacaatatatatgaaaacccaaatgaaatggtgtatggaaattgacaagatgaacccaaaattgatctaaagtagtaattatttgataaaaactaagatatacttgaaatagaacaatamgggagagttactctatcagatagcaaagcattttatcaaactatgtaatgaacacattgcattttggcatagggtagacaaatttattaatggaacaaactagagagtccagaggcagacccatgtataaatattggaatttaatatatgaaacaatggcttagtaattaaagtgttgggacaatgaactattcattaaaaaaaatacgcttagatacctacctcacaccatatacaaaaatcatttccagatggattaaagagctaaacataaaaaacaaaacaataataatattagaa

SEQ ID NO: 92117 - DNA, 601 bp, Human
aaagataaaagaagaaaaaccatattttcaaaaatgccaaaaatttccaacatctttttctgattaaaagtctaattcatagaaggtaacttcctttattaaatatactaaatatcatatttactgacaaaacgttaggaaaatacaaagtatcttctatcacgaattttatgtgacatttttcaagaggtcctaaccaatgcaataaagcaagaattttttaaatgaggtagaaatattgaaaacaaaacgtcaaactgcctgttgtatggatatgatatgactattcaagacaattaaygaaaaagcagttagaaccattatatgatttagcagcctacccagaaataagagaaacacacaaaaatcaaactattctcacatgccggtggcaatgacttcaaaatacaatggaaaataagattatttgtacaataacaacagaagtgtttaaaacacctcagcataaaccttagcagaaaatgtccaaggttatttaaataaatgcattgaaaaacataaaagaggatctgaacaaatgaaaagttgtgtcatttccttgaataggaagactcaatgttatacatatttcatttcttct

SEQ ID NO: 92118 - DNA, 601 bp, Human
aatcagtgtaaaacaaacaaagcaaaacagccagccaaaaggaaaataaaaatcagaattgatctacacaatcaattgttagttctctcaaaagttacataaacttttggcaagattaataagggatgtagaggagacaaatgtaaaatgttaagactattacatccataaatttgaaagtatacatgcattattggtttactaaaaatattaattttttaaaagttaaatagaaaagttgaatacaaaaaccataattgtaaaaaaaatctatacattaaaaaactagaaggttcagatrgttttctggttgagttctattaaagttttctgtcttatttatactttttcaaagcaaaaaaagatagaaactttcccaaaccattctatgtggtttaaacgtccctgaagacaaaatcagtcaaatttaacatacagccttacatgtatatttacataataaatatcaacatacatagttatctatatgtgtgtaaaactatgttatgaatatactctccaaatacaaataaaatatttatcaaatcagcactatattacaagaattccatattatatatagctcaataaggtttaccct

SEQ ID NO: 92119 - DNA, 601 bp, Human
aaataaatactgattaatcagtgtaaaacaaacaaagcaaaacagccagccaaaaggaaaataaaaatcagaattgatctacacaatcaattgttagttctctcaaaagttacataaacttttggcaagattaataagggatgtagaggagacaaatgtaaaatgttaagactattacatccataaatttgaaagtatacatgcattattggtttactaaaaatattaattttttaaaagttaaatagaaaagttgaatacaaaaaccataattgtaaaaaaaatctatacattaaaaaaytagaaggttcagatagttttctggttgagttctattaaagttttctgtcttatttatactttttcaaagcaaaaaaagatagaaactttcccaaaccattctatgtggtttaaacgtccctgaagacaaaatcagtcaaatttaacatacagccttacatgtatatttacataataaatatcaacatacatagttatctatatgtgtgtaaaactatgttatgaatatactctccaaatacaaataaaatatttatcaaatcagcactatattacaagaattccatattatatatagctc

SEQ ID NO: 92120 - DNA, 601 bp, Human
gaagatacactttaaaaatacaaataatgggtttcaataagtagatatgagtgttgtgattgtgtgcatctttcagcttccttaaaaaattgcacattattttcaattacctaaaaaaagtatcaaaaccaatcacatattaaatctcaaaggaaaactggaattccaagataaaaaataaatatgaagtaaaaataagaaacattttctgtatcaaatataataaaataaaagttaacaagaaagaataattttttaaaagttgtctttgggcaattaaattatttggtaaagaaaaaaytgaaaataaaatgtaaaagtatttattgtaacaataactaaagtcctatttcttgaaatctatgaaatataactgaagtaatttttgaaaaaaaaattacagcatttaagcatttatttttaaaatagtgaaaatataattaaattaataaggattcagcaagaaaaaaaaaaaaggcagtaaagatccactaaacaaatgcaagaaaagtaagaagaaataaacaataaaataaaataaatactgattaatcagtgtaaaacaaacaaagcaaaacagccagccaaaaggaaaataaaa

SEQ ID NO: 92121 - DNA, 601 bp, Human
aatgaagcttagaaaacaccactagagacaataagtacaaatgagttatatcacctcttaaatgagagagaaatttaggttagaaaaatcaagttgcatgttatttaaaatagacatgtctaaaacaaaatggcagaaaacattgaaaatggaagagtgctaaaaatacaactatacataaaagaaaaatataattggctacatatatgcatatatgtgcatatacatgtatatatatatatgcatatacagatatatatagccaattacatttcttttattgtgatttacacgttgtctrttgtttcatatatatgtgaaaaaaaggattcaaaatgtcaaaaactaaagtaagactaaataatttatattaaatttatatcataattaatattatatttaaagctggtaaaattcaccattacgatgatgaagtttatgctccaattaatatagcaacaatatataaaaatttataaaaatatatagaaataatacatatatatgtatatgtgtgtgtatatatatatataaagagtaaaaacaagttataaataaaagaaaactgacaaagctatcattataatggaaaactaaaatg

SEQ ID NO: 92122 - DNA, 601 bp, Human
taatggttgttaatttggtagtaaaagtaatacaattactaataaaggcttcctgtaaaatagagacataaagtaaataataatactaataatgctattagtactaccactgatacaactaacatacttatctggaatgaaactttccaataatttcaaccataaatgcatagaagagtagatatagaaataattaaaagcctgataaaggctgtatgttatagaaaggaaaaaagaagcttacagtgattaattgttgagattaacactttaaatttaaatatgcttactaaaattttaragtagcttctagaatagaaatagtacatatagctttcaaaccgttttttaaataaagccaaaatctttaactaataccaaaaagactacagaaaggcggagtaggataatgatgactaaaaagcacaaaatgaaaatgaagcttagaaaacaccactagagacaataagtacaaatgagttatatcacctcttaaatgagagagaaatttaggttagaaaaatcaagttgcatgttatttaaaatagacatgtctaaaacaaaatggcagaaaacattgaaaatggaagagtgctaaaaa

SEQ ID NO: 92123 - DNA, 601 bp, Human
cccgagtagctgggactacaggtgcccgctgccacacccggctaattttttgtatttttagtagagacggggtttcactgtgttagtcaggatggtctcgatcttctgacctcgtgatccgcctgcctcggcctcccaaagtgctgggattacaggcttgagccaccgcgcccggcctaaagttcttatttctatggggggtcagttagagaaataataacaatgaataattaagaacgaataagttgggagatgggcaatcttgtttccaaaaagggaaatcatgtttgccttaaccacytgaagaattttaggaggtaaattataatacaagtttgcagagcagttcttttcttttctttcttttttctgagacagagtttcactcctgctgcccaggctggagtgcagtggcgcgatctccgctcactgcaacctccgcttcctgggttcaagcgattcccctgccttagcctcctgagtagctgggattataggcatgaaacaccatgcctggctaatttttgtattttcagtagagacggggtttcaccgcattggtcaggctggtctcaaactcctgaccacaagttatacaccc

SEQ ID NO: 92124 - DNA, 601 bp, Human
aaatctaaccttaagagcaagtccagcaagaagtcagcagaatgactaagccagtcaccaaggatcagtatctgcaaacatcaggttagattcttggctgcagtggcacagtatattccatgtgcatctgatctgcagaactttagcttctaactgacaatctcgaatctctcaccacaatttaggactcagtgtttcaagtgaaggagacagagacattccaaaagcgtggaagaccacgtgctaataaggtaggagatggacagaaagagaattcaccacagttcttagtaagatctcwaaggacagtagggagagtctttaaaaatagcctaaggaggatatcaaccacctgtgaatctgccaaactgaaagccaaggggaaaaggaagtgactgacaaggataaacacccagggtaccctttactgagaaaaacattagggaactcctctttgcccagcaggctagagatgttagcataagtgggagaaaattcacagcatgtgtgaaaactcaggaactaactgcatcattagtaaatagattttcaggaactgaaacttttgcctaatacatggaactcattgttaaaaaaacta

SEQ ID NO: 92125 - DNA, 601 bp, Human
ccacaagatggcacaattgaaaaactcatagctgttctgttttccttttttgtcatagtgaaacatttgtgatttttaagggtagcagatttaacagaggcatgacttgagtctcaatttagacctctgatttcatgctcttttgacaattacaccacatttcctacagttccattttttttttcctactaagaagctctctgctcccactaatgcctgcattcactctgctggctctaaatcccacctaatgtcttgttcagtaggtccaagttctgggctgagatagctcttatgagcyctcccccaatcaagattcctacgcaccccctttttacctccgtgtttgagagttggaaccatggctgctttccataggtgaagatctcccagaggatcaccccgaagctccatacatcactctctgtagtgaacttccggtacatgatgctttcaggaggcatccagcgaatggggagcatggtgtgtcctcccacctaaaaggggttgagatagaggcacacagagtgaccagatggccagaatgagtgttatctgtctgcactcttcacacatagatgcactcttgatgcatcctatt

SEQ ID NO: 92126 - DNA, 601 bp, Human
ccagcccatttcagtacctcaagcagacccccttcctttaacctgaatctcaacaggtgtttttgcaaaaattactgaattaatagagctaacatgcttagaaaagtgcctaccactaaatgtcagctactattaatttatgtttactagcattttttattattgcaaattacaattataaaaaatataatggctatttattactaagtttaacagtaaacatactaataaacatagtaaaaacatagtaataaaataaacacggtttattttattcctagacgttcacacatgactctaycagttataaaactggtcttcccaaattgaccatctggtacatccctgggcttggcatacctaaaacctttgtgcacccagattatgtgggcatactaagtagtgggtgtttccacaagatggcacaattgaaaaactcatagctgttctgttttccttttttgtcatagtgaaacatttgtgatttttaagggtagcagatttaacagaggcatgacttgagtctcaatttagacctctgatttcatgctcttttgacaattacaccacatttcctacagttccattttttttttcctac

SEQ ID NO: 92127 - DNA, 601 bp, Human
tctcctcttatctctcattcctggcaggctcccagttgcagactctgtgcacgtcaccacacttgcctctgagtcattacataggacccttttgcagcaagacccatccttccctgctgcttgcactaaaccatgcttccagtttctcttaaagtccttaacaataggactaactgcttgattcaccactgccttctgggtggccagttcaagtctgttaacctcaggatctcagcatgtccatctgtaagatggaatcaaatgtctgccttaaccacccccaggagtgttgtaaggatgaaatgagaccacgaaaagggactgtatggcccaacatactgaaggagaagccataaggaggagtaggaagaaaacaagtaatgcatgcctggccaaccccagcaggccacttgagacccaagtgtataatttgcaatgcatttccaattcctcaaagataattctttactgacactgaatatatgcattttcaaggcttcattgtctagtttttaggttggttttcacttctccctaactctaccactgcataactttggtcaagtcactgaccccgaacttcagtttctgcatttaaaga

SEQ ID NO: 92128 - DNA, 601 bp, Human
aaaatatatgtatatgggtgaaattgaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacrttactggatatactcatctgcctttatgatgaatgcaataattctccattgagaagagagaagaacattctcgaatacctagaatggggtaagtttgtaatttttaaagaaactgttaatctttagctggtcattatgatttaattggtatagagagttatgagtaaactctactccgttgaaagaaaaaatacaataaaaaaacagacactagttattcaagattttccgctagtttttggtaaatattttcccaggagtagaattgtgctgctcaattgttgccttgatttaaggcct

SEQ ID NO: 92129 - DNA, 601 bp, Human
ccgctcagaccaatgggcagtgcttcagtgtggagacattactggatatactcatctgcctttatgatgaatgcaataattctccattgagaagagagaagaacattctcgaatacctagaatggggtaagtttgtaatttttaaagaaactgttaatctttagctggtcattatgatttaattggtatagagagttatgagtaaactctactccgttgaaagaaaaaatacaataaaaaaacagacactagttattcaagattttccgctagtttttggtaaatattttcccaggagtaraattgtgctgctcaattgttgccttgatttaaggcctagctaatgtggaacttggctatgaagaacttatgtttttaggtcaacagtaagagattttaaatcaattctgtgatgggcaaaagtggattattggttacagttgcctaatacatggcactataatagtccttcatttgaaaggtatttattggtggaaacattcagactatggaaattattctcaaaataggaggagatattaaaatatctgtgtttgccttaggtcaacagaaagctgaaggtggtgatcagtgggtttta

SEQ ID NO: 92130 - DNA, 601 bp, Human
atgagtaaactctactccgttgaaagaaaaaatacaataaaaaaacagacactagttattcaagattttccgctagtttttggtaaatattttcccaggagtagaattgtgctgctcaattgttgccttgatttaaggcctagctaatgtggaacttggctatgaagaacttatgtttttaggtcaacagtaagagattttaaatcaattctgtgatgggcaaaagtggattattggttacagttgcctaatacatggcactataatagtccttcatttgaaaggtatttattggtggaarcattcagactatggaaattattctcaaaataggaggagatattaaaatatctgtgtttgccttaggtcaacagaaagctgaaggtggtgatcagtgggttttatttcatctctacatagtacaaggaaaggaaactgctaaacatggactttccaaaaattatgtttgtaagattaaatgacatagtttaaaaatcttgtgatagtagttagagaatgtttgggggcagcttccacttgagagttagattttactcgaaagttaatttaaatctaaactggttaggtttttggcttcatt

SEQ ID NO: 92131 - DNA, 601 bp, Human
tcaatgatgtgagcaaacgctccatgaccttcaagcttgaaggcttggctcaagttcttcagcgtctgctgttacatacagggcacattctaaggtccagaagttcactgttgcaataagcacgcatcgtcacccagatctgtctgtagtagtggtacgttggcttttgaaggattttggccaaatatgattttgtacctttggaatactaatcattttagtttgttcttatgctaagttcttatgctaaaatatctgttcccaagtaaaactttattttcctgaagtaaaagtcaagtgstgattgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtg

SEQ ID NO: 92132 - DNA, 601 bp, Human
cgcatcgtcacccagatctgtctgtagtagtggtacgttggcttttgaaggattttggccaaatatgattttgtacctttggaatactaatcattttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtrtaagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttt

SEQ ID NO: 92133 - DNA, 601 bp, Human
gtctgtagtagtggtacgttggcttttgaaggattttggccaaatatgattttgtacctttggaatactaatcattttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtataagaaggtttctagcaaygtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttttggtacttttagagttgga

SEQ ID NO: 92134 - DNA, 601 bp, Human
ttagtttgttcttatgctaagttcttatgctaaaatatctgttcccaagtaaaactttattttcctgaagtaaaagtcaagtgctgattgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcckgggaatgtaagaaatctaaaccatctttcaagtaacttctcacttaagagtgagacaattttggctttggtactggttttgtgagtatacgtcttttatttgttgaataaagtattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatct

SEQ ID NO: 92135 - DNA, 601 bp, Human
tgtgtctttttttttttttttttttggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtawacgtcttttatttgttgaataaagtattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatctgcgaagctatgggagaactctatgtaccagtagtaaatataattttaaatgatttatgataaagagaaaactgtatcctccattgcct

SEQ ID NO: 92136 - DNA, 601 bp, Human
tggatttgaaatttattcaaagttagtttctcaggtaaaccactgatacaagaatgtctacacgtaataactttaattattcaatttgccagtataagaaggtttctagcaatgtgatgtcataaggtttaaaaaaatatgtaaatgtgaatagaataacttttcaaaacagactgccagactcatcctgggaatgtaagaaatctaaaccatctttcaagtaacttctcacttaagagtgagacaattttggctttggtactggttttgtgagtatacgtcttttatttgttgaataaartattttgtaaagcatatgtagttttacatcccatgtttcacaaattgagaaattctgtagtgttaatttttttttttaagacttaaagggttttggtacttttagagttggaacttgagttcttaagttatggttccttaatgacactctagtctgtgatttttgtcatttagtattctttcctatctgcgaagctatgggagaactctatgtaccagtagtaaatataattttaaatgatttatgataaagagaaaactgtatcctccattgccttctgattattagagtttaggtaag

SEQ ID NO: 92137 - DNA, 601 bp, Human
tttaggtaagtagttttatgttatgagatatttcgctgtattatcagaataatttatatatattttccattaaatatgttttcttggatgttgtttcttatatatgtataagaacacctcatttatgtatatttttatataagccaaatatcaaataagtatttggctgagtattatttttattagtatggaagtctggataaagagtaaaaagaaagttaagaatggaaaaggctgtcaggagttgcgtagtgagtagtggtatttgctgtctttaagttatttgagaatttaggttaaragtgccagtctatttaagaattgaaatagatcagatgttcttcatatgaattgataactgcattttggggaaatgtcctattttattttaattacttaacaatatgtgaaaatcagttaagactaagaatatttccaaattgtgaattgacctcagttcagtgttctaaacattattttttgggactctggtggaaatttacagggattgttgttggggttaaatttggtaatttagatttgccttaaatggtgtaattttaagtttaatttttaataattgaaaaaatattgtctttta

SEQ ID NO: 92138 - DNA, 601 bp, Human
atatattttccattaaatatgttttcttggatgttgtttcttatatatgtataagaacacctcatttatgtatatttttatataagccaaatatcaaataagtatttggctgagtattatttttattagtatggaagtctggataaagagtaaaaagaaagttaagaatggaaaaggctgtcaggagttgcgtagtgagtagtggtatttgctgtctttaagttatttgagaatttaggttaagagtgccagtctatttaagaattgaaatagatcagatgttcttcatatgaattgatamctgcattttggggaaatgtcctattttattttaattacttaacaatatgtgaaaatcagttaagactaagaatatttccaaattgtgaattgacctcagttcagtgttctaaacattattttttgggactctggtggaaatttacagggattgttgttggggttaaatttggtaatttagatttgccttaaatggtgtaattttaagtttaatttttaataattgaaaaaatattgtcttttatttaaatctttaaaagactatttgcaacaggaacgcagtattaataacacaagttgt

SEQ ID NO: 92139 - DNA, 601 bp, Human
catttctatcaatttcattttattcctagttttagtccattttatttttatattggtacagttaatgttttgttcatagcagtatcaaaacaataagaaaactgacaattcaaagtcagatatgttgtttttctttgacagcctttcttgcttttggtgctgatggcttgagggaggaaataagtggaaagagaaagagaggattaagccaatgatcactagagcaagggaataaaagtgccttaagactatagatcacatttaaatttaataagatgtattatttttcatttatagtaamtagtatttgaaagactatgttttttgtctgcttagttttaagttgttgaaatgattatggtttgtatgtttgtgtatacagtaatagtcgatgtcagcataactctagaataaattacagtggagttgtagaagtaaaaataacttccacattgtaaactaatttgctagtaatgactgaattagtatatcattcgttaaatcggccaccccctactttgaaatgggaaattggaattttggggaattatttaccaatttacttaataaatgtaagataatattacttaatacaaaataa

SEQ ID NO: 92140 - DNA, 601 bp, Human
aaccaattactaagtctaaccagcatttaaaaaaaattaaagactagaatagaaaatataaagtacatcaaatatagaaggaataagtattgttgtgcaaaacattgtgttttcctgtagtccttattcccatatttcttactataggttgagataaaaatagtttgaaatacttcagtgtaggtgcagctatgctatgttgactgttaaacagtgaaaatatagacagttcattttttcaaaaaggacacacgatagattagggacttactcaagaacctagtgaagggaaagagtgtarggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaatttaaaagaacttaatgggcaggggagttaatttcactcttgtatttctttcaatggtttattgtctcttcctttgtttttttccgtttctgagtttgggctaatgggcattgact

SEQ ID NO: 92141 - DNA, 601 bp, Human
gcagctatgctatgttgactgttaaacagtgaaaatatagacagttcattttttcaaaaaggacacacgatagattagggacttactcaagaacctagtgaagggaaagagtgtaaggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaawttaaaagaacttaatgggcaggggagttaatttcactcttgtatttctttcaatggtttattgtctcttcctttgtttttttccgtttctgagtttgggctaatgggcattgactttgattgattgtcagaggtatatacgtttttgagtttgagtgataaccatatgacctataaacaaaggtagtagtttcttggttttagcttctcatcacttcagctgaactctagggtagatgtaggtgaggatttgctagttctatcagattttttctcatcatttgttgctcaggaaactgcc

SEQ ID NO: 92142 - DNA, 601 bp, Human
ttttttcaaaaaggacacacgatagattagggacttactcaagaacctagtgaagggaaagagtgtaaggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaatttaaaagaacttaatgggcaggggagttaatttcactcttgtatttcyttcaatggtttattgtctcttcctttgtttttttccgtttctgagtttgggctaatgggcattgactttgattgattgtcagaggtatatacgtttttgagtttgagtgataaccatatgacctataaacaaaggtagtagtttcttggttttagcttctcatcacttcagctgaactctagggtagatgtaggtgaggatttgctagttctatcagattttttctcatcatttgttgctcaggaaactgccagttttaggtatcgaggaccaagaattgcttagctccttttgccctgt

SEQ ID NO: 92143 - DNA, 601 bp, Human
ctcaagaacctagtgaagggaaagagtgtaaggtatgggcaagatacagacttggaaatagatgggaagaggagacatgggggagggagaaaaagagaatgagtagggagagggagacagagaatgagaatgaatactgtgttcctgagttgctacttcagtctgacttgttgaatgatagggtattttttttttttatgattgggtatttttaatttaaaagaacttaatgggcaggggagttaatttcactcttgtatttctttcaatggtttattgtctcttcctttgtttttttccktttctgagtttgggctaatgggcattgactttgattgattgtcagaggtatatacgtttttgagtttgagtgataaccatatgacctataaacaaaggtagtagtttcttggttttagcttctcatcacttcagctgaactctagggtagatgtaggtgaggatttgctagttctatcagattttttctcatcatttgttgctcaggaaactgccagttttaggtatcgaggaccaagaattgcttagctccttttgccctgtcttgatgagtcaagaagtctttgcataataattgtta

SEQ ID NO: 92144 - DNA, 601 bp, Human
aactctagggtagatgtaggtgaggatttgctagttctatcagattttttctcatcatttgttgctcaggaaactgccagttttaggtatcgaggaccaagaattgcttagctccttttgccctgtcttgatgagtcaagaagtctttgcataataattgttatgagagaccatcatggctcactacagcctcaacctcctgggctcaggatcctcctgtctcagcttaccaagtagctggagctacaagcatgtgccaccatgcccagctaattaaaaaatttttgtgtgtgtggagatgggggggtctcattatgttgtcctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggctaacatggtgaaac

SEQ ID NO: 92145 - DNA, 601 bp, Human
gtgtgtgtggagatgggggggtctcattatgttgtcctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggytaacatggtgaaaccgcgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagc

SEQ ID NO: 92146 - DNA, 601 bp, Human
gggggtctcattatgttgtcctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggctaacatggtgaaaccscgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagctagcttctacacactt

SEQ ID NO: 92147 - DNA, 601 bp, Human
cctgactggtctcaaactcctgccctcaagtgatccgcctgccttgggcttccaaagtgttggaattgcaagtgtgatcatctgcacttcgtgtgatttttgtttttgaattacccacactgtaagtatggattatcccagacacaagttttttgttgtatataaaaactccttggccgggtgcggtggtttacgcctgtaatcccagcactttgggaggccgaggtgggcggatcacgaggtcaggagattgagaccatcctggctaacatggtgaaaccgcgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagctagcttctacacacttccttcctatgactgccatc

SEQ ID NO: 92148 - DNA, 601 bp, Human
ggtgcggtggtttacgcctgtaatcccagcactttgggaggccgaggtgggcggatcacgaggtcaggagattgagaccatcctggctaacatggtgaaaccgcgtctctactaaaaattcaaaaaaaaaaattagccgggcgcggtgacgggtgcctgtagtcccagctactcaggaggctgaggtgggagaatggcgtgaacccaggagtcagagcttgcagtgagccgagatcgcgccactgcactccagtctgggcgacagagcaagactctgtctcaaaaaaaaaaacaaaaaacaaaaaaaaaaactcctttccaaatctgggggacttccttttcttctccattaatggtgagtagaactccaggattattctttctagctagcttctacacacttccttcctatgactgccatctctttttctaatcagtacgtagggaatggctaatcttctattggctagtgtttctttatctatcactgtatgagagcagcactttagctttcatgttaacggggcacaaagacctggctccccctttccaatcccactgtttgcctttactcttcctcatggaactgtttgcttctctt

SEQ ID NO: 92149 - DNA, 601 bp, Human
gtttcaaagtgtgttctggaaatccatgggatatttaatagatgcttgagcaaggggaaaggtttatatgaataaatcagtttgggaaaagattttagacaacatttaatgttaaaaatacagcagattatcctagaatttatgaagtttatctgactatggaataggctttttttcagagcgtctggaggatggctggcaaccagtgtttcacagaatacgctttgggaaatgttcttccagtataaggtcatggttttccttgtaacttcctgagtagcagggttagaaagaaattttsagagaaatttgggatatcgtgtggattggagagagaatccaaatctgaataggttatattttacttagtggctgtgaacttcattttctgtgtgaaagtcatgtgcactgaaagataaatttaatcatggtgaaataacatgagtgatgctgttggtaaaattacatctaagaaaagcaccctaaaaagtagagtgaaatttgacatcataatgaaccactgctgtcaacccctaaagtccttgaaattactgagagatctcttaattatgaccttttcctgctctaattaagcttactt

SEQ ID NO: 92150 - DNA, 601 bp, Human
taagctagtgattttgtttttttccagtaaagctttattatgttctaatccagttacctctctaaccattggtacagaatttgggatcgatattgtcatggctgtgaaatagaacaatgctaattagattttatgaaagttttgtaaaagcagtatagttatcttgctacagcaagaatcccatccttaagtatcatcgtttacttagagtggctaatgcaatgccccaagttgactcagatactattaaaagcactcaagcatctacttagaagtggtatgccctgagatttaaaaaatrcttgtttgaaaagattaggaaaagcccccgcaatgaaacagtgactaaagcccctttttgagattgtattgctagctacctgtgatctggccctgagctaaaagcataactaacaaacatttaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacc

SEQ ID NO: 92151 - DNA, 601 bp, Human
atagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttttgcctatgtacctctggtaatcccagttaagtgtagtagctcatgagttctggttttattcaacctctgtgtgcatctggctcagttgayttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaccacttagaacatgatcctttgatcatgtcaacatcctgcttaatatacttcagtgactactgaaagctttcagaatgacatttgaactcctctttagcatgccatacagaat

SEQ ID NO: 92152 - DNA, 601 bp, Human
tacatgctaagttgacagtttcttctaagagtcctttgctgtgttatgttgcttgaggctgtgattaagtgtgatcatcatatttgtctcttttgcctatgtacctctggtaatcccagttaagtgtagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctytaacttgaaaatactgtgaattctacacatccaagacctttgtagaaggaagcaaaaaaaaaaaaaaaaccacttagaacatgatcctttgatcatgtcaacatcctgcttaatatacttcagtgactactgaaagctttcagaatgacatttgaactcctctttagcatgccatacagaatttttaatatgatcctgtttacttctctttttcttcactttatttatttatttagttttttgagatggagtctcgctctgtcacccaggctggagtgcaatggcacgatcttggctcac

SEQ ID NO: 92153 - DNA, 601 bp, Human
aatttgatgatggtgatgaagaaaataattttcataatccttgaagtatatgaacttcgttgaaagagaataaagtcagcttaataagaatgacatctaaaggtatgagaggacctagtaatctttgaaagaccaaccttaagagacttctctgacagcaagaaaaatgaaagagtaaacaacaagaaatgaagacgaggtttcttgagacaacaaaccacaatgcagacattatacaaatgtgagttacttttatcctatccattttgggattaatgtaaagaataagagtaatctatamagagtaatggatttaagataaaaaaatgtttgcctcagcttcccaaagtgctgggattacaggcatgagccaccatgcctggctttttcttcacttaaaaaaattttgaaataatctcgagtttacagaaacattgcaagtatagtataatttttttcctctggaaccatttgagagtaagtagcctacctaatgctctgtcatccccatatattttctgcattcttctacctaaccacaatacaactattaaaatgaagaaattaacattggtgtatattgtcatctaatctttagggc

SEQ ID NO: 92154 - DNA, 601 bp, Human
tgacttttcacatattggttaaattgtttggaaactcctctttcactgcaccccataggagacatttggtaatgtaggttgaatgaattatgccgttatacttgttatatgcagggctagaagcagtagctctaatcttgaaacattgtatgaaactcatatttttaatgccagggacttgtttcttctttgatttaccctattttatttcaaagtaattttttccttttaaaattatttaataattagaaatagtgataataaaaattcaaaagtggtttttgtgtttttctttttttgttttttttttgagatagaatcttgctttgttgcccaggctggagtgcagtggtgtgatctgggctcactgcaacctctacctcctgggtttaagcaattcttctgcctcagcctcctgagtagctgggactgcagacatgtgctactatgcctggctgatttttgtatttttttgtagagggggtatcgccatgttgaccaggctggcctggaactcctggcctcaagtgatgcgcccacctcggcttcccaaagtgccaggattaccggcgtgattacaggcgccaccacatgtggtcaa

SEQ ID NO: 92155 - DNA, 601 bp, Human
taattagaaatagtgataataaaaattcaaaagtggtttttgtgtttttctttttttgttttttttttgagatagaatcttgctttgttgcccaggctggagtgcagtggtgtgatctgggctcactgcaacctctacctcctgggtttaagcaattcttctgcctcagcctcctgagtagctgggactgcagacatgtgctactatgcctggctgatttttgtatttttttgtagagggggtatcgccatgttgaccaggctggcctggaactcctggcctcaagtgatgcgcccacctyggcttcccaaagtgccaggattaccggcgtgattacaggcgccaccacatgtggtcaaaagtgatttcttatatgagtagtcatttattatcccctagcagttggcaatttgtaaacaagtacttcatggtggtgaggtaaggagaagagggtgctgctatttaaaagaatgaggtaaaatgcagataatctcaaatttttcaaggtaaaagttcttagattaactctgcatttaactttatttgcacaatgtccatcataaactttagagtctggtgatgatggattgagcatacaaat

SEQ ID NO: 92156 - DNA, 601 bp, Human
gtatggaaagggaattttttttttggtggaagtgatagtaggtacggggcgtaatgtttttcctaaatcttaagtgatgattgaatgtgtatttatgaataactgataaaaatgaaaattttaaaaacagctgtagtttttacagaattaaaaagtctaaatccggctgggcacagtggctcatgcctgtaatcccagcattttgggaggccgaggtgggcagatcacgaggtcaagagattgagaccatcctagccaacatagtgaaaccctgtctgtactaaaaatacaaaaattagcygggcatggtggcacatgcctgtagtcccagctaccctggaggctgaggcaggagaatcgcttgaacccaggaggcagaggttgcagtaagccgagatcgcgccaccgcactctagcttggcgacagagtgagacttcgtctcaaaaaaaaaaaaaaaatgtctacatcctttactcctacttcactgatcttattttcaaacttgtgtttttctttttgaggtatttctaagtcctgtaatcgaggagctcaaaactggatagagggaatgggaaatttgtgttagaatttatgagtata

SEQ ID NO: 92157 - DNA, 601 bp, Human
tttcctaaatcttaagtgatgattgaatgtgtatttatgaataactgataaaaatgaaaattttaaaaacagctgtagtttttacagaattaaaaagtctaaatccggctgggcacagtggctcatgcctgtaatcccagcattttgggaggccgaggtgggcagatcacgaggtcaagagattgagaccatcctagccaacatagtgaaaccctgtctgtactaaaaatacaaaaattagctgggcatggtggcacatgcctgtagtcccagctaccctggaggctgaggcaggagaatygcttgaacccaggaggcagaggttgcagtaagccgagatcgcgccaccgcactctagcttggcgacagagtgagacttcgtctcaaaaaaaaaaaaaaaatgtctacatcctttactcctacttcactgatcttattttcaaacttgtgtttttctttttgaggtatttctaagtcctgtaatcgaggagctcaaaactggatagagggaatgggaaatttgtgttagaatttatgagtatattctttgagcagatcagtctttttcttcttcagttatttctctgttcttatgatggca

SEQ ID NO: 92158 - DNA, 601 bp, Human
gcgacagagtgagacttcgtctcaaaaaaaaaaaaaaaatgtctacatcctttactcctacttcactgatcttattttcaaacttgtgtttttctttttgaggtatttctaagtcctgtaatcgaggagctcaaaactggatagagggaatgggaaatttgtgttagaatttatgagtatattctttgagcagatcagtctttttcttcttcagttatttctctgttcttatgatggcaatttatagtctttgtcttaggagtttagttgattcctaaaaaacctatgtaggttaaattcrttagtgatacacagatacttctgtgaacacacagcaaaagaacactaacagagcagtgaagacaaatcacacaaatgatgtaaatgacgcaaaggatggatatgattattatttcttaaaactaaggagctgccaggtgctatgaggaggcatcagaatacgtgtcaactatacaactgcaaaggtagctttggtttagcagcgcttacccgctcttctgatgttcaagttgatacttgtaaatgcaaagaaatgccgtgtgtgcgtgtgtgtaaattctcatagcttttggagtacaag

SEQ ID NO: 92159 - DNA, 601 bp, Human
tgaactgtaggactctgagaaaactggtccgctttctaactactcctgagtcaggttttcagaggacgagaatgacgtctttatttactttaacattatgactctttacattcagatgcatattgaaaaacacaccccaaaagaaattattattgaattatgtaatactttgcttccttgtatgagaaatcattctgtttagtttgttgactacttctgttgctcaaggtcgtttttattttccagactgtgggtcatttattttgttcatgattgcatacctaaaaatttatcttgcatyttatctaaagggaaaaacatcaaaatagtagcaaagccataaaaaatttacataataaatctgtaatcattttagtttctaaatttaatgtctttgctgagaatcaatagaatttaaagcagatattaatcagtgtatctagataacattatatatttacagcttaaaatagggttaggatgaaatatttatgacagtttagtatattttgttttcaattaggtgtattactaaaaaacatgtaaaccattccatttaaaaaaagaagtaaaaggagatgatgtaatataactagtattt

SEQ ID NO: 92160 - DNA, 601 bp, Human
atgaagaaatgccaagaaaatgtttagttcaaatttactcttctttcatagaatgactttcactttaactgtttcacttgatttctatttatgctactctacagctgtccatttgtgaaagttaccagcctctagaatgtaaagagctatatatgattctattctagcatattgaggtgaagttatagatgagcagtgtgttttgttcagcttagttttgattaattttccttttttatggatattgaattatctttataattcagtgaaaaggcagtgtttgagatatttcatgtgcttkcttctctgtaaagttctcagtttttgtcactgaaacctataagccactgagcggctgctgtctgtatctgcttatgccagatagtccttggctttcatttgccagaatgcagcaagctttttgttatatagcttcaaatggcttttttccttaaaagaagcatgtttttgctggagaagtatgaatctatattaacagttgattataaaggacaaaactctgggacagccaaatggaagtgatgcgtagggcaaggtttagggtaagggagtagagggggaggatttccatgccctcctt

SEQ ID NO: 92161 - DNA, 601 bp, Human
tgactttcactttaactgtttcacttgatttctatttatgctactctacagctgtccatttgtgaaagttaccagcctctagaatgtaaagagctatatatgattctattctagcatattgaggtgaagttatagatgagcagtgtgttttgttcagcttagttttgattaattttccttttttatggatattgaattatctttataattcagtgaaaaggcagtgtttgagatatttcatgtgctttcttctctgtaaagttctcagtttttgtcactgaaacctataagccactgagckgctgctgtctgtatctgcttatgccagatagtccttggctttcatttgccagaatgcagcaagctttttgttatatagcttcaaatggcttttttccttaaaagaagcatgtttttgctggagaagtatgaatctatattaacagttgattataaaggacaaaactctgggacagccaaatggaagtgatgcgtagggcaaggtttagggtaagggagtagagggggaggatttccatgccctccttaattttcttctgagtttttaggttatagcaccaacatactaatgacactagct

SEQ ID NO: 92162 - DNA, 601 bp, Human
cattctctcctttccccagtttgtggtaacttctgatctactttctgtctctctgaatttctacatattgtagatattttgtataagtggaatcatttaatattattttgtgtctggcatatttcatttagcatgctattcgtaaggttcattcatgtggcattatgtgtcagaacttcattcctgtttatggctgaataatattccattgtatggctataccacattctgtttatctgttcatttgttgatggatacttgcgttgtttccaccttttggttattatgaataatgctgcartgaacattggcatacaagtatctgtttgagtccctatttttaactcttttgcatatatgcttaggagtgatatttctgggtcatatagtaattctatgtttaactttttgaggaactgccaaactgtttttcaaagcagtggtaccgtcatacattcccaccagcaatgtatgaaggttgagttttgctacatgcttgctaacatttggtactttctgttttttgattagtcattttagtaggtatgaagtggtaggtggttcattgtggctttgatctacttccttaataattactgat

SEQ ID NO: 92163 - DNA, 601 bp, Human
ggttattatgaataatgctgcagtgaacattggcatacaagtatctgtttgagtccctatttttaactcttttgcatatatgcttaggagtgatatttctgggtcatatagtaattctatgtttaactttttgaggaactgccaaactgtttttcaaagcagtggtaccgtcatacattcccaccagcaatgtatgaaggttgagttttgctacatgcttgctaacatttggtactttctgttttttgattagtcattttagtaggtatgaagtggtaggtggttcattgtggctttgatytacttccttaataattactgataacgagcagcttttcatgtgcttattggcaatttgtatatcttctttggagaaatgtctgattaaccctttgcccactttaaaagatagactatttttagaaaagttttaggttcacagtgaaattgagcagaaggtatagaaatttcttagatttccagcctccccatatgcatagtctcgcctattctttgtctatttaaaaattgcatttatcttttgttgttagagttcttcatacattctggatattctttgtcatgtatattatttacacat

SEQ ID NO: 92164 - DNA, 601 bp, Human
tactgtgtgagggagtgagataatatattaccagaattgctggaactatacttaatttaaattttttttaatttcatgctgggcatggtgtttcatgcctgtaatcccagcactttgagaggctgaggtgggtggatcacttgaacctaggagtttgagaccagccgggcaacatggtgaaaccccatctctacaaaaatacaaaaattagccagatgtggtggtgtgcgtctatagtcccagttgctctggaggctaaggtgggaggatcgcttgagcctgggcagtgtaggttgtaatragctgagatcacaccactgtaccctagcctgggtgagaacctgtatcaaaaagaaaaaattatatttcatatatatgtattgtgaatttgactttaaaattatttttccttagtatgtaatactaaaacgttctttaacttaaatgtagcctcaacatttttttaaaaagcagaaaaaaattttcactgctgtaacatagcagatttgtcatttttgtgctaacccgttgaatattttttatatacatacttagttttctacataggaacatttctggtatttttataccttgctttttt

SEQ ID NO: 92165 - DNA, 601 bp, Human
taatttcatgctgggcatggtgtttcatgcctgtaatcccagcactttgagaggctgaggtgggtggatcacttgaacctaggagtttgagaccagccgggcaacatggtgaaaccccatctctacaaaaatacaaaaattagccagatgtggtggtgtgcgtctatagtcccagttgctctggaggctaaggtgggaggatcgcttgagcctgggcagtgtaggttgtaataagctgagatcacaccactgtaccctagcctgggtgagaacctgtatcaaaaagaaaaaattatatttmatatatatgtattgtgaatttgactttaaaattatttttccttagtatgtaatactaaaacgttctttaacttaaatgtagcctcaacatttttttaaaaagcagaaaaaaattttcactgctgtaacatagcagatttgtcatttttgtgctaacccgttgaatattttttatatacatacttagttttctacataggaacatttctggtatttttataccttgcttttttttttcacttaatgtgataaagtgatctagtgcaagttaattaacctcctttttttttttttttttttt

SEQ ID NO: 92166 - DNA, 601 bp, Human
atgtgaaatagattttgtttttctaaggcggagttttgttcttgttgcccaggctggagtgcaatggcgccatctcggctcactgcaacctccacctcccaggttcaggcgattcttctgcctcaggccaacctcccgagtagccaccatgcccggctgattttgtatttttagtagagatggggtttctccatattggttaggctggtctcaaactcccgacctcaggtgatccgtccacctaggcctccccaaagtgctgggattacaggcgtgagccactgcacccagcaatagatctttttttttttttttaatgactttaccatagtagctttgtatatgaatctgatggcaattgggatgtagatatcttttgcaataaataataatagtcacagattgtataaccagttctcataacacattataagttctgtaagcttgaggatttagtttggtttaattctctttttgtggtaatttttagaaactgtaaacatttaagtgttaaaaggtgattaagaatatgccatagtcactattttctggcatttatcactgtttttaattatatatatttgcaattatttgattatta

SEQ ID NO: 92167 - DNA, 601 bp, Human
ctcggctcactgcaacctccacctcccaggttcaggcgattcttctgcctcaggccaacctcccgagtagccaccatgcccggctgattttgtatttttagtagagatggggtttctccatattggttaggctggtctcaaactcccgacctcaggtgatccgtccacctaggcctccccaaagtgctgggattacaggcgtgagccactgcacccagcaatagatctttttttttttttttaatgactttaccatagtagctttgtatatgaatctgatggcaattgggatgtagatatyttttgcaataaataataatagtcacagattgtataaccagttctcataacacattataagttctgtaagcttgaggatttagtttggtttaattctctttttgtggtaatttttagaaactgtaaacatttaagtgttaaaaggtgattaagaatatgccatagtcactattttctggcatttatcactgtttttaattatatatatttgcaattatttgattattattgatcttccttactagagcagggactgtgtctgttttgcttaccagctcttccccaatacctaacataagtg

SEQ ID NO: 92168 - DNA, 601 bp, Human
ccatgcccggctgattttgtatttttagtagagatggggtttctccatattggttaggctggtctcaaactcccgacctcaggtgatccgtccacctaggcctccccaaagtgctgggattacaggcgtgagccactgcacccagcaatagatctttttttttttttttaatgactttaccatagtagctttgtatatgaatctgatggcaattgggatgtagatatcttttgcaataaataataatagtcacagattgtataaccagttctcataacacattataagttctgtaagcttraggatttagtttggtttaattctctttttgtggtaatttttagaaactgtaaacatttaagtgttaaaaggtgattaagaatatgccatagtcactattttctggcatttatcactgtttttaattatatatatttgcaattatttgattattattgatcttccttactagagcagggactgtgtctgttttgcttaccagctcttccccaatacctaacataagtgcttggtgtattgtaggcactcaataaatatttatttgattaatgaaagaattggtgagtgaacaacggagtta

SEQ ID NO: 92169 - DNA, 601 bp, Human
ttgtatagttgtggaaggtaggtgagtaagacatattcctcataataataattcaattaaaatacctcttaccctgataattctcttcacaagtaaagttttaacaaagttagaattttgattttagaatttagtggaaagcaatgattatgaccaaattatcttaataccttgttgaattttcactgtatcttctaagtgataaagatgattttaattcagtgaactttgtagttgagacttttgttaataaaatatttttaaaaagttttactgccattctgtgtagaaataattggarcaagatttttaaaaataatcattatgatacctatcttttatctttctgtggaaaaaatatggaaacgcttatgtctctagaggtaaatatttagtgaaatgtggttttcatttgaaattaaaattaatcatttttgatttcatattttttctttaacactatgatactttaaaaattattggctgggcttggtggctcacgcctgtaatcccagcactttgggaggccaagacaggcggatcactaggtcaggagtttgagaccagcccggccaatatggtgacaccccatctctactaa

SEQ ID NO: 92170 - DNA, 601 bp, Human
gataaagatgattttaattcagtgaactttgtagttgagacttttgttaataaaatatttttaaaaagttttactgccattctgtgtagaaataattggagcaagatttttaaaaataatcattatgatacctatcttttatctttctgtggaaaaaatatggaaacgcttatgtctctagaggtaaatatttagtgaaatgtggttttcatttgaaattaaaattaatcatttttgatttcatattttttctttaacactatgatactttaaaaattattggctgggcttggtggctcaygcctgtaatcccagcactttgggaggccaagacaggcggatcactaggtcaggagtttgagaccagcccggccaatatggtgacaccccatctctactaagaatacaaaaataagccgggcatggtggcgtgtgcctgtagtcccagctactcgggaggctgaggcagaagaatcacttgaacctgggaggcagaagttgaaatgagccgagatcgcaccactgcactccagcctgggcaacagagcgagactccgtctgaaaaaaaaaaaaattatctgttatagacctcagggctatt

SEQ ID NO: 92171 - DNA, 601 bp, Human
tatgatacctatcttttatctttctgtggaaaaaatatggaaacgcttatgtctctagaggtaaatatttagtgaaatgtggttttcatttgaaattaaaattaatcatttttgatttcatattttttctttaacactatgatactttaaaaattattggctgggcttggtggctcacgcctgtaatcccagcactttgggaggccaagacaggcggatcactaggtcaggagtttgagaccagcccggccaatatggtgacaccccatctctactaagaatacaaaaataagccgggcakggtggcgtgtgcctgtagtcccagctactcgggaggctgaggcagaagaatcacttgaacctgggaggcagaagttgaaatgagccgagatcgcaccactgcactccagcctgggcaacagagcgagactccgtctgaaaaaaaaaaaaattatctgttatagacctcagggctatttgttatttttaaattgtctttaaaatgaacttgaattttgtgaacattgtactttatttattgaatttatgattctgtagaagaaacaggtcaatttctggtggtacatgtcttaacttcagt

SEQ ID NO: 92172 - DNA, 601 bp, Human
ctttaaaatgaacttgaattttgtgaacattgtactttatttattgaatttatgattctgtagaagaaacaggtcaatttctggtggtacatgtcttaacttcagtattggaataaaaaaagtttaaatgatagtacagtaataagaggtagctgattacacaatacaaatgttgagggttaatagtgtgcttttggttggaacagaaaacctgatgcaaactggtttgaagaatatggaaagttttactagttaacctatcaagagcaaaagtggggtagacttcttggtttagtggctytatagtattatcaaatatccaaagtctttcagtctcactgttgttgtagtatagatttgggtgttttttttgtttgtttttgtttttaatttttgagacagagtctcactctgtcacccaggctggaatgcagtggtgtgactttggctcactacaacctccgcctcctggattcaagcgattctcctgcctcagcctcctgagtagctgggatgacaggcgcgtgccaccatgcctgggtaatttttgtatttttagtagagacggggtttcaccatgttagacaggctggttttgaac

SEQ ID NO: 92173 - DNA, 601 bp, Human
atgattctgtagaagaaacaggtcaatttctggtggtacatgtcttaacttcagtattggaataaaaaaagtttaaatgatagtacagtaataagaggtagctgattacacaatacaaatgttgagggttaatagtgtgcttttggttggaacagaaaacctgatgcaaactggtttgaagaatatggaaagttttactagttaacctatcaagagcaaaagtggggtagacttcttggtttagtggctctatagtattatcaaatatccaaagtctttcagtctcactgttgttgtagtrtagatttgggtgttttttttgtttgtttttgtttttaatttttgagacagagtctcactctgtcacccaggctggaatgcagtggtgtgactttggctcactacaacctccgcctcctggattcaagcgattctcctgcctcagcctcctgagtagctgggatgacaggcgcgtgccaccatgcctgggtaatttttgtatttttagtagagacggggtttcaccatgttagacaggctggttttgaactcctgacctcaagtgatccgcctgcttcggcctcccaaactgctgggatta

SEQ ID NO: 92174 - DNA, 601 bp, Human
tttatagtgctcatttggaaaccaatatgaatcttggattatttattgtctttttatgtatgtcataccaggatcatttcttgtatatctaggacaaataaattctattatatctgtgttactggtatctgcagaaggtgtcattaagagaagatttaaagtcaattcaataaattttttaaatgtacagtaaagtattatgtctataatggagtgtagcagcaatgaagatgaacaacatgtggttccttccctaaaggaattaaacagaattaaatgtaataaagggggcagtagagaragattactttggtgtggggagtagaaaggctcaatcatggaagtgacattttgagcttactcttaaggaattaatgttttgtgaaacagagaaaagggggcattttagatggaaaggaagctcaaaggcatgtgcttggagcatagtacttgggtgcagttgaggcatagtgggaaataaagttgaaatggtggattggggccatttcagaaggcttactacttaatttgaatttgactctatggacagtgggaagccattgaatatatatatttgtttttatttttagaggtagagtct

SEQ ID NO: 92175 - DNA, 601 bp, Human
ttgaaacatcactgtgtactccatgaatatgtataattatttgtcaattaaaaaccctgggcactgagtttatttttttattggtggctagtcacgtaggaaccctctgcctagcctctgcctagcacatactgaaattcaacaaggttgaagattcaacaaggtattaagtaatttggtcataatcatattgctttccattgaattctaaaatcaaaattctaactttgttaaaactttacttgtgaagagaattatcagggtaagaggtattttaattgaattattaatattaattgarttattatcattccttctggacttccagaaggatagtagattttcagcataaattatattatttgcagaaatagttcaggtacagtgagccattcttaccagttaggattgtgagaacactcccaaaatctaagttcccagatgccagccatagaccaaccttgcaaataggccttgctaagaaatagcagtctcaggtctgtgatgtaactcttttccgcacaatacgaaacagtacttttggagcattggagagagaccatcctaggagagagtattgagattgtcaggaatgtgtgtt

SEQ ID NO: 92176 - DNA, 601 bp, Human
agtagtaaagaaggaagaagtgttttcaggagaggaatccaagggggctgtggagcaaccacttgctagagagagtagcatgatgaaaaggtaggtaagtgccgatattaagacagtgggaaaaaggccctgaaggcatttcagaaatcttccaggctgtccttcccattataggctcagaggcttaggaggacagaatggtttcaaggggccaggcctagggcttcaactgccttgtgccgactcaggatgctgttcttctctctgactccagctggattaataaaagcatgattgtgattttttttttctttacctatatccaagtactcaggagtaggcagagttacagttttaactagggtttgctgacataatttgaattgttcagaaatgaggtggctcctttttttacactagcgtgagacagagaaacaggtggagattttgtggattttattctcattcgataatcccatggtaaaccctaaatgatcctctttctagtgacaggaccatctaggactcacagaggatacaatttgtatggaataacctgtcaagataagcagagtatcagatactgacagtccttcattgt

SEQ ID NO: 92177 - DNA, 601 bp, Human
ttttttctattttgggtagagacagggttttgccatgttgcccaggctggtctcgaagtcctgagctcaagtgatccacccaccttggcctcccaacatgctgggattacagatgtaattaatcctggcctagaacaaagtggatttctaacagttaggggaacttgggtttccagcaagagaaaaatgcaatcaaatgttgctctgaagtttgggcttagggaccaacttagtatttctttaggaatcatagattaagaaaatgtgtacattctctccagtgctattagtattaaggttrggccctctcctggggatggtggtgggtagaatacttgataatcacctgctgggcctcagatttaaagcttacggacttacatgtggttcactggaaaaccaaccagtatttataacataatctttgagataatgtattccaaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttacaa

SEQ ID NO: 92178 - DNA, 601 bp, Human
ctgggattacagatgtaattaatcctggcctagaacaaagtggatttctaacagttaggggaacttgggtttccagcaagagaaaaatgcaatcaaatgttgctctgaagtttgggcttagggaccaacttagtatttctttaggaatcatagattaagaaaatgtgtacattctctccagtgctattagtattaaggttaggccctctcctggggatggtggtgggtagaatacttgataatcacctgctgggcctcagatttaaagcttacggacttacatgtggttcactggaaaacyaaccagtatttataacataatctttgagataatgtattccaaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttacaaaatatcaaaatatcctatttaatactcatcaaaccataccatcatgacatttgatgtgtcaagacaaagcattaatagaagatagtttatggattattca

SEQ ID NO: 92179 - DNA, 601 bp, Human
ttaggccctctcctggggatggtggtgggtagaatacttgataatcacctgctgggcctcagatttaaagcttacggacttacatgtggttcactggaaaaccaaccagtatttataacataatctttgagataatgtattccaaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttayaaaatatcaaaatatcctatttaatactcatcaaaccataccatcatgacatttgatgtgtcaagacaaagcattaatagaagatagtttatggattattcattagttatttaaaacaatctagtaaagcacttaattaaaaagtatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgccca

SEQ ID NO: 92180 - DNA, 601 bp, Human
aaattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttacaaaatatcaaaatatcctatttaatactcatcaaaccataccatcatgacatttgatgtgtcaagacaaagcattaatagaagatagtttatggattattcattagttatttaaaacaatctagtaaagcacttaattaaaawgtatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaa

SEQ ID NO: 92181 - DNA, 601 bp, Human
aattccaaagtagttatttgtaactaaatttctagattatgactagttcataagttgtgaattgctttaagttcagcttttcatttcaaggagaataaaatataaaaaattaaatcattactttttaggaaatgcaaattcttatatttttagttacaaaatatcaaaatatcctatttaatactcatcaaaccataccatcatgacatttgatgtgtcaagacaaagcattaatagaagatagtttatggattattcattagttatttaaaacaatctagtaaagcacttaattaaaaartatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaa

SEQ ID NO: 92182 - DNA, 601 bp, Human
tttttaggaaatgcaaattcttatatttttagttacaaaatatcaaaatatcctatttaatactcatcaaaccataccatcatgacatttgatgtgtcaagacaaagcattaatagaagatagtttatggattattcattagttatttaaaacaatctagtaaagcacttaattaaaaagtatatatattttttgagatatagtctgtgttgcccagactggagtgcagtggtgtgatcttgtctcactgcagcccactccacctcttgggttcaagcagttcttgtgccccagcctcccsagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaaaatttagatgcaagggtacatatgcttatttattacatggatattacatgcataatggtggggggttgggcttccgtactcatcacccaaatactgggcattgtatccattggtaattttt

SEQ ID NO: 92183 - DNA, 601 bp, Human
tcaagacaaagcattaatagaagatagtttatggattattcattagttatttaaaacaatctagtaaagcacttaattaaaaagtatatatattttttgagatatagtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcargtgaactgcctgccctggcctcccaaagtgctgagattacaggcgtgagccaccatgcctggcctaataaagcattaacaaaaaatttagatgcaagggtacatatgcttatttattacatggatattacatgcataatggtggggggttgggcttccgtactcatcacccaaatactgggcattgtatccattggtaatttttccaccctccgtacttctgtcctctttcctttggagtctcgagtttttttcctccatttttatctccatatgtaccctttgtttagctcccacttat

SEQ ID NO: 92184 - DNA, 601 bp, Human
agtctgtgttgcccagactggagtgcagtggtgtgatcttgtctcactgcagcccactccacctcttgggttcaagcagttcttgtgccccagcctcccgagtgctgggattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaaaatttagatgcaagggtacatrtgcttatttattacatggatattacatgcataatggtggggggttgggcttccgtactcatcacccaaatactgggcattgtatccattggtaatttttccaccctccgtacttctgtcctctttcctttggagtctcgagtttttttcctccatttttatctccatatgtaccctttgtttagctcccacttataaagcattttgaaaataaatataattatagcataaacattttcattacaaatagaatcttcctacctggttttcatttgctttttctatttttaggtggagagag

SEQ ID NO: 92185 - DNA, 601 bp, Human
gattacagtcatgcgccaccatgcccagctaatttgggcaaaatcccggccaacatggcaaaatcccatctcaaactcctggcctcaagtgaactgcctgccctggcctcccaaagtgctgagattacaggcgtgagccaccatgcctggcctaataaagcattaacaaaaaatttagatgcaagggtacatatgcttatttattacatggatattacatgcataatggtggggggttgggcttccgtactcatcacccaaatactgggcattgtatccattggtaatttttccaccctcygtacttctgtcctctttcctttggagtctcgagtttttttcctccatttttatctccatatgtaccctttgtttagctcccacttataaagcattttgaaaataaatataattatagcataaacattttcattacaaatagaatcttcctacctggttttcatttgctttttctatttttaggtggagagagtagtaaatgattatgataaaattttataaactattagtaaatattatcatagtattttcataggatatgaagagtaagcctgccatttttttggtgggtcaatacttt

SEQ ID NO: 92186 - DNA, 601 bp, Human
aaatacttgaaaaattatttatctgcatttaaaaaataacatattaatcaagatcttagataactgccggtaataccagagagcctgttgctgctgcagtgtgtgctagaggaattctgctgtctttttgacttagctgctatcacagtcctcacatcccacatgtgtaacagtaaacactggaagttattttattttctatgcagacattttagagtattatataaacaaccgcttaattaattttggtttaaactcctaggaagtgatgaaatcacattttaacaggactgaataggamccataaaataatttttaggtaatctctgttctcaccctaagaatattaattctgccattctaggtaatgtttactctaattcacttaaaatttttcttttccctttttttttttttttttgagacggagttttgcttttgttgcccaggctggagtgcaatggcgcaatctcgactcaccacaacctctgcctcccgggttcaagtgattctcctgcctcagctcccaagtagctgggattacaggcatgtgtcaccacgcccggctaattttgtatttttagtagagacggggtttctc

SEQ ID NO: 92187 - DNA, 601 bp, Human
gctagaggaattctgctgtctttttgacttagctgctatcacagtcctcacatcccacatgtgtaacagtaaacactggaagttattttattttctatgcagacattttagagtattatataaacaaccgcttaattaattttggtttaaactcctaggaagtgatgaaatcacattttaacaggactgaataggaaccataaaataatttttaggtaatctctgttctcaccctaagaatattaattctgccattctaggtaatgtttactctaattcacttaaaatttttcttttccctttttttttttttttttgagacggagttttgcttttgttgcccaggctggagtgcaatggcgcaatctcgactcaccacaacctctgcctcccgggttcaagtgattctcctgcctcagctcccaagtagctgggattacaggcatgtgtcaccacgcccggctaattttgtatttttagtagagacggggtttctccatgttggtcaggctggtcgcgaactcccgacctcaagtgatccacccgcctcagcctcccaaagtgctgggattacaggcgtgagccaacatgcctggcttct

SEQ ID NO: 92188 - DNA, 601 bp, Human
gggctctgagctgcttccaggggccctgggacaactgcttttgagggcctcatgtctactggaccatgggatccaagagaagagcccttgcctgaaatcacaggacctggaatggggctggcagttgtacaggttggagaactgggcctggtaatccctttaggagctgtgctctgaggagctttggagtttccctggcatgtctggggtgagagtgggggaaaaaagtgactctgagggttagggcaatgacctactcacaccccacctggttttgtgtaaaaccagagcagccaatcamgagaaagcgttctaatgattgattaaaaggactgcctttttctttctttaaaccacagcaataaagggttttgctaggctaactttctcagtttggcttggcctagattttcacatggctcagtattctccacattcacatgggccatggtgtttgtggaagtgaaggattggaatttgggagaatgtggtgaggagagagacagctgacttggtgcagtatctgggctatggaacaggcactgcataactgctgatggagtcttggctaccagtagcagccggtctatcccagagaggc

SEQ ID NO: 92189 - DNA, 601 bp, Human
gacgatccctattaggaaacagaacttccagaatgcagtccatttgtaagtttttatcattcatttataccggagagtcaattaagatcagattttttttgttaaaatataaattggcaattttagtttttaaaagatctactaaagctcaggagataatttagtgtaatagtcttcaaactgtggtatctgtatccttggtgcgtgaagactttccaagggatatgcggatgcatatagttttaagggaatcaattttcaggtctttagctttcctaattagtcttctaaaatccatctrtttgagaacagtctgaactctgtggattttctttccactcccatttcacaatgaaccatctcccatttttataaaataaaggcatatttctcacccatctcatatgttcccatggtactgtcttgtgttgtgaagatctcttaggtgtaaaacaaaagggactgtttgagaatgtgttgctcttgaaagagggcaaaagaaaaagagcttctataaaaagtattgaagcaggtattttatttcactagcttacaaaccagtggcaaaattcttatccgtcttctttcagagaactctgaa

SEQ ID NO: 92190 - DNA, 601 bp, Human
taaaatccatctgtttgagaacagtctgaactctgtggattttctttccactcccatttcacaatgaaccatctcccatttttataaaataaaggcatatttctcacccatctcatatgttcccatggtactgtcttgtgttgtgaagatctcttaggtgtaaaacaaaagggactgtttgagaatgtgttgctcttgaaagagggcaaaagaaaaagagcttctataaaaagtattgaagcaggtattttatttcactagcttacaaaccagtggcaaaattcttatccgtcttctttcrgagaactctgaagcaaaatggttgataccaggctatgtaataacacattcatttgaattaaaaattaaagtcagacttattctaatagaaaataagtctttttttatacaaggttttaattccatttagtacagtactttgtatctttttttcttttttttgagatggagtcttgctctgtggcccaggctggattacagtggcacaatctcggttcactgcaacctccacctcccaggttcaagttattctcctgcctcagccttccaggtagctgggattacaggcacacaccaccac

SEQ ID NO: 92191 - DNA, 601 bp, Human
aacctcaagtgatctgcccaccttggcttcccaaagtgctgggattacaagtgtgagccaccgttcccggccttagtacagtatgttaaattttgtgtgtgtgtgaatcaaattattttcaagtctgcaaaaaactgtatctccacaaagaggcttaaattgctgacaaatttctggggtgataaggcagcatatttaattaaataaaagtaatgtctccaaatataaagccttcagttaaatatatcttttggaattacaaagaattaaaccacttaatttataatataaattatattaytttaatatgtgaagtaagaaaatgatagttaaatatctcaactttaattttctggtatggtcagacctttacagatatttccatgctattttaactttaggatataaaacagtagcagtctactaagttttctattattaaaattagtatagaaattatcaaaatactgaaaaaactgttttatgaaagcagtacctccatcactgtaacttatttcctttcttttagaatacatcttcaaaagagaccagaatttatttaaagatagtagtttgaattttaaatttccagtcaattttt

SEQ ID NO: 92192 - DNA, 601 bp, Human
ccatggaggtggagcttgcagtgagccgagattgcgccactgcactccagcctgggcgacagagtgagactgtctgaaaagaaacaaacaaacaaaagttttatccagtatatctattcctagttttctaagagattttaaatttttagtaaaaactgttacagaattttatcaattgtttgcatgcattgagaggatcttaatgatttttcagtttttaaattccattatgtggtgattaacattgaagtttgaatattaaatcagttttaaattcctggattaaactcatcttgattgygatggataacgtatttctggatttgatttactaatgctttgattaggatattttttggattatgtttgccagagagattagtctgtagtcttgtaatactgtccttgtaagttttaagtattaacattatgctgtcctcataaaaaaggatgagatgtagtccctcaaataatggtgccatttctacatttaatattgagacgtttggaaaaatttagtgataaatccatctcattctggagttttcttgaaagattttaaattatggattcaatttctttattagagataggattgttt

SEQ ID NO: 92193 - DNA, 601 bp, Human
gtagtccctcaaataatggtgccatttctacatttaatattgagacgtttggaaaaatttagtgataaatccatctcattctggagttttcttgaaagattttaaattatggattcaatttctttattagagataggattgtttaagttctctgttggtcatttggcaagttgagtttttctaggaatttgcccacttttaattttaaagtttattggcgtacattttttcacaatgattgtttttctgtttactctcttaatgtccataattgtacacattttttctttttctttttttytttttttttagtatttattgatcattcttgggtgtttctcggagagggggatttggcagggtcataggacaatagtggagggaaggttagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagag

SEQ ID NO: 92194 - DNA, 601 bp, Human
gagacgtttggaaaaatttagtgataaatccatctcattctggagttttcttgaaagattttaaattatggattcaatttctttattagagataggattgtttaagttctctgttggtcatttggcaagttgagtttttctaggaatttgcccacttttaattttaaagtttattggcgtacattttttcacaatgattgtttttctgtttactctcttaatgtccataattgtacacattttttctttttctttttttttttttttttagtatttattgatcattcttgggtgtttctcrgagagggggatttggcagggtcataggacaatagtggagggaaggttagcagataaacatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagagcacagggttgggggtaaggttatagattaacagcatcccaa

SEQ ID NO: 92195 - DNA, 601 bp, Human
acatgtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagagcacagggttgggggtaaggttatagattaacagcatcccaaggcagaagaatttttcttagtatagaacaaaatggagtctcctatgtccacttcttyctacacagacacagcaacaatctgatctctctttcctttccccacatttcccccctttctattagacaaaaccgccatcgtcatcatggcccgctctcaaggagctgttgggcacacctcccagacggggcggcggctgggcagaggcgccccgcacctcccggacggggtgactgccgggagggctgccccccacctcccgaacggggcggctggccgagcgggggctgccccccgacctccctcccggacggggcagctgccaggcggagacgctcctcacttcccagacggggcggc

SEQ ID NO: 92196 - DNA, 601 bp, Human
ccgcagtgtttgtgtccctgggtacttgagattagggagtggtgatgactcttaacgagcatgctgccttcaagcatctgtttaacaaagcacatcttgcaccacccttaatccgtttaaccctgagtggacacagcacatgtttcagagagcacagggttgggggtaaggttatagattaacagcatcccaaggcagaagaatttttcttagtatagaacaaaatggagtctcctatgtccacttctttctacacagacacagcaacaatctgatctctctttcctttccccacatttcycccctttctattagacaaaaccgccatcgtcatcatggcccgctctcaaggagctgttgggcacacctcccagacggggcggcggctgggcagaggcgccccgcacctcccggacggggtgactgccgggagggctgccccccacctcccgaacggggcggctggccgagcgggggctgccccccgacctccctcccggacggggcagctgccaggcggagacgctcctcacttcccagacggggcggctgctgggcggaggggctcctcacttctcagacggggcggccgggcagagac

SEQ ID NO: 92197 - DNA, 601 bp, Human
catcccaaggcagaagaatttttcttagtatagaacaaaatggagtctcctatgtccacttctttctacacagacacagcaacaatctgatctctctttcctttccccacatttcccccctttctattagacaaaaccgccatcgtcatcatggcccgctctcaaggagctgttgggcacacctcccagacggggcggcggctgggcagaggcgccccgcacctcccggacggggtgactgccgggagggctgccccccacctcccgaacggggcggctggccgagcgggggctgcccccygacctccctcccggacggggcagctgccaggcggagacgctcctcacttcccagacggggcggctgctgggcggaggggctcctcacttctcagacggggcggccgggcagagacgctcctcacctcccagacacgctcctcacctcccagacgggttggcagtcgggcagagacgctcctcagatcccagacggggtcgcggccgggcagaggcgctcctcacatcccagacggggcggcggggcagaggcgctccccacatctcagacgatgggcggcagggcagagacgctcctcac

SEQ ID NO: 92198 - DNA, 601 bp, Human
ccccccacctcccgaacggggcggctggccgagcgggggctgccccccgacctccctcccggacggggcagctgccaggcggagacgctcctcacttcccagacggggcggctgctgggcggaggggctcctcacttctcagacggggcggccgggcagagacgctcctcacctcccagacacgctcctcacctcccagacgggttggcagtcgggcagagacgctcctcagatcccagacggggtcgcggccgggcagaggcgctcctcacatcccagacggggcggcggggcagaggcrctccccacatctcagacgatgggcggcagggcagagacgctcctcacttcctagacgtgatggcggccgggaagaggcgctcctcacttcccagactgggcggccgggcagaggggctcctcacatcccagacgatgggcagccaggcagagacgctcctcacttcccagagggggtggcggctgggcagaggctgccatctcggcactttgggaggccaaggcaggtggctgggaggtggaggttgtagcgagccgagatcaggccactgcactccagcctgggcaacattgagcactg

SEQ ID NO: 92199 - DNA, 444 bp, Human
ttggcagtcgggcagagacgctcctcagatcccagacggggtcgcggccgggcagaggcgctcctcacatcccagacggggcggcggggcagaggcgctccccacatctcagacgatgggcggcagggcagagacgctcctcacttcctagacgtgatggcggccgggaagaggcgctcctcacttcccagactgggcggccgggcagaggggctcctcacatcccagacgatgggcagccaggcagagacgctcctcacttcccagagggggtggcggctgggcagaggctgccatctcrgcactttgggaggccaaggcaggtggctgggaggtggaggttgtagcgagccgagatcaggccactgcactccagcctgggcaacattgagcactgagtgagcgagactccgtctgcaatcccggcacctcggggaggcccag

SEQ ID NO: 92200 - DNA, 601 bp, Human
aattgctgcaaacccaaatatatgtaattccatagtctttctgtaagactatttctctcaaatttacagggtgggggaaatactcttccttttttttttttttttttttttttttggtgtatacgaatatttgaaaactatcaaaccaggaaacacctccccccaccaccacctcccaatcccaaacctgtcatctctcattggctaagctgttccaagagctttgggttatttgtgtttttttttttttttccttgtttcttccattcttttcctttggtgcttatctgagaattcctasggaactttgaggaagtgtcatcagtatttcacagttagaatgaactattgtcctaacatttcatggaggttcaggaccatggacagatcacatgtgctacctgtctcagtcccacccacatattttagcaggttaaaatattcttctgaagtctccactggcatcattcttttccttataagttgaactcctccctatttttatcagtcatcttacagccaggtcttgcctctttaaagttgttttgttgttgttgttggtttttttttttttgagacagagtttcgctcttgtcgccca

SEQ ID NO: 92201 - DNA, 601 bp, Human
agtggtgccatctcggctcaccgcagcctcagcctcctgagtgtctgggattacaggcatgcgccaccacgcccggctaattttgtatttttttagtagagatggggtttctccatgttgtcaggctggtctcgaattcccaatcctcaggtgatctgcccgccttggaggcgtgagccaccatgcccggccttttttttgagacagagtctcattctgtcacccaggctggagtgcagtggtgcaatctcgactcactgcaacctctgcctcccgggttcaagcagttctcctgcctcarcctcccgagtagctgagattacaggcatgcgccaccatgcctggctaatttttgtatttttggtagagatggggtttcaccatgtttgccaggctggtctcaaactcctgatctcaccttaggtgatccacccaccttggcctcccaaagtgctgggattacaggcgtgagccaccgtgcccaacccctctttgaagtttttatctcacttatgtataaaatacttatcttgccaatacgtttgagttagtaaatagtttagtctctgcaaagaaatggagaattagataggttaagtaa

SEQ ID NO: 92202 - DNA, 601 bp, Human
gccttggaggcgtgagccaccatgcccggccttttttttgagacagagtctcattctgtcacccaggctggagtgcagtggtgcaatctcgactcactgcaacctctgcctcccgggttcaagcagttctcctgcctcaacctcccgagtagctgagattacaggcatgcgccaccatgcctggctaatttttgtatttttggtagagatggggtttcaccatgtttgccaggctggtctcaaactcctgatctcaccttaggtgatccacccaccttggcctcccaaagtgctgggattrcaggcgtgagccaccgtgcccaacccctctttgaagtttttatctcacttatgtataaaatacttatcttgccaatacgtttgagttagtaaatagtttagtctctgcaaagaaatggagaattagataggttaagtaacttatttaatgatggagccaggttttgcagtcaactttttctgactctgaaaccatatctctcaattacttgatatacttcattaaaaaaataattattctgttcattatactcttggtttatgactttaaaaatatgttttaaaatcaacttataattta

SEQ ID NO: 92203 - DNA, 601 bp, Human
tgatcagaatcagagatacaagtatattcagtagtcttatttataggaggcaaagtagatgaactagaatgccagttaggaatttccaataaagaatatatctatcagccatcagagtcatttgtatcgttctccccactgcttttttttttcctacaggaaaaattttatcagatgtttacttgaagaatgaaactggaataaggatagctactttagtgaatttaagttctgatagcatgataggaatgatgtgccaagtggattaatatttttgcccagtgtttaacatatccctctrctgtgcacaaaagactgctacctaaatttctcactcacagattttctctactgataatatctgcctcctggccacgtactttctttagctgtgtcattagctcaccattagatcttgctctgatttagtcataattatttaaaagaaaatacacaagttgtacatgaatatatgtttatttaaaaaacagtataattaacatttattgagccattttatgcaccagatatcacattaagtattatatattcttatttaattaaaaacccatttttaacccattgagggactcaaacaggt

SEQ ID NO: 92204 - DNA, 601 bp, Human
atatatctatcagccatcagagtcatttgtatcgttctccccactgcttttttttttcctacaggaaaaattttatcagatgtttacttgaagaatgaaactggaataaggatagctactttagtgaatttaagttctgatagcatgataggaatgatgtgccaagtggattaatatttttgcccagtgtttaacatatccctctactgtgcacaaaagactgctacctaaatttctcactcacagattttctctactgataatatctgcctcctggccacgtactttctttagctgtgtsattagctcaccattagatcttgctctgatttagtcataattatttaaaagaaaatacacaagttgtacatgaatatatgtttatttaaaaaacagtataattaacatttattgagccattttatgcaccagatatcacattaagtattatatattcttatttaattaaaaacccatttttaacccattgagggactcaaacaggtacttacatgccagtgttcatagcactggcatgtaatagccactcacaatagccaaaaaatgtaaacaccccaagtcttcattaacttgtagttgg

SEQ ID NO: 92205 - DNA, 601 bp, Human
atgttatgtgaatatgctccattatattttcctagtattactgtagattttaaaaaattgtttctctaattatggcattattttttgagtcgtgtgagctatggattaaagtttttttccaaatagttcatctttctcccactcatttaaaatacctatatctgagcccatttctgcttcattgttctattggttcaggggtcagcagactgacacacaagacaaatctggcctactgccttgtttttgtaaatacagatttattggaacatagccccacctatttgtttacatactgttyttgttttgattatgcaagggctgagttgaatagttggcacagagactaaagagctcacaaagcctgcaatatttactgtggcctttacagaaaaggtttgccaacccctgaattagtctcttttctaataccagacttttttttaaataaaaatatgaatatgggctgagcccagtggctcgtgcctgtaatcccagcactttgggaggccaaggtagatggattgcttgagcccaggagtttgagaccagcctgggcaacatggcaaaccctgtctctacaaaaaatacaaaaattagc

SEQ ID NO: 92206 - DNA, 601 bp, Human
acaggtcttctagtagatgatcttatctaagctttaagagatcactggattcctaaagtgattttattttgtagaattatgtattctgttatgtattttagtaacagattagaactaaattggatatagtagggatttcattcataaattatcattcaacactaaatgcaaattcttggctgaaggagcttatagaaacaaaatctattttgttataaaaatgcataaattaagcattttcttagtaggaccaaactttttgtgatatgttagagtgactaacttttctttcctaatcttrtaatatccttctatagacatttaaagctttacttctttatgccttccccaacaactttaaaccaatgttttcctgctctttctgatctcatgctaaagactgtatgctagatgatctggttgtaaatcccagttccttcatttatttgagtatttaagggccaacaaaattgtcagaaattagtttaaaaacgtaaataaatggactatttaggtcacataacttaaattattttgtttcctcatttaaaatgaagctagtaatgccacctatcttcatagtttgttgtgtgtcttggac

SEQ ID NO: 92207 - DNA, 601 bp, Human
cactggattcctaaagtgattttattttgtagaattatgtattctgttatgtattttagtaacagattagaactaaattggatatagtagggatttcattcataaattatcattcaacactaaatgcaaattcttggctgaaggagcttatagaaacaaaatctattttgttataaaaatgcataaattaagcattttcttagtaggaccaaactttttgtgatatgttagagtgactaacttttctttcctaatcttataatatccttctatagacatttaaagctttacttctttatgycttccccaacaactttaaaccaatgttttcctgctctttctgatctcatgctaaagactgtatgctagatgatctggttgtaaatcccagttccttcatttatttgagtatttaagggccaacaaaattgtcagaaattagtttaaaaacgtaaataaatggactatttaggtcacataacttaaattattttgtttcctcatttaaaatgaagctagtaatgccacctatcttcatagtttgttgtgtgtcttggacaagttggtatgcaaaacataaaatgtcaagcttgttaaatgg

SEQ ID NO: 92208 - DNA, 601 bp, Human
tgttagagtgactaacttttctttcctaatcttataatatccttctatagacatttaaagctttacttctttatgccttccccaacaactttaaaccaatgttttcctgctctttctgatctcatgctaaagactgtatgctagatgatctggttgtaaatcccagttccttcatttatttgagtatttaagggccaacaaaattgtcagaaattagtttaaaaacgtaaataaatggactatttaggtcacataacttaaattattttgtttcctcatttaaaatgaagctagtaatgcyacctatcttcatagtttgttgtgtgtcttggacaagttggtatgcaaaacataaaatgtcaagcttgttaaatggagttaatctgaagattatgagtcctattctgatagcctaattgagaaaaagtgccacaaacgtgtagtttcaatttacagatgcagagataagttatagactagtgataaacttggcaaaatttccaggtaagattatctttcactggatagaattatattttgacttcatgcttaatattttttaagagcatttgcttggccataacaatacaactaacagtga

SEQ ID NO: 92209 - DNA, 601 bp, Human
aatgaagctagtaatgccacctatcttcatagtttgttgtgtgtcttggacaagttggtatgcaaaacataaaatgtcaagcttgttaaatggagttaatctgaagattatgagtcctattctgatagcctaattgagaaaaagtgccacaaacgtgtagtttcaatttacagatgcagagataagttatagactagtgataaacttggcaaaatttccaggtaagattatctttcactggatagaattatattttgacttcatgcttaatattttttaagagcatttgcttggccataayaatacaactaacagtgatcgaaaacacaagaacatttattactaaataagtcttgaggcaggcaatcccagggttggctctctggctcagcagtgtcagtgttagattgccaggtctctgaagctcttctgtttttcctttcatggttgcaagacagctcctaaaagagcgtatcatcatagtaatatatagagtagagagagagcattcgagaaagggctttctccttgttcttcttactcattaaggaaagaccctagaagctctcaggccctttctattactggtcaaaataatata

SEQ ID NO: 92210 - DNA, 601 bp, Human
actaaataagtcttgaggcaggcaatcccagggttggctctctggctcagcagtgtcagtgttagattgccaggtctctgaagctcttctgtttttcctttcatggttgcaagacagctcctaaaagagcgtatcatcatagtaatatatagagtagagagagagcattcgagaaagggctttctccttgttcttcttactcattaaggaaagaccctagaagctctcaggccctttctattactggtcaaaataatataaagcaagtttcacacagatgcctgaccaaacaatggaaaargggaaagggcttataccaattatactggcatataccaattataattcatcatctggggtaaaacaaattgccactacccagaaatagggtctgtcaatgaggaagaagggaagattagttgttaggtaactaggcagtctgccacatacgatattcatttgtttaagtaacttacaaagtaacaaggtttaaaatagtgaacaaagcggacttaatccccggaattcttgagtttttttctttctctgtttaagagatgccatttttgttgggatattattatgcattttcttgtctcct

SEQ ID NO: 92211 - DNA, 601 bp, Human
tagtaatatatagagtagagagagagcattcgagaaagggctttctccttgttcttcttactcattaaggaaagaccctagaagctctcaggccctttctattactggtcaaaataatataaagcaagtttcacacagatgcctgaccaaacaatggaaaaggggaaagggcttataccaattatactggcatataccaattataattcatcatctggggtaaaacaaattgccactacccagaaatagggtctgtcaatgaggaagaagggaagattagttgttaggtaactaggcagtytgccacatacgatattcatttgtttaagtaacttacaaagtaacaaggtttaaaatagtgaacaaagcggacttaatccccggaattcttgagtttttttctttctctgtttaagagatgccatttttgttgggatattattatgcattttcttgtctcctgaatgcttataagtgttagagttcaaacgaggaccttctttggaccatcagtttttaaaaatacattccttagaagaaaaacattcacttaaaaatgttttatttttacaattatgtattagtatttctagtttcagag

SEQ ID NO: 92212 - DNA, 601 bp, Human
ccacctcccggattcaagcgatactcctgcctcagcctcctgaggagctaggattacaggtgcatgccacaattccgcccgccttggcctccctcccaaagtgctgggattacaggcatgagctactgtgcccggcctaatttttgaaacttttttttatgccccacgtactgtacttaactacttttcataaattgttttattaaatcctcatgaccctgtgagggttatgaggtataggtacctgtacaggtagggaaacgaagccttttgtgtctaaataacttctcaaggtctcacrgctactaagcggcaatcaaactaacacctcagggttgttagatgccaaagtgtgcacttttagcacgctttggtgtttgtgctgctggtcttcctaccactgtggaagtggttgctgggatcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatgtaagaaaaaggtagcagcactgcccaaatgaggttat

SEQ ID NO: 92213 - DNA, 601 bp, Human
attcaagcgatactcctgcctcagcctcctgaggagctaggattacaggtgcatgccacaattccgcccgccttggcctccctcccaaagtgctgggattacaggcatgagctactgtgcccggcctaatttttgaaacttttttttatgccccacgtactgtacttaactacttttcataaattgttttattaaatcctcatgaccctgtgagggttatgaggtataggtacctgtacaggtagggaaacgaagccttttgtgtctaaataacttctcaaggtctcacagctactaagcrgcaatcaaactaacacctcagggttgttagatgccaaagtgtgcacttttagcacgctttggtgtttgtgctgctggtcttcctaccactgtggaagtggttgctgggatcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatgtaagaaaaaggtagcagcactgcccaaatgaggttatacaagaagagg

SEQ ID NO: 92214 - DNA, 601 bp, Human
gagctactgtgcccggcctaatttttgaaacttttttttatgccccacgtactgtacttaactacttttcataaattgttttattaaatcctcatgaccctgtgagggttatgaggtataggtacctgtacaggtagggaaacgaagccttttgtgtctaaataacttctcaaggtctcacagctactaagcggcaatcaaactaacacctcagggttgttagatgccaaagtgtgcacttttagcacgctttggtgtttgtgctgctggtcttcctaccactgtggaagtggttgctggratcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatgtaagaaaaaggtagcagcactgcccaaatgaggttatacaagaagaggaagagataatccatgaatataccgagtggggtattgagctggtatctgaggtttcagaagaggaattgaaaaattcttcaggtccagttccagacttacctgaaggaa

SEQ ID NO: 92215 - DNA, 601 bp, Human
atgaccctgtgagggttatgaggtataggtacctgtacaggtagggaaacgaagccttttgtgtctaaataacttctcaaggtctcacagctactaagcggcaatcaaactaacacctcagggttgttagatgccaaagtgtgcacttttagcacgctttggtgtttgtgctgctggtcttcctaccactgtggaagtggttgctgggatcttagtacacagcatgttaaagtttctgttaaaatttggtactgttagttttaccttggatacaatgcaatgcaggatttttttcctgctrcgtccatgaagccaaatcctcagtgtgatgacagaaattgcagaaagaatgtaagaaaaaggtagcagcactgcccaaatgaggttatacaagaagaggaagagataatccatgaatataccgagtggggtattgagctggtatctgaggtttcagaagaggaattgaaaaattcttcaggtccagttccagacttacctgaaggaattacagtggcatacacaattccaaaaaagcaagaagattctgtcactgaggtaacagtggaagattctttaaagcttggaagacctcatggcc

SEQ ID NO: 92216 - DNA, 601 bp, Human
aagccttttgtgtctaaataacttctcaaggtctcacagctactaagcggcaatcaaactaacacctcagggttgttagatgccaaagtgtgcacttttagcacgctttggtgtttgtgctgctggtcttcctaccactgtggaagtggttgctgggatcttagtacacagcatgttaaagtttctgttaaaatttggtactgttagttttaccttggatacaatgcaatgcaggatttttttcctgctgcgtccatgaagccaaatcctcagtgtgatgacagaaattgcagaaagaatrtaagaaaaaggtagcagcactgcccaaatgaggttatacaagaagaggaagagataatccatgaatataccgagtggggtattgagctggtatctgaggtttcagaagaggaattgaaaaattcttcaggtccagttccagacttacctgaaggaattacagtggcatacacaattccaaaaaagcaagaagattctgtcactgaggtaacagtggaagattctttaaagcttggaagacctcatggccaagattaagaatatgtacataatggactggcatatattttatttctcatgt

SEQ ID NO: 92217 - DNA, 601 bp, Human
agaagaggaagagataatccatgaatataccgagtggggtattgagctggtatctgaggtttcagaagaggaattgaaaaattcttcaggtccagttccagacttacctgaaggaattacagtggcatacacaattccaaaaaagcaagaagattctgtcactgaggtaacagtggaagattctttaaagcttggaagacctcatggccaagattaagaatatgtacataatggactggcatatattttatttctcatgttaaagcctcttaccttgaaattaaaaaatttttaaaactgrtaaaacttagggcaacattaattaatgtatactcttaactgaattgttatactttttgaaaatcccgtgacttgcttgtttctctccactccaactaaatcattaactctcctaaaatgtatgtttcattctagtaagaaaacctcaaaggatattgtaggatataaatcttatttgaaaatatagccattgaaatgttttggccttttggagttggggaatgacaaatctgatcctggaatctttttcttttcagtaatcccttgtgtctgttgcctgagggacatggacaataaagca

SEQ ID NO: 92218 - DNA, 601 bp, Human
atactggtgcttaaaggtgaataatactgtttttaaccttcatgtgtctgtgattgtaaaaagtctcaaatataccacctgtaactttgttctttgtatattttaactcattaatgtatagtcacagtattacagaatttagacacagagcctggcataattgataacagttttaacatggctttattaactactcttttctcattcttccctattctcttctagtctcccttttgcatggattattctcttttcctgccctactgttggttccagattcttatgttattccattgcagayaagggagaagaagaatggtagaatggaaacccactggagaaattcgagacgaaagagaagaaggaaaataatgggtgaagggaaggttaaaatttcttgctccagcactctctgttctcttccaggccttatcttactccttcagactctgtcttcatttctcatcttttcttctcacttatgcctctgcctttccactctctctttctattggacactttctttctgacaccatggtagctatcactagtggcttgcaatctatgttcctaccacctggccagtagttgtagggaggaa

SEQ ID NO: 92219 - DNA, 601 bp, Human
tgttgttggatcttgggctacacagagtagggagaaagatgtaccttgcaaggtataccaggcattttgtattggaactttgagttctttttcttctagaattattcatttatctgttcattaaacagtaaacaatgaaccccaggcagtgttttaggaactcacatagaaacatactttgttcttttcagtttcagagatcttttttatttaacttagaattatttcacttttgaatctcttaatttcagcatctgtatttatttcaaaccttttgggaataaagaggcaacttgttatrttggaaaggcttttggagcctgatagatctgagttttaatcctgtctttgccacttactaggtatttaatattcaggaatttatattatctttctaaaccttttttttttttttctgtaaaatgggaagttcttagtatggtacttggcttagatggctcccaataaaataatgcctgctaagattattattatcacacagaaagtttgtccttagtaccaaatcaattttttttgtttttgtttttgttttgccaagaagtacttttaaaactagagtacattaagacaatgattaaag

SEQ ID NO: 92220 - DNA, 601 bp, Human
agtagaaatcaaaactgcttttaagtatagaagactggtgttacaattatttggggggatagtcaggctcccattttcagttcttttttttttttttttttcccggacagggtttcaccctgttgcccaggctggagtgtagtggcgccctctaagcttactgcagccttcatctcctgggctaaagtggccctcccacttcagtctcctgagtagctgggactgcaggcacaagccaccgtgtccggccgatttttatatttgtatttttgtagagacagagttttgccacgttgcccaygctggtcttgaactcttagactcaagcaatccgtctgctttggcctcccaaagtattgggatacaggcgtgaaccaccacacccggccccatttttagttctagtaggtctgtatgtatctcccaccttgtcaaacttgtgtgtaattttttttaaaaaaggtttcacccaccttgtcaaacttgcgtgtgatttttaaaaaagttttcttccttttttttttgagacagagtctcactcaatcgcccaggctggagtgcagtggcataatcttggctcactgcaacctccgcctcctgg

SEQ ID NO: 92221 - DNA, 601 bp, Human
taaaactttttcattatccaaagagaaattctgtaaccattaagccataagttttcattctcctgtcccccagcccttagtaacctttaatctactttctgtctctatgaatttgcctattctagatatttcatttaagtgacataatatatttgccttttaatgcctgtcttactttacttagcatgttttcaagatttatccacattatagcacgtatcagaccttaacttcattttaaagctgcttaacatactggtgtgtgtgtgtgtgtgtgtgtgtgtgtgtgtgtgtgtgtgtstgtctgtatatatatatcacattttgtttatctgttcatctcttgatggacatttggataatttccaccttttggctactgcgaataatgctgtcatgaacatcattgtacagatatctgtttgaatctcttcttttgattctcttgggtacataggaatggaattgctgggatatgttggtaaatctatgtttagctttttgaggaactacccaactgttttacaaagcagcagtaacattttatatcccctctagcaatgaatgagggttccagtttctccacatcctcttcatcact

SEQ ID NO: 92222 - DNA, 601 bp, Human
atcttttcatatgtgttttggccatttttatatatcttcatatatatattattttacttttaagttctgggatacatgtgcagaacatgcaggtttgttacataggtatacatgtgccatggtggtttgctacacctatcaacctgtcatctgtgttttaagccccgcgtgcattagttatttatctaatgctttccctcctcttggcccccaccccaacaggccccagtgtgtgatgtgcccctccctgtgtccatgtatgttctcattgttcatctcccacttatgagtgagaacatgkggtatttggttttctgttcctgtgttagtttgttgagaatgatggtttccagcttcatccatgtccctgcaaaggacatgaactcattcttttttcatttttatttatcttctttggagaaatgtttattaaaacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatt

SEQ ID NO: 92223 - DNA, 601 bp, Human
gttagtttgttgagaatgatggtttccagcttcatccatgtccctgcaaaggacatgaactcattcttttttcatttttatttatcttctttggagaaatgtttattaaaacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatttctgtaatgccattgtaattttgrtagggattgctttgaatctgtggattgctttgggtaacattgtcatattaacaatattaagtcttcttccaatctagaatactggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtgg

SEQ ID NO: 92224 - DNA, 601 bp, Human
atgaactcattcttttttcatttttatttatcttctttggagaaatgtttattaaaacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatttctgtaatgccattgtaattttgatagggattgctttgaatctgtggattgctttgggtaacattgtcatattaacartattaagtcttcttccaatctagaatactggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgc

SEQ ID NO: 92225 - DNA, 601 bp, Human
aacttttgcccatttttgaattggggttttttgttgttgacttgtaggagttctttgtatattctggtattaattccttagtagatacatgatttgcaaatacttttcccattctatgggttgtcttttctctctctccatatgaattttaggatgagtttttctatttctgtaatgccattgtaattttgatagggattgctttgaatctgtggattgctttgggtaacattgtcatattaacaatattaagtcttcttccaatctagaatactggatgtcttttcatttatttaagtcktctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgccttagcctcctgtgtagctaaggactacaggcatatgccaccacgttcagctaat

SEQ ID NO: 92226 - DNA, 601 bp, Human
tccaatctagaatactggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgccttagcctcctgtstagctaaggactacaggcatatgccaccacgttcagctaatttttttctctttctcttctctgttgtgtcaattccagatagaaatcctctctctctttcctttccttacaaaacacaaatacagaaatccctagtggacttgactaagcagtgtggaatacccgttttcgaagctagttagagctaaatgcatacttttagatcagagcaaactgtatgacctatctgtttcactcccctaatgctcaaatatgtatctttgatcttatcacactctggctccatggaaggaagagaga

SEQ ID NO: 92227 - DNA, 601 bp, Human
actggatgtcttttcatttatttaagtcttctttaatttttatcagcaatattctgtagtttccaatgtacaagtctttcacctcattggttaaatttatctttaagtactttattcttttggatgctgttgcaaatggaattttattattattaattcttttattactgctttttaagagacaggatcttgctgttttgcccaggcaggagtgcagtggtatgatcatgactcattgcagcctcgaatacctgggctcaagttatcctcctgccttagcctcctgtgtagctaaggactrcaggcatatgccaccacgttcagctaatttttttctctttctcttctctgttgtgtcaattccagatagaaatcctctctctctttcctttccttacaaaacacaaatacagaaatccctagtggacttgactaagcagtgtggaatacccgttttcgaagctagttagagctaaatgcatacttttagatcagagcaaactgtatgacctatctgtttcactcccctaatgctcaaatatgtatctttgatcttatcacactctggctccatggaaggaagagagaagacagctacacc

SEQ ID NO: 92228 - DNA, 601 bp, Human
tttttgtgttagaataaagagggacctgaggagaggaaaggagacacgtttaaacttctcttagaggcagcagaatatgtaattgctctaatcattaaacatttttaatttaccagttaaaattattaataagattacatctaaattcctttaatgaaattcaaagccttttccattttctagctcttatttctttgcatttcttctcacaattctttaccatggattatttaccattaacaccccaaattcacttcctcgcctctcttcatttgcttatattgttccctcttgcctggartatctacattgtcaaacccaggcaaagcagcaagattctatttagtcctcaaggttcaatttatctgttatctcctttgtgtgaagcattagtatccacataattagtgttctattctcactaattctgaagcacttaaaactttatcacattattaaattttgtgtctgcatatatgcatacttgtctttcttgaatgaagactaagagtttcttgaaggaaagtatcatatcataatcaaatttttaaaaactccagtcattgccaccatgctttgtatactgtagacgtttgctaac

SEQ ID NO: 92229 - DNA, 601 bp, Human
gtatctacattgtcaaacccaggcaaagcagcaagattctatttagtcctcaaggttcaatttatctgttatctcctttgtgtgaagcattagtatccacataattagtgttctattctcactaattctgaagcacttaaaactttatcacattattaaattttgtgtctgcatatatgcatacttgtctttcttgaatgaagactaagagtttcttgaaggaaagtatcatatcataatcaaatttttaaaaactccagtcattgccaccatgctttgtatactgtagacgtttgctaaygcattttaaaggaacaaatgaatgagtgtgaaagaaacatgagtttacttggtgggaattgctgaagagctctctggtgccatgaaatctgcttttattttttatatctttgtgttaaaatatatatttaatgctgatagaatgttaaaactggtctcatttttacatcccccttgctttgcattcttttatatgttatttggagtttaaacatacatttctcaccaaaaatgtaattcatatgtaagaaataaaagaaaatatattgttttcttagggaaattaaatctgtttattctc

SEQ ID NO: 92230 - DNA, 601 bp, Human
gcagcaagattctatttagtcctcaaggttcaatttatctgttatctcctttgtgtgaagcattagtatccacataattagtgttctattctcactaattctgaagcacttaaaactttatcacattattaaattttgtgtctgcatatatgcatacttgtctttcttgaatgaagactaagagtttcttgaaggaaagtatcatatcataatcaaatttttaaaaactccagtcattgccaccatgctttgtatactgtagacgtttgctaacgcattttaaaggaacaaatgaatgagygtgaaagaaacatgagtttacttggtgggaattgctgaagagctctctggtgccatgaaatctgcttttattttttatatctttgtgttaaaatatatatttaatgctgatagaatgttaaaactggtctcatttttacatcccccttgctttgcattcttttatatgttatttggagtttaaacatacatttctcaccaaaaatgtaattcatatgtaagaaataaaagaaaatatattgttttcttagggaaattaaatctgtttattctcatatagtttgggatttttaaatatttt

SEQ ID NO: 92231 - DNA, 601 bp, Human
tgattgatataatagctcagaaaataaagtgttgaatgaaatatttctactgggaattttttctaagatcatgttttcacatgtacttcatatgtcaatgtaaatatgagtgtgtttctagactcttcttttgttctgttggtctgtcttattctagtttataaggaatcttgatacctggtagtgtatatactctgacttcctttttctccccctctcccatctctcctcccctgatattttcatagtattttattttatgtatgaatgtatgtatgtatgtatgtatgtatgtatgtagttatttatttatttatttttgagatggagtttccctctgttgcccaggctggagcgcagtggcatgatcttggctcactacaacctccacctcccggattcaagtgattctcctgcttcagcctcccgagtagctgggattacaggcgtccgccatcaggcccagctaatttttgtatttttagtcaagttgggtttttgccgtgttggtcaggcgggtctcaaattcctgacctcaagtgatctgcccaccttgtcctcctaaaggatattttcatagtattttagaatcagtttttca

SEQ ID NO: 92232 - DNA, 601 bp, Human
attgatataatagctcagaaaataaagtgttgaatgaaatatttctactgggaattttttctaagatcatgttttcacatgtacttcatatgtcaatgtaaatatgagtgtgtttctagactcttcttttgttctgttggtctgtcttattctagtttataaggaatcttgatacctggtagtgtatatactctgacttcctttttctccccctctcccatctctcctcccctgatattttcatagtattttattttatgtatgaatgtatgtatgtatgtatgtatgtatgtatgtattgatttatttatttatttttgagatggagtttccctctgttgcccaggctggagcgcagtggcatgatcttggctcactacaacctccacctcccggattcaagtgattctcctgcttcagcctcccgagtagctgggattacaggcgtccgccatcaggcccagctaatttttgtatttttagtcaagttgggtttttgccgtgttggtcaggcgggtctcaaattcctgacctcaagtgatctgcccaccttgtcctcctaaaggatattttcatagtattttagaatcagtttttcaat

SEQ ID NO: 92233 - DNA, 601 bp, Human
tatatgtaccaacggacttcatgtgctttttgtgtgttgataggatctttgcacctgtgttcttcagataaattggcctgtaattttcctacttcgaatgttctgatcagattttggtatcttggttatactggtcttacaagaagagggaaatgttccctcctttagtattctccagaagagttagtgaagattgttattatttttttcctgatatgcttacaagatttaactggtgaagcctctgagaccagaggttgctagtgaaaaagttttaaataatgtttaatttctttaatgkaaataaaatgacttgttctgtgtatgtattagttttgctaggtttatccatttcatctaatttttaaaacttgttactgtattgatcatttctctctctttttatttttcttgctaggggtttatcagtttattatcttttccatgaattaacttttggccttttgaattttgttattgtagatttgttttctggttctttaatttctgcactttataatattttctttggttttatcttgctattctttttctgatttttcaaaatagcattgatatctagcccttcttttcaaacctg

SEQ ID NO: 92234 - DNA, 601 bp, Human
ttacaagatttaactggtgaagcctctgagaccagaggttgctagtgaaaaagttttaaataatgtttaatttctttaatggaaataaaatgacttgttctgtgtatgtattagttttgctaggtttatccatttcatctaatttttaaaacttgttactgtattgatcatttctctctctttttatttttcttgctaggggtttatcagtttattatcttttccatgaattaacttttggccttttgaattttgttattgtagatttgttttctggttctttaatttctgcactttatartattttctttggttttatcttgctattctttttctgatttttcaaaatagcattgatatctagcccttcttttcaaacctgtgtttaaggctatatgttttcctctaagcatttttagctatagcagacatattttggtatgtcatatatatgtatatattttttgcttaaaatacagtgtgattttaaatttttgtttttgatctatgaatttaaagttcattaaaaaaatttctaaacatttagaaaattttctagtttttcttattgagttataatgtaatttaaaagtggttagaa

SEQ ID NO: 92235 - DNA, 601 bp, Human
tttttgtgtcctcttcagtttctttcatcagtgtttcatcagtatattgatgtatgtgtgtgtgtgtgcatacctcacatgtatgtttatatacttcaattaaaaaatacacatagataacttgatgaatttttacatttttttgtaggggacaaataaataatagcattttattcttatgccatttgaccatagcatttgtgttctgtagttttcactgtagacatcttttacttctttggctgatttaaatcctaggtatttaattttatttgtggctattgtaaatgggattactttyttcatttctttttcagattgttcactgttggcatagagaaatgctactgatttttgtatgttgattttgtatcctgcaactttactgaatttgttcatcagtttgaataagtttttttgtgtgtgtgtgtggagtctttaggttttccaaaatataagaccatatcatcttcaaacaaggataatttgacttttttctttccaatttggacacctttcattctttctcttgtttaattgctctagctaatacttaaagaactatgctgtacttgaatattgatatctttctctagatttg

SEQ ID NO: 92236 - DNA, 601 bp, Human
tcttatacatgcttcattctttttcattcttttgtcacctctgtgtattttcaaatagaccattttcaagctcactaattcttgcttctgcttgatcagttctgctattaagagactctgatacattctttaacatgtcagttgagtttttcaactctagaatttctgcttgatttttaaaaattattgtttgtttatttatttattttgagatggagtcacactctgtcacccaggttggagtgcagtggtgtgatctcggctcactgcagcctccatctcacaggttcaagcgattctyctgcttcagcctcctgagtagctgggactacaggtgcataccacgcctggctaatttttgtatttttaatagagatggggttttacagtgttggccaggctggtctcgaactcctgacgtcaggtgatccgcctgccttggcctcccaaagttttgggattacaggcatgagccactacgcctggccccgtttttaattattttaatctgtgaaatttatcttatagaatcccaaattccttctctgtgttatcttgaatttctttgagtttcctcaaagtagctattgttttttaagat

SEQ ID NO: 92237 - DNA, 601 bp, Human
attctttaacatgtcagttgagtttttcaactctagaatttctgcttgatttttaaaaattattgtttgtttatttatttattttgagatggagtcacactctgtcacccaggttggagtgcagtggtgtgatctcggctcactgcagcctccatctcacaggttcaagcgattctcctgcttcagcctcctgagtagctgggactacaggtgcataccacgcctggctaatttttgtatttttaatagagatggggttttacagtgttggccaggctggtctcgaactcctgacgtcagrtgatccgcctgccttggcctcccaaagttttgggattacaggcatgagccactacgcctggccccgtttttaattattttaatctgtgaaatttatcttatagaatcccaaattccttctctgtgttatcttgaatttctttgagtttcctcaaagtagctattgttttttaagatggactgtcactctgtcacccaggctagagtgcagtggcacgatctcagctcactgcaacctccgcctcctaagttcaagccattctcttgcctcaaccttctgagtagctgggattacaggcgt

SEQ ID NO: 92238 - DNA, 601 bp, Human
actctagaatttctgcttgatttttaaaaattattgtttgtttatttatttattttgagatggagtcacactctgtcacccaggttggagtgcagtggtgtgatctcggctcactgcagcctccatctcacaggttcaagcgattctcctgcttcagcctcctgagtagctgggactacaggtgcataccacgcctggctaatttttgtatttttaatagagatggggttttacagtgttggccaggctggtctcgaactcctgacgtcaggtgatccgcctgccttggcctcccaaagtkttgggattacaggcatgagccactacgcctggccccgtttttaattattttaatctgtgaaatttatcttatagaatcccaaattccttctctgtgttatcttgaatttctttgagtttcctcaaagtagctattgttttttaagatggactgtcactctgtcacccaggctagagtgcagtggcacgatctcagctcactgcaacctccgcctcctaagttcaagccattctcttgcctcaaccttctgagtagctgggattacaggcgtgcaccatcatgcctggctaatttttgtat

SEQ ID NO: 92239 - DNA, 601 bp, Human
taccacgcctggctaatttttgtatttttaatagagatggggttttacagtgttggccaggctggtctcgaactcctgacgtcaggtgatccgcctgccttggcctcccaaagttttgggattacaggcatgagccactacgcctggccccgtttttaattattttaatctgtgaaatttatcttatagaatcccaaattccttctctgtgttatcttgaatttctttgagtttcctcaaagtagctattgttttttaagatggactgtcactctgtcacccaggctagagtgcagtggcrcgatctcagctcactgcaacctccgcctcctaagttcaagccattctcttgcctcaaccttctgagtagctgggattacaggcgtgcaccatcatgcctggctaatttttgtatttttttaaaaatagagatagggtttcaccatgttggccaggctggtctttgacctcaagtgatctgcctgcttggcctcccaaagtgctgggattacaggcatgagccactgcacctggccaaaatagcttttttttgagacaaagtctcgctctgttgcccaggctagagtgcagtgacacgatc

SEQ ID NO: 92240 - DNA, 601 bp, Human
gtttttgcagtcttatataggtattgtcttggtggtcttggataagatccaaaagttttctctggattaccaggcaaaaactcttattcttttactttactttcttccaaacatattgggtctttctttctgtatcgagccacctggaactctggggatttggtgatacaagcacccctgtggccaccatcactgggactgtgctgggtcagacctgaagccagcacagcactgggccttgcccaaggcccttcccttcagggtggtgagtttccccaggccccgggtgtgtccagagatsctgtctggtagcctgcgattctagttaaaaaccttagcaatctacctgatgttttatttttactacgtctgtgctggcattcaaaccacaatacaaaaagttcttcccgctcttctctcccctttccacatgcagaggaggagcgtctctctgtggccagcaccatgactgttccatgagcagttctgccaggccacaccaccagtgttcacttaaagcccaagagctctttcatcagcttgtggtgagtgctgccaggcctcggactcacccttcaggcagtgggcccccctctggccc

SEQ ID NO: 92241 - DNA, 601 bp, Human
ttttttggtgagtgagtggccgtattgtgttatttcatttcgcatttcttgatagcgcctacatttgaacacattttcatatcacctcacatcacttagatatcctttccatgaagtacacattttggggttgggtaagtaggagttgcatgggtgagttgtctgacttatcgtcatattctagattcaaatctgttgttggagatgtgcacacgtgtgtgtgtgtgtgtgtgtgtgtgtgtgtgtgtgacaaatcttttccgtggcttggcatttccctctctccaaagatcttgtattraacagaaattcttaatgttaatggagtgcaattaattaaacttttacttataattagtgatttttgtgtttttaagaagtttttttctaacctcaaggtcatgaacatattttccaataattaaaataaattctttctttgatctttcaagacaaacctttcacatttagatgtctcatctctctggtattgactgttttgtgttttctgaggtataggtcaaagttcactttattctttgtggtttctgattattgtttgttttaaagactacctttttcacatttaattgcaaagaaa

SEQ ID NO: 92242 - DNA, 601 bp, Human
aaattcttaatgttaatggagtgcaattaattaaacttttacttataattagtgatttttgtgtttttaagaagtttttttctaacctcaaggtcatgaacatattttccaataattaaaataaattctttctttgatctttcaagacaaacctttcacatttagatgtctcatctctctggtattgactgttttgtgttttctgaggtataggtcaaagttcactttattctttgtggtttctgattattgtttgttttaaagactacctttttcacatttaattgcaaagaaactttttagttgggcccctatgtgtgccacttattaattttttaaaaacagttttcaatgtagaagtcttttttaaaaacagttcttaaggtcaggggtacacttgcaggtttgttaaataagtaaacttgtgtcatgggcatttgttgtacagattatttcatcgccctattaagctcagtacccatcagttattttttcctgatcctctccctcctcccaccctctgtcctctgacaggtcccagtgtgtgttgttcccttctatgtgtccatgtgtactcatcatttagctcccacttacaagt

SEQ ID NO: 92243 - DNA, 601 bp, Human
tattgactgttttgtgttttctgaggtataggtcaaagttcactttattctttgtggtttctgattattgtttgttttaaagactacctttttcacatttaattgcaaagaaacttttaagttgggcccctatgtgtgccacttattaattttttaaaaacagttttcaatgtagaagtcttttttaaaaacagttcttaaggtcaggggtacacttgcaggtttgttaaataagtaaacttgtgtcatgggcatttgttgtacagattatttcatcgccctattaagctcagtacccatyagttattttttcctgatcctctccctcctcccaccctctgtcctctgacaggtcccagtgtgtgttgttcccttctatgtgtccatgtgtactcatcatttagctcccacttacaagtgagaacatggggtatttggttttctgttcctgtgttagtttgcagagcataatggcctccggctccatccatgtccctgcaaaggacatgatctcattttttttctgtggctgcatagcattccatggtgtatatgtaccacatttaaaaatctagtctaccattctgggcatttaggttga

SEQ ID NO: 92244 - DNA, 601 bp, Human
agtcttttttaaaaacagttcttaaggtcaggggtacacttgcaggtttgttaaataagtaaacttgtgtcatgggcatttgttgtacagattatttcatcgccctattaagctcagtacccatcagttattttttcctgatcctctccctcctcccaccctctgtcctctgacaggtcccagtgtgtgttgttcccttctatgtgtccatgtgtactcatcatttagctcccacttacaagtgagaacatggggtatttggttttctgttcctgtgttagtttgcagagcataatggccyccggctccatccatgtccctgcaaaggacatgatctcattttttttctgtggctgcatagcattccatggtgtatatgtaccacatttaaaaatctagtctaccattctgggcatttaggttgattccatgtctttgctattgtgaatagtgctgcagtgaatgtatgtgtgcttgtgtctttataagagaacaatttatattcctttgggtatatacccaagtaatgggattgttgggtcaaatggtgtttctgtttttgttctttgaggaatatttttcaatgtagatgtcttgttca

SEQ ID NO: 92245 - DNA, 601 bp, Human
gagttttaactgtagattaattttgactgtttgaaaatttcatataaatggaattatacagtatgtactcttttgtgtccacctttcactcaggataatgtccaagactcatccttgcaattgcatgtattaatcgtttttattactgagcagtataccattttatcaatgttccacagtttattcattttcctattgatgaacatttgtttccaattttttggctattagaaataaagctgatatgaatattctcctacaggtttttatggaaatatgtttttgttttctttgggtaaawaaccagaagtggaactgctatgctaggcagtagttgcatgtttaaatttaaaagaaactggcatactacttccagttggattgtaccatttttatattcctacttatgccctgttcttgcctaatattttttgttgttaatattaattttagccattctagtgggtatgtagtggtattctgtggtcttaattttcattgttgtttgcatttgtgttatatatcagcataatcatggggtttttgtgtgcctattaaccatttttatatcttcctttgtgaggtatatgttcaaattttt

SEQ ID NO: 92246 - DNA, 601 bp, Human
ttactgagcagtataccattttatcaatgttccacagtttattcattttcctattgatgaacatttgtttccaattttttggctattagaaataaagctgatatgaatattctcctacaggtttttatggaaatatgtttttgttttctttgggtaaataaccagaagtggaactgctatgctaggcagtagttgcatgtttaaatttaaaagaaactggcatactacttccagttggattgtaccatttttatattcctacttatgccctgttcttgcctaatattttttgttgttaatmttaattttagccattctagtgggtatgtagtggtattctgtggtcttaattttcattgttgtttgcatttgtgttatatatcagcataatcatggggtttttgtgtgcctattaaccatttttatatcttcctttgtgaggtatatgttcaaattttttgctcagtctttagaaattgaaatgtttgtatttttattgttgagctgtaggagttctttgtcagatgttttagcaatattttctcagactgtgtggtttgttcattttttaaaaaaattatcgtttagagcagaagttttc

SEQ ID NO: 92247 - DNA, 601 bp, Human
atattttttgttgttaatattaattttagccattctagtgggtatgtagtggtattctgtggtcttaattttcattgttgtttgcatttgtgttatatatcagcataatcatggggtttttgtgtgcctattaaccatttttatatcttcctttgtgaggtatatgttcaaattttttgctcagtctttagaaattgaaatgtttgtatttttattgttgagctgtaggagttctttgtcagatgttttagcaatattttctcagactgtgtggtttgttcattttttaaaaaaattatcrtttagagcagaagttttcaattttgaaggtataattttatcaattgttttctattacagttagtattttctgtgttctaagaaatccttgtttatactcagatcacaaagatatctatgttttttttttctaaaagccttctatttttagctactatatttagattggtgatccatctcaaattcatgtctgatgtgatatcggcattgagattcatttttttttttgtatttgtagccagttgtttcagcaccatttgttgaaaaggctgttttccctttattaagtcattttagcacc

SEQ ID NO: 92248 - DNA, 601 bp, Human
ttgagctgtaggagttctttgtcagatgttttagcaatattttctcagactgtgtggtttgttcattttttaaaaaaattatcgtttagagcagaagttttcaattttgaaggtataattttatcaattgttttctattacagttagtattttctgtgttctaagaaatccttgtttatactcagatcacaaagatatctatgttttttttttctaaaagccttctatttttagctactatatttagattggtgatccatctcaaattcatgtctgatgtgatatcggcattgagattcatttttttttttgtatttgtagccagttgtttcagcaccatttgttgaaaaggctgttttccctttattaagtcattttagcaccttagtaaaaagaccatgtgctctattgctgtcctctctattctctttatctcattgtctgcctttatgctaataccacagtcttgattcctatagctttatactaatgttgagattgtgtaatgaactctgagtgtatggagtcctactttgttctttttcaagattgttttaattattcgaagacttttgcattttagaatcaatatatcaatttt

SEQ ID NO: 92249 - DNA, 601 bp, Human
agcagtcctgctgtctgataataggattttcagaatagggacgcatcctttttactttgtagactttctatttctttgtcttgacttactgcactagctcggacctctaatacagtgttgaaatggtgtcacaagggtggacatccttaccttattcctgaactgagggaggaagaattcagtgttttactgttaagtatggtgaaattattgttaggcaatattttggtaggtgccttttatctgattgaagatattgtcttctgttactataatagtttgctgagcatttaaaaaatawagttattgataggtgctgaattctgtcatatgctttttctgtatctattgaaatcattatatggattttttctttcagttagttgacatagtggattactttgattaattttttaatagactttatattttagagcagttttaagttcacagcaaaattgagcagaaaatacagagttcccgtatacctcctgttcccacacttacccaatcttcatctcccaaaacactgaaccagaatggtacatttgttacaatccaggaaactacattgacatattattattacccaaagtctgta

SEQ ID NO: 92250 - DNA, 601 bp, Human
catattattattacccaaagtctgtagtttaccttagggttcactcctgatgttgtacgttcagtgggttttgacaaatgtatgttatgtatctgccattgtagtatcaaacagagtagtttccactgccctagaaatcttctgtgctctgtctgtttattcatttctccctcaccactgacccctggccaccactggtctttttttataatctccatacttttgccttttccagaatagttagaatgatacagtatgtagcctgttcagattggcttttctcagtaatatgaatttatgrttcctctacatctttaaatggcttgatagctcttttctttttagtgctgaataatattacattgtctagatacactgtgtgcattgaacattccatgtacacttgaaaagaatgttttttctacatttattgtttgttgtgttttatacatcagttagctctagacggttgatgcagtcattaagctcttccataatttcctaatttttgtttagttctgtcagtgctgagaagagggttttaaagttttcaaatataattgtgggtatgtctgtatttccctgtagtttcctctctttt

SEQ ID NO: 92251 - DNA, 601 bp, Human
cactgacccctggccaccactggtctttttttataatctccatacttttgccttttccagaatagttagaatgatacagtatgtagcctgttcagattggcttttctcagtaatatgaatttatggttcctctacatctttaaatggcttgatagctcttttctttttagtgctgaataatattacattgtctagatacactgtgtgcattgaacattccatgtacacttgaaaagaatgttttttctacatttattgtttgttgtgttttatacatcagttagctctagacggttgatgsagtcattaagctcttccataatttcctaatttttgtttagttctgtcagtgctgagaagagggttttaaagttttcaaatataattgtgggtatgtctgtatttccctgtagtttcctctctttttattttatgcattttgaaacttaattggtgcatacatgttccaattgttcatctttcttatacactgagcctttaatcatgcaatgtttcccttcaaggtagtactcgttgtcatagtctgatttgcctcagtatagccagctttcttatgatattaacctttttcatatagtta

SEQ ID NO: 92252 - DNA, 601 bp, Human
catatagttaggttttatattttttacatattctgataatctgtattttaagtggactgtttagactgtgggtcaacaaactttttctgtaaagtgacagtaaatattttagatttcacagttcatatgttctctgtggcaactactcttctctgtcattgtggtgtgaaaactagccatagacagtttgcaaatgaatgatggatgtggttgtattcaaataaaattttatttttaaaaacaggtaatggaccagatttgaccttcaggccatggtttgctgaaacctggtttagatgtygtgtttgtttgtttgtttgtttttttaatgagacagggtctcgccagtgtagtggtgccatcatagctcactgtagcctcaaactcctgggctcaagctatcttcccactcagcctcataagtagctgggactacaggtgtgccccaccatgtccggctaattaaaaattaaaaaaaaaaatagagatgggggtctcactttgttgcccaggctggtcttgaactcctggcctcaagtgatcctcctgcctatgcctcccaaagtgttgggattacagacatgagccactgtattccgct

SEQ ID NO: 92253 - DNA, 601 bp, Human
aagtggactgtttagactgtgggtcaacaaactttttctgtaaagtgacagtaaatattttagatttcacagttcatatgttctctgtggcaactactcttctctgtcattgtggtgtgaaaactagccatagacagtttgcaaatgaatgatggatgtggttgtattcaaataaaattttatttttaaaaacaggtaatggaccagatttgaccttcaggccatggtttgctgaaacctggtttagatgttgtgtttgtttgtttgtttgtttttttaatgagacagggtctcgccagtktagtggtgccatcatagctcactgtagcctcaaactcctgggctcaagctatcttcccactcagcctcataagtagctgggactacaggtgtgccccaccatgtccggctaattaaaaattaaaaaaaaaaatagagatgggggtctcactttgttgcccaggctggtcttgaactcctggcctcaagtgatcctcctgcctatgcctcccaaagtgttgggattacagacatgagccactgtattccgctagaaataaaacttttttttttttttttttttttgagacagagttttgct

SEQ ID NO: 92254 - DNA, 601 bp, Human
gtcagccagtagggggtggcagtcttcattctcccagaccaggctgcagatggtgtaggttctcctcatttctttggtgtcatgttggacccttcagactttgattgctggaaatcagcatacacagagaaggctccatctgctggaccattcttgtaaatatcagccatgatctctacacttgaaggtttactgtaaaacagaggtgtccaatcttttggcttccttgggccacattggaaaaagaattgtcttgggccacagataaaatacactaacactaacgatagctaatgagctaaaaaaaaaaaaaaatcacaaaatctcatactgttttaagaaagtttacgtatttgtgttgggtcatattcaaagccgttctgggccacatgcggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacgtggtggatagaatagggtcttcaggctacgtgggagtcataga

SEQ ID NO: 92255 - DNA, 601 bp, Human
gccacagataaaatacactaacactaacgatagctaatgagctaaaaaaaaaaaaaaatcacaaaatctcatactgttttaagaaagtttacgtatttgtgttgggtcatattcaaagccgttctgggccacatgcggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacrtggtggatagaatagggtcttcaggctacgtgggagtcatagaggctacctgagagagaacaggcttttcttggttcagaaattctaggtttgagaaggaaagcctacatacagccatctccacactgcacaataggtgagcagttttcagcagacatctccacattggtgttcttattggtctaaatgtacacctggtcagaaatggttttcatggccccagatgttcaggaagagctacatgaactctgttgatgatgtctttttaattgttagacattttggccactgttcctggat

SEQ ID NO: 92256 - DNA, 601 bp, Human
gtcttgggaggaaaatcacatgattatttcaataaaggaaaaacataactttgataggtatatgttacaagaactcagaaaataggaataaaggggaatatccttaacttgataaaggatttatgccaataacctaaagcaaaccttttatggagaaactttagatgcattctgtctaagatcaggaacaggacaaagatggttaacactattacagctttatatgttactggaggtcctagatagtccattaagaaaagaaatagaggccgggcgtggtggctcatgcctgtaatcctakcactttgggaggccaaggtgggcggatcacaaggtcaggagattgagaccatcctggccaacgtggtgaaattctgtaacatctctactaaaataaaaataaaaataaaaaaatagcggttctaagatggccgaataggaacagctccagtctgcagctcccagcgtgagtgacgcagaagacaggtgatttctgcatttccaactgagcacatggcacaccaggacatcatatcccgcacctggctcggagggtcccacgcccatggagcctcgctcactgctagcacagcagtctgag

SEQ ID NO: 92257 - DNA, 601 bp, Human
atgattatttcaataaaggaaaaacataactttgataggtatatgttacaagaactcagaaaataggaataaaggggaatatccttaacttgataaaggatttatgccaataacctaaagcaaaccttttatggagaaactttagatgcattctgtctaagatcaggaacaggacaaagatggttaacactattacagctttatatgttactggaggtcctagatagtccattaagaaaagaaatagaggccgggcgtggtggctcatgcctgtaatcctagcactttgggaggccaaggkgggcggatcacaaggtcaggagattgagaccatcctggccaacgtggtgaaattctgtaacatctctactaaaataaaaataaaaataaaaaaatagcggttctaagatggccgaataggaacagctccagtctgcagctcccagcgtgagtgacgcagaagacaggtgatttctgcatttccaactgagcacatggcacaccaggacatcatatcccgcacctggctcggagggtcccacgcccatggagcctcgctcactgctagcacagcagtctgagatcgaactgcaaggtggca

SEQ ID NO: 92258 - DNA, 601 bp, Human
atgtatagatgcaatagataaaaattttgttaataagataattgagtattttcagttaagggatcatcttacaaaaatcagtagaattcctctgtattcaaaataattaactagaagagatgatgatacaagatgtcattcacaatagcaaaaacaatcatgtctctaggatctgggaattaacctaacaatgcataagatctacatggaataaattttaaactctgttacagtattattcaaaagacttgaaaaccagatacaccctattcaaagatagtacaacatatttgtaacgatrtcagttctccctaatctataaattctatgaaatgtcaatcaaaatccagtggaatattttgagaaatttgaactattaaataatttatgtggagcttctgattctgattatgacacttttgcttatattacaccagctgttctgctgaaaacaactagaaaaccttgactaaagtataaatttatctgtttgaaggtataagaactatgaaatcagagaggtaaactcccaacattcagccctacctttctctttcaggcagttgccattacctaggcagtagcagaacagctagaaatc

SEQ ID NO: 92259 - DNA, 601 bp, Human
cacatgtgaaagaatgaagttggactctacttcataccatattcaaaaattaactcaatatagatcatagacataaatgtaacagataaaactatgaaactcttagaaggaaacataggtgtaaatttttgtgaccttggcttaggcaatggttcttaaatatgacacgaaatctcaggcatcaaagaaaaaacaaaaaataagatttcatcagagtttaaaacttttgtgcctccaaaaaacaccatcagggaaggaaaaagacaactcacagggtgggagaaaatatttgcaaatcatrtatctgatgagggcccagtgtctgtgttaaaagaactctgcaactcagcaataaaagcacaacctaatttaaaaattgatgagtgatttggatagctgtttctccaaagaagttatacatatggacaatatgtacatgaaaagatgctcaacatcactggtcattagagaaatgcaagtcaaaactacagtgagataccccttctcacccactgagatggctgtaataggcaagacagtaacaagtattgatgaagatatagggaaattggaaagcttatgcattgctggtagaatgtaa

SEQ ID NO: 92260 - DNA, 601 bp, Human
gacaactcacagggtgggagaaaatatttgcaaatcatgtatctgatgagggcccagtgtctgtgttaaaagaactctgcaactcagcaataaaagcacaacctaatttaaaaattgatgagtgatttggatagctgtttctccaaagaagttatacatatggacaatatgtacatgaaaagatgctcaacatcactggtcattagagaaatgcaagtcaaaactacagtgagataccccttctcacccactgagatggctgtaataggcaagacagtaacaagtattgatgaagatatagggaaattggaaagcttatgcattgctggtagaatgtaaaatagtgtaaccactttgtaaagaaattagagagttcctcaaaatgttaaacatagaattaccatatgatccagcaattctactccgagatgtgtacaaacgcaagagaattgaaaatgtaggtacacacaaaaacttgtatatgaatgttcatagcacccttaatcataatagctaggaagtggaaacacttcaaatgtccatcaactgatgaatgcataaacaaaatgtggtatatctgtatgatggaatattatctagc

SEQ ID NO: 92261 - DNA, 601 bp, Human
attttctgttaaaagagatcaagacttaaacctggagccaaactggagatttccaattattttctcctaaatgcaaagttgggttctgacttggaatctcggagtagactccaagtatatgtatccagctagctgacttaaggtttccagccagccttacaaaccaattggctagtggaacagagaacagtattgaaatatgggcatccaggccaattgcaagaggacagatcttgagtcctaatccatttgagtttattacaaggacagaagtgaagtgaaagggaattactcatttttrtttttcaacatttgcctcttgaatcaagagagagggtggagcctctcttgcttgtgaggcagggtgtttccacatactcgtaacttgaactctaggaagaaaaaggtagcaggataaattttacagaaaagggaagtagagcagcatgctttgcccaagcactcatctcctttgatacagttccttcagatactttgaaatgactaatgcattatatttaaggccactagtactagtcattgtgttttcaaggaaatcagaggtattccctgcttcactaaatgtatttgtcatgaccaa

SEQ ID NO: 92262 - DNA, 601 bp, Human
ttgcagtttcccagtacctacaacagtgtctagtgcgtagtaggtgctcaatatgtatttgtagcatgagtgaaagaatgtgctctattttttccatattataaatgccttataaaacgtttttgtacctaatgctttcactacacttcaaatgattttctaagaataaatttctagaagaggacttgccagttgaaaagacatagaaaaggttgtatgatttcaaattagttttctaatccacaataatgttacctgtggctatttttctttacactttaattttataaattttctatarcatattaggattaaaagagttattttttttcttttaagtacatttctatttattcagagagcagtgagcagtcttctaactggaatataaggtttttgttggtggtggtgaaagatgaggcttgaaaggtcacagctgggtgtggtggctacacctctaatcccagcactttgggaggccgaagtgggcgcatcacctgaggtcaggagttcgagaccagcctagccaacatgatgaaaccccatctctactaaacatacaaaattagccggggtggtggcacgcacctgtaatcccagc

SEQ ID NO: 92263 - DNA, 601 bp, Human
tccatatctcaccagtcactgactcagtatttcttcagtttcttcctctttttcttagttagatcctctcacctcaattactgctataactttccaatgtctttccctgccttaaaaccattctccacagagctgctagagtgatctagctaaaactatctgcgcagaatggttcccctgttatctgtatttttaaggttctagtttattaacatgacatacagcttctctgctctttggacccttcagcaccatttcttgctactccctgttgtgctctttatgttcctaggaaaggaarctgcttattgtcctgtgtatcttctcccccacacatatttcctgcctgtgtgccttgcttatgctgtccctacttcccaaactatcccatcctcagtcacatccatttcagtccccttttttctggagttcactgtgtaagactcaggtgtcagccacttcatttaaaaaaacttttaacatacgtattcacatactatacactttcctcctctactcccactttggggtcaaggatctctcttctttactttttataggaccctgatttttatctctcctttccctgtagtactgttat

SEQ ID NO: 92264 - DNA, 601 bp, Human
aaaatgaacatgcacaaggcagattaataggagaaaaggcatacaaatttatttaacatgtatccgcgggaacctgtatgatgaccccaaaatacaggggaaattgcccattcttatacttaggttcaataaagtatagacagctgtgtagaaatgtgattggagaagaaaaagggtatgatctaatgctaacagactgagtggggaaacccagcaaggcctgtgtgtctaaagtcttcttggcctctctgtgcagcattccttccttccaggtatggggcaggaccctctctggaacggkggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctccca

SEQ ID NO: 92265 - DNA, 601 bp, Human
tttatttaacatgtatccgcgggaacctgtatgatgaccccaaaatacaggggaaattgcccattcttatacttaggttcaataaagtatagacagctgtgtagaaatgtgattggagaagaaaaagggtatgatctaatgctaacagactgagtggggaaacccagcaaggcctgtgtgtctaaagtcttcttggcctctctgtgcagcattccttccttccaggtatggggcaggaccctctctggaacgggggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctcccaaagtgctgggattacaggcatgagccaccgtgcccagctattttttt

SEQ ID NO: 92266 - DNA, 601 bp, Human
ccttccttccaggtatggggcaggaccctctctggaacgggggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcraactcctaactttaagtgatccgccttccttggcctcccaaagtgctgggattacaggcatgagccaccgtgcccagctatttttttaaagacaaggtctcattctgtcacccaggctggagtgcagtggtgcaatcacagctcactgcagtcttgaccaagctcccatctcagcctcccaagtagctgggatcacaggcatgcaccactatccctgactaattaatttttttttttttttttttttttggtagagatagggtcttcctatgttgctctggctggtctcaaactcctggg

SEQ ID NO: 92267 - DNA, 601 bp, Human
ggtgtgatgacctacaatgaaacaggtaaaatctgatagtttttttgttgttgttgtttctttgtttgagacagagtctcgctgtgtcccccaggctggagtgcagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctcccaragtgctgggattacaggcatgagccaccgtgcccagctatttttttaaagacaaggtctcattctgtcacccaggctggagtgcagtggtgcaatcacagctcactgcagtcttgaccaagctcccatctcagcctcccaagtagctgggatcacaggcatgcaccactatccctgactaattaatttttttttttttttttttttttggtagagatagggtcttcctatgttgctctggctggtctcaaactcctgggctcaagtaatcttccctctgcagcctcccaaagtgctgaga

SEQ ID NO: 92268 - DNA, 601 bp, Human
cagtggcgtggtcttggctcactgcaacctcagcctcccgggttcaagccttcctcatgcctcagccacacgagtagctgggactacaggtgcctgcctaatttttttgtattttcagtagagatggggtttcatcaagttggccaggctggtctcaaactcctaactttaagtgatccgccttccttggcctcccaaagtgctgggattacaggcatgagccaccgtgcccagctatttttttaaagacaaggtctcattctgtcacccaggctggagtgcagtggtgcaatcacagctyactgcagtcttgaccaagctcccatctcagcctcccaagtagctgggatcacaggcatgcaccactatccctgactaattaatttttttttttttttttttttttggtagagatagggtcttcctatgttgctctggctggtctcaaactcctgggctcaagtaatcttccctctgcagcctcccaaagtgctgagattataagcatgagccaccatggctggcaataatttctttgtagccagtttttataccaaaaggctgagggaaaactagagtaatatttttaggttttatggct

SEQ ID NO: 92269 - DNA, 601 bp, Human
tttgtgttctcagcagttagcataatgtatagcatatagtaatgtggtaaaaaaaaaaaaaagcctattatttttctgttgaaataatgaggtcttgaactaggccaggggtagtgggaagggagggtgggtgggagaaacattcaaaaaagtcaactttggatgttagtgataagttaaaggtatgtaatttatagatgatgagatttgcaacttgagtgagtttggtatacagattgttgacttcttaaatttaagacatttgctgaacatgctagagagatgaccagtaggcaactasaaataagggtatagatagtaagagatagggatttaggagttgccagcatattggtattaactgaggctttggaatagataatataagtcaggaaggagaggagatgtaaaaaaggtggagtagagatccttggggaacaatatttaacaggttacagcaaaagaaagattagagaagtatattaattgtcagcagtgtccagtaatgaagaaagggtaaagcagatgagaattgagaacaatttatttggaaattagacagttgttattgaactttgagagaatagtttcagtctagtag

SEQ ID NO: 92270 - DNA, 601 bp, Human
tactactctttcaaaatgtgctttttggagaaatgtgttgtggaaagggatgtggtatcagttccttgaggaaaaggtaaaatgggggtgacgtttttgttcatatttttgttcttggatggggaatggtcttggaaaagtttttcaattgatatccaggagaaagggggattgaaagcaggaaagaaatttttaatggaataaggacaggaagggaaggaaggagagggtttgggatcaagatgtcaaatgatactgttagccctgaaaagtggtagggttcaaaaggaaaagaggtatgaagcgcaaaaacatttagagttggcatgagggaatgtaaaaggtctgttatctataaagtaggcaaccaggtcattaattgctggtgaagagtagataggacaggaatgggatagtttgtggtggcagggtggcacaggacattttggaagattagtaaagttctgttgagagtgatagaattaatgttaggactgcaggtagatttgagggttcagctgagattgagctatggaaataaaaagcaataataaaaagacaaagtatatatatattcttatatatattattccttacataa

SEQ ID NO: 92271 - DNA, 601 bp, Human
cagaattgattttgtatagaaaggtagtattggctggattatgagctttactgcttattcattcctgatgaaaatatctctgctgggcttacataccctgtagtgtttatgaactagtaggtttagaaatgaagagaccctagagagataatcatttcctccaagatgttttgtcttctaccaggaatttgtcaatagatatataggcccagtgggtaggctcacctctgcatgaatatttgataggagcatttctatcagttatgctctttcttaaaaaaaaacatgaaaataaacgcaycatttatgtaactcttataagaaatgcataaatcatgggaaacagtgagcaagatataattgaaattcagcagctcagtgagttacgaaccttctctctacaactcaattgtgttagttactgcttaacttaacgctgggttttcctttttgctttcaggaaaacctttaacttacgccctgggtgttgcctgtcaacagtttcctggtggctcaccgcttctgcctgctccagccttgctccggcagcttcaaggcttctgggcttcagagcttgttgtgaaagcttgctgctttggcc

SEQ ID NO: 92272 - DNA, 601 bp, Human
tttcattatgttggccagactggtctcgaactcctgacctcaggtgatccacccacctcggcttcccaaagtgctgggattacagacatgagccatgtaatagtagcttggaatgggttggaacagaggagatatggtgaatgaattcttgctatatgcaggaagactagatttatagaactccgtggcaactgtttctgtattctacaacctgtaacttaagaatgaacataaaatactgttacagcattctgtaactgcaatttgtaactagtttgtagcttcaaatgataatacattstgtttaagaactgatttgtatacatttgtcacttagtgattatttctgtagtgtttacagaaataattcttgaattattattacaggttttctaacatcatgtttttactatgaagtctttcaagacattgctagtgtttttaaaaatatatctttgttctgtgttaaactatagtcttgcagttcatactaaatgtacttttaattttgatcaagctaaacaagaaaggacattttaacagactacactgttatatgttaagctgtggttcttgaaaatacaggacctgaggttagagt

SEQ ID NO: 92273 - DNA, 601 bp, Human
tttgaaaatgttttccaccctgcagcagcatggcattcctgatgaccacatacatgtgtagtctcattttagccatgatcagttataccacaataccttgataattagcggtcatttcatgaccaggatgtgatgtgtggtatcccatactacctcattccatgcttcaaattttatgtgttttatatagaaaatgtagaaaagcaagtagaaattgcatcacttagaaatacctgatcttttgataaagcatagaaatttatggtacatattttatgtgtgtgtgtgtgtatatatatakagagagagagaaaaagtcacagtgtacatactttaataaacttatttgtttaacattatactgtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtgaatatatttgtc

SEQ ID NO: 92274 - DNA, 601 bp, Human
tgaaaatgttttccaccctgcagcagcatggcattcctgatgaccacatacatgtgtagtctcattttagccatgatcagttataccacaataccttgataattagcggtcatttcatgaccaggatgtgatgtgtggtatcccatactacctcattccatgcttcaaattttatgtgttttatatagaaaatgtagaaaagcaagtagaaattgcatcacttagaaatacctgatcttttgataaagcatagaaatttatggtacatattttatgtgtgtgtgtgtgtatatatatatakagagagagaaaaagtcacagtgtacatactttaataaacttatttgtttaacattatactgtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtgaatatatttgtcat

SEQ ID NO: 92275 - DNA, 601 bp, Human
tgtatatatatatagagagagagaaaaagtcacagtgtacatactttaataaacttatttgtttaacattatactgtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtraatatatttgtcataagtctaaaattacagaaagttagaaattaaagagatgaaagatttttttattttggtagttaaactgaagaaattgagagttatattctttgccacatattagaggtagagttggcagtgaagagattgggctgtaatgtgcttagtgcaatgcctggcacataatcatagctaacacttattgaatgcttactaagcaccagacccttgaaaaacttgaaattatttttcaccctgtggcagcatggcatccctgatgactgcacaggtgtgtagaatgggtct

SEQ ID NO: 92276 - DNA, 601 bp, Human
gtgaacttttccgtattaacattcctcagtaattttttcaagtgtatgagtaatttttctgtcatactgtgagataccatatttagtcaaattgatcatgtagaatatttaagttcatttcaatattttactattgaaaaccacactgtggtgaatattgtggcttagtttttatttgtatatagatatattcagttgagggtatttctatccatatttctatgtgaatatatttgtcataagtctaaaattacagaaagttagaaattaaagagatgaaagatttttttattttggtagttaaactgaagaaattgagagttatattctttgccacatattagaggtagagttggcagtgaagagattgggctgtaatgtgcttagtgcaatgcctggcacataatcatagctaacacttattgaatgcttactaagcaccagacccttgaaaaacttgaaattatttttcaccctgtggcagcatggcatccctgatgactgcacaggtgtgtagaatgggtctcattttgtccctgatcagttacaccacaatacctcaatagttagtggtcaataatcccgagtacaaggattatac

SEQ ID NO: 92277 - DNA, 601 bp, Human
acactgaagtattgaaaggttaagttttttgcctagagttatacagctaaggacaaaactaggattcaaacccaagtagtctggcttcagaatccatgctatcaccactccccaaaacagccacaataaatgctagctaagtgtttgagtgttcaataaatattaggcgtcatcattattcctactgcacagttgcatattccagaggtggttttggttccaatatttttggattttagaaagataatttagtttgtatactctattttatgtaacattctcattggggtttggagcagcmcttcataaacagatacattcacgtttcttcagtgaagcatgtttgtttttatactaagtgagattaaaaagcaagaatattaatagcctgatgtcactacatgctgccaaatgagttatgaaaaccttttgtctttgagaattgcagataagggattatggacctgtataaaactcttaccatagtgcctggcatttagaacacactcctccttctactagatttatactagtagtattgggtgggtactactactaccactactgttattagtagttatcatcagatacatacttacag

SEQ ID NO: 92278 - DNA, 601 bp, Human
tggttttggttccaatatttttggattttagaaagataatttagtttgtatactctattttatgtaacattctcattggggtttggagcagcccttcataaacagatacattcacgtttcttcagtgaagcatgtttgtttttatactaagtgagattaaaaagcaagaatattaatagcctgatgtcactacatgctgccaaatgagttatgaaaaccttttgtctttgagaattgcagataagggattatggacctgtataaaactcttaccatagtgcctggcatttagaacacactyctccttctactagatttatactagtagtattgggtgggtactactactaccactactgttattagtagttatcatcagatacatacttacagaaaactggtgaattgtagagtactgttagtacttttctcacactgtgaccttgggaggggaagacacctaagttttggagtctttcagctattcttccctcaatcagaataagagggtgtaagtcatagtgttctgtgtgttttccccgccctaaattgagtcttgtatagcttagtgctcctgtccctctatccatgtgcactccca

SEQ ID NO: 92279 - DNA, 601 bp, Human
tggttccaatatttttggattttagaaagataatttagtttgtatactctattttatgtaacattctcattggggtttggagcagcccttcataaacagatacattcacgtttcttcagtgaagcatgtttgtttttatactaagtgagattaaaaagcaagaatattaatagcctgatgtcactacatgctgccaaatgagttatgaaaaccttttgtctttgagaattgcagataagggattatggacctgtataaaactcttaccatagtgcctggcatttagaacacactcctcctyctactagatttatactagtagtattgggtgggtactactactaccactactgttattagtagttatcatcagatacatacttacagaaaactggtgaattgtagagtactgttagtacttttctcacactgtgaccttgggaggggaagacacctaagttttggagtctttcagctattcttccctcaatcagaataagagggtgtaagtcatagtgttctgtgtgttttccccgccctaaattgagtcttgtatagcttagtgctcctgtccctctatccatgtgcactcccagttgtg

SEQ ID NO: 92280 - DNA, 601 bp, Human
gcatttagaacacactcctccttctactagatttatactagtagtattgggtgggtactactactaccactactgttattagtagttatcatcagatacatacttacagaaaactggtgaattgtagagtactgttagtacttttctcacactgtgaccttgggaggggaagacacctaagttttggagtctttcagctattcttccctcaatcagaataagagggtgtaagtcatagtgttctgtgtgttttccccgccctaaattgagtcttgtatagcttagtgctcctgtccctctrtccatgtgcactcccagttgtgcagggtttgattttagagtctaagcaatagctcacgtggtgtgttcaccgcttcagagatcttagtgaaacaacgtttcaagtttttccttattctttattacagccctctttatgagcccattgggagaacaatttaattgtttgaaattgagatacttccttttctttctcatccattttaattgatgaaaaactataatcacagtcattataaccacttataacaattaccaagaaatatttagtatgtatacacttactgtaattatatggtca

SEQ ID NO: 92281 - DNA, 601 bp, Human
gttctgtgtgttttccccgccctaaattgagtcttgtatagcttagtgctcctgtccctctatccatgtgcactcccagttgtgcagggtttgattttagagtctaagcaatagctcacgtggtgtgttcaccgcttcagagatcttagtgaaacaacgtttcaagtttttccttattctttattacagccctctttatgagcccattgggagaacaatttaattgtttgaaattgagatacttccttttctttctcatccattttaattgatgaaaaactataatcacagtcattataaycacttataacaattaccaagaaatatttagtatgtatacacttactgtaattatatggtcatgttacttttattgcagtctgatccaaatataaatttattaaataaccttgatatgcacatttgctattaagtttttttttttttgcacttgaatttaaacctatactctgtttttggaaatatcccgttgaacagcagtttgaagatctgctgtatatagtttgacctccctttctgcatattagagtagcatttctcttcctccccaccaacccccagtaactggaaacatcctcgt

SEQ ID NO: 92282 - DNA, 601 bp, Human
cttcagagatcttagtgaaacaacgtttcaagtttttccttattctttattacagccctctttatgagcccattgggagaacaatttaattgtttgaaattgagatacttccttttctttctcatccattttaattgatgaaaaactataatcacagtcattataaccacttataacaattaccaagaaatatttagtatgtatacacttactgtaattatatggtcatgttacttttattgcagtctgatccaaatataaatttattaaataaccttgatatgcacatttgctattaagtttttttttttttgcacttgaatttaaacctatactctgtttttggaaatatcccgttgaacagcagtttgaagatctgctgtatatagtttgacctccctttctgcatattagagtagcatttctcttcctccccaccaacccccagtaactggaaacatcctcgttcaacctttgttttcctcttttgtgggctagcctgtggcctatggcaagtccaatggcctggaagtggtcttacagattatctggttaaactgaagcagagagatagaaatgtaatcaatttgttgagagtgag

SEQ ID NO: 92283 - DNA, 601 bp, Human
gaaaaactataatcacagtcattataaccacttataacaattaccaagaaatatttagtatgtatacacttactgtaattatatggtcatgttacttttattgcagtctgatccaaatataaatttattaaataaccttgatatgcacatttgctattaagtttttttttttttgcacttgaatttaaacctatactctgtttttggaaatatcccgttgaacagcagtttgaagatctgctgtatatagtttgacctccctttctgcatattagagtagcatttctcttcctccccaccmacccccagtaactggaaacatcctcgttcaacctttgttttcctcttttgtgggctagcctgtggcctatggcaagtccaatggcctggaagtggtcttacagattatctggttaaactgaagcagagagatagaaatgtaatcaatttgttgagagtgagaaagggattttatttattgtatttgatagtttttgatctgcaattgaaatataaaatacagaaatagatgttcctttttttttctttttggaagggatgtgtaaagtttagtttttgtaaaatcgttagttttaattgc

SEQ ID NO: 92284 - DNA, 601 bp, Human
taaggcataaaagacaaattcaacacaattgtgatataattatgataaaggttacaatccataatgctaatttaatattagtggaatactaaatggaaacccttgtaatggggggcttatgcagctatatttaaaggatgtctgcaaactactttcttctatagaaagacattttgtaatggttgatttctaacgtgacgtaacttgtttatattattctgtatttatctgtattctgctacaagcaaaagtcagcaggagttttgaacatgccctctagaaattctgtttaatgctgatyatgcagtcactttgtattttgttttatattacaggagttgtagtaaaatctagtaatggaagaactgcctgcatttttatgtagatttgagggaaggattgactggagtgatgttaaaaatatccagcagctggtatggcctggtcagaactgctgtcacacatagatttggagtggacttctggggggtccgctgctgtgctgtatcatggtgaagggttgaatgggataggcattctggggcttcagggaagcagaacttaactggtgtagaattctgtcagtattttaactggtaaa

SEQ ID NO: 92285 - DNA, 601 bp, Human
taattgttcctttttatctgcatccccccagaggtaattattgtatagtaatatcctgtttgacaaagtatctgggagctttaatgtcacatgtatcactgggatatgtgccagtgtccattatattcaacaccttagtttttacttttaatttccctaagactgaattgccttactgtcactggttggatttctcaaggagtaaataccgagattgagtttattgtgcagatatttgtttgggatttcttttgagaaatccctacctgtagaagggaagggagggagataggatttgtamagttgtcccatcagcctcagttgattccactgggagctctgtagcagaaatggctcttgagaagtgtcctacattggatcaaaatgtctagacctttatacacctgcctctactagtcagtggacatgggctacccctgaaggacatggccttggactggtaggctttcttcagctgatgcaaaccctgaaggtgtgacagcatcagcagctagagcaacaaatcctgttattacaaaagagtaaataattatgttctgtttagcagaaataacaactgtagtcagtttactgtttcaga

SEQ ID NO: 92286 - DNA, 601 bp, Human
atgtgccagtgtccattatattcaacaccttagtttttacttttaatttccctaagactgaattgccttactgtcactggttggatttctcaaggagtaaataccgagattgagtttattgtgcagatatttgtttgggatttcttttgagaaatccctacctgtagaagggaagggagggagataggatttgtaaagttgtcccatcagcctcagttgattccactgggagctctgtagcagaaatggctcttgagaagtgtcctacattggatcaaaatgtctagacctttatacaccwgcctctactagtcagtggacatgggctacccctgaaggacatggccttggactggtaggctttcttcagctgatgcaaaccctgaaggtgtgacagcatcagcagctagagcaacaaatcctgttattacaaaagagtaaataattatgttctgtttagcagaaataacaactgtagtcagtttactgtttcagagttagaacttttaaaaaattgaattaaagtttatacttttttcaatgaagctggatatgttggggaagaattgtgaaaaggatgaataactgggttagctttcat

SEQ ID NO: 92287 - DNA, 601 bp, Human
tagtcagtggacatgggctacccctgaaggacatggccttggactggtaggctttcttcagctgatgcaaaccctgaaggtgtgacagcatcagcagctagagcaacaaatcctgttattacaaaagagtaaataattatgttctgtttagcagaaataacaactgtagtcagtttactgtttcagagttagaacttttaaaaaattgaattaaagtttatacttttttcaatgaagctggatatgttggggaagaattgtgaaaaggatgaataactgggttagctttcattacagctgraagtggcaaaattcaaaataaaacagtataatttaaaatcaaatattttattcaattaacaagtatttatatattctgtttctgagacaagatggaatagactcacttctccctgttctcctgtgaagtatagctgaagattctggacatttatatataaagcaaacattagaagaacccaaaaggtagagagaataaggtagaccagctagggacctcaggaccttacggtataagacccattttggaggtcagtattatgctgatagaaaaacctgacaaggaccatacaaagaaagt

SEQ ID NO: 92288 - DNA, 601 bp, Human
gcagcaaaattccttattttttatttgtgtattgttgatgctttaaaacaattttttcagaggtttatgtacaacttatttaccttattctgtttcaagccatatgtcaaatatataattaatgatatacgggttactcaaaggtgctaggaagcctcctctcttttctatacctgggcagaaaggtataataatataataattgtccaataatttcacagatttatcatttacaaactttgctagtttatcaccaataactctacaagttcatcatttacagactttgctagtttatcarcagcctcctaaattaacaaatgaactactgctctcaatctgttctgtaaattttacttctgtcttcacatttgttcagtgagtactgacttcgctcattaacagatgtccttactcatttcatgaggagatgcggtatagtttacagaaacactcactgtcttgagagttaaacctttttataaaaccttttaaaaacattttatttattgaggcagagtcttgctctgttgtccaggctggagtgcagtgttaggatcttggctcactgcaacctctgcctcctgggctcaagggatcc

SEQ ID NO: 92289 - DNA, 601 bp, Human
ttgctcacacccggaggcagaggttgcagtgagctgagatcacgccactgcactccagcctgggcgacagagcgagaaaaaagaaccaaagcatagtgttgtatagattttagtaatttaattgttttgtggatcatggctgttgaattttccttgtgggaaataataatcacttattatatatagcatactgtgtgataatgtttttagtgtatctggaatatggtgtagccattaagaaaaaattaggtagatttctgtgtactgatacggaaggatgttcaaattcattgttacttgaaaaaaaaaaaaacttacagagcactataatctcatttgtataaagaccaaaaaatataggggaggtgggataccatgtgaatatataatctgtgtgtgtgtgtgtgtgtgtgcacgtgcacatgcatgcttatatagacacagattttctgagaggattttgaccaaagagttaataatggtaacctctgcacacaacaattgggcaatgaaactatgggaacatgactcagggagacttttactttcttagagttatctttgaagtttctgtcatagtgttatttttgtttctttttag

SEQ ID NO: 92290 - DNA, 601 bp, Human
ttcatttagcatttctacttctaagtgtatacagtggagaaactcttgcacatttgtacaaatatgtttattccaacattgtataataataatacaaaactggaaataacctgtgtttccaccgttgggggttgcataaataaattatagtgcattcaaacaatggtatgccatagcagttaaaagaagaacagtcattcttgagaaaaaaaaaaaatcaaattgcaaaaggataaaattataccattcacatagattttttttgtttttgttttctttctttctttcgtttttttttttgttgttgtttttttttttaaggcaaggtctcactctgtcacccaggttggagtgcagtggtgcaatcttggcccactgcaacctgtgcctcctgggttcaagcaattctcccgtcttagcctcctgagtggctgggattacaggtgtatgccaccacaccctgttaatttttgtatttttgttagagacagggtttcaccatgttgcccaggctggtcttgaactcctgtgttcaagcaatctgcccacctcggcatcacagagtactgggattataggcgtgagccactgcgcccggccc

SEQ ID NO: 92291 - DNA, 601 bp, Human
gataaaattataccattcacatagattttttttgtttttgttttctttctttctttcgtttttttttttgttgttgtttttttttttaaggcaaggtctcactctgtcacccaggttggagtgcagtggtgcaatcttggcccactgcaacctgtgcctcctgggttcaagcaattctcccgtcttagcctcctgagtggctgggattacaggtgtatgccaccacaccctgttaatttttgtatttttgttagagacagggtttcaccatgttgcccaggctggtcttgaactcctgtgytcaagcaatctgcccacctcggcatcacagagtactgggattataggcgtgagccactgcgcccggcccatgaaaattttcaaaacacaaaacaaatctgttgtttgtagacatatacatgtgtgatcaagtcatataattggactatccactgacttcagattattacagcaggggagaaagggaagagaatgggttcacagtttggagtaggaaggatacaatttacatcttatttctttaaaaagatcagaagtaaatatggcaaaatgtagacatttatattatctggatggtggg

SEQ ID NO: 92292 - DNA, 601 bp, Human
tttttgttgttgtttttttttttaaggcaaggtctcactctgtcacccaggttggagtgcagtggtgcaatcttggcccactgcaacctgtgcctcctgggttcaagcaattctcccgtcttagcctcctgagtggctgggattacaggtgtatgccaccacaccctgttaatttttgtatttttgttagagacagggtttcaccatgttgcccaggctggtcttgaactcctgtgttcaagcaatctgcccacctcggcatcacagagtactgggattataggcgtgagccactgcgccyggcccatgaaaattttcaaaacacaaaacaaatctgttgtttgtagacatatacatgtgtgatcaagtcatataattggactatccactgacttcagattattacagcaggggagaaagggaagagaatgggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtatta

SEQ ID NO: 92293 - DNA, 601 bp, Human
caacctgtgcctcctgggttcaagcaattctcccgtcttagcctcctgagtggctgggattacaggtgtatgccaccacaccctgttaatttttgtatttttgttagagacagggtttcaccatgttgcccaggctggtcttgaactcctgtgttcaagcaatctgcccacctcggcatcacagagtactgggattataggcgtgagccactgcgcccggcccatgaaaattttcaaaacacaaaacaaatctgttgtttgtagacatatacatgtgtgatcaagtcatataattggactrtccactgacttcagattattacagcaggggagaaagggaagagaatgggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtattatttaatataaaatatatttttaaaaggtactattccagtagcccagtttctgagggtggtttgaaacttgtgttattgaaatg

SEQ ID NO: 92294 - DNA, 601 bp, Human
gagtggctgggattacaggtgtatgccaccacaccctgttaatttttgtatttttgttagagacagggtttcaccatgttgcccaggctggtcttgaactcctgtgttcaagcaatctgcccacctcggcatcacagagtactgggattataggcgtgagccactgcgcccggcccatgaaaattttcaaaacacaaaacaaatctgttgtttgtagacatatacatgtgtgatcaagtcatataattggactatccactgacttcagattattacagcaggggagaaagggaagagaatsggttcacagtttggagtaggaaggatacaatttacatcttatttctttaaaaagatcagaagtaaatatggcaaaatgtagacatttatattatctggatggtgggttggtccatggttcttaaattattctgtgcatttttctcattgttttgaactataaaagtattatttaatataaaatatatttttaaaaggtactattccagtagcccagtttctgagggtggtttgaaacttgtgttattgaaatgtcttataatatcaggtgtattccttttccagaacagaaataatataa

SEQ ID NO: 92295 - DNA, 601 bp, Human
acagaaataatataataaacatagtaattctttgtatatttcctagttttacataaagtatgctctaaaaattttctttttgcgtttcagacagcatgttttcgtgaagaaagggatgtattagtgaatggagacaataaatggattacaaccttgcactatgctttccaggatgacaataacttagtaagaatcatttttgtatttctatatactgtttttttgttggaagaattagcattatttttatttaagcattgtttaaatgtaggtttcatatagaaaattaagtgcatttcayacagggtaagttgttcacttgatatgtggtgtttttttttctccctggaaatttgataccttttcattggaattctttatgctttttaataagcaagtcaaaactaaatccaaacatttaatttccattggttaagttctatagacggtcttcaggagtttttcatgatacctttaacaccagtaccattcctcttcccttgttcctgttgaagtccagctagtactttaaaattgtgctcaaattcatcttaaaataatcatttccagaattttccactgaaattaatctttctcatct

SEQ ID NO: 92296 - DNA, 601 bp, Human
tgctttccaggatgacaataacttagtaagaatcatttttgtatttctatatactgtttttttgttggaagaattagcattatttttatttaagcattgtttaaatgtaggtttcatatagaaaattaagtgcatttcacacagggtaagttgttcacttgatatgtggtgtttttttttctccctggaaatttgataccttttcattggaattctttatgctttttaataagcaagtcaaaactaaatccaaacatttaatttccattggttaagttctatagacggtcttcaggagttyttcatgatacctttaacaccagtaccattcctcttcccttgttcctgttgaagtccagctagtactttaaaattgtgctcaaattcatcttaaaataatcatttccagaattttccactgaaattaatctttctcatctcattctaactttacatttttaaattatttttattacataactaacacatgtatctctgattttttttgatacaactttaagaaacatttaaataggccggatgcggtggctcacgcctgtaatcccagcactttgggaggccaaggcgggaggatcatgag

SEQ ID NO: 92297 - DNA, 601 bp, Human
atttttaaagattaaatagaatagaaaatgacagagttcatgacaagtaagtagtaagagtgaatatggtctcatgacacatttcttttataatatactgaattatcatataagccatatatattattgtgggttatagtgagaattgtgtaaaaaccatagcatagagttttttgtatgtgctagatgcatagttgttaaattgaatagaatgatgttttaactggatttattatacttaatatacaaaattttagggatgaatgtatcatgcaaagataatctgcatgggtttgttaayaacatttgtaagagcaaattaaaacacatcccacatctttgcctagaaaaattatagcaatgtatcatgataattttcaaaatgttttcaaataatgaataaaatccactatgacggtgtattctgtaatagataaatttaacactgcagatttgtgcattgcttaaaaatctacattttggtataaatatagaaataattatataattttgtaggtatattaatagaaataaagtacccaaataccaaattttatatagcaaaaaaagcctgaactgtgatttatctctctcctcttgt

SEQ ID NO: 92298 - DNA, 601 bp, Human
atatatattattgtgggttatagtgagaattgtgtaaaaaccatagcatagagttttttgtatgtgctagatgcatagttgttaaattgaatagaatgatgttttaactggatttattatacttaatatacaaaattttagggatgaatgtatcatgcaaagataatctgcatgggtttgttaacaacatttgtaagagcaaattaaaacacatcccacatctttgcctagaaaaattatagcaatgtatcatgataattttcaaaatgttttcaaataatgaataaaatccactatgacrgtgtattctgtaatagataaatttaacactgcagatttgtgcattgcttaaaaatctacattttggtataaatatagaaataattatataattttgtaggtatattaatagaaataaagtacccaaataccaaattttatatagcaaaaaaagcctgaactgtgatttatctctctcctcttgtttagttttatttgcattcttcgtatttgacattaggattaacatttctttttcaaagacatttttcagggaaaaatagtctgtatatacccctcaataattactaaaatagaatta

SEQ ID NO: 92299 - DNA, 601 bp, Human
gaaaaaatcattaaaaaatgtcgacaaagctaattttagataccaaaaaaggaaattttattatatataattgtttttcaaagtaacttttaaccctgatagcttttaaattgccaagtaaagaacataatttataatgctatacggttctagaaagctgtggcaaataactttcatttctaacctacttactacaatagtttatgaaaaaatttgcaattatagcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaatatcttgcactgacatatgtaacttgtttaaaaggtgaaagatacttgaattttaaattaattgtagtaactcatatgaactctaaattctttataggaatccaatttgtgaagacag

SEQ ID NO: 92300 - DNA, 601 bp, Human
gcaagtagactttttgtgtgtttcagaaaaaggcacataatttaatgaatggtagatattattatgtgattagatctttttttctttaagaaaagctcattaaatacaaagctgcttagttatatcaacattgacacataaaatttttatcacttacataacactagaatataatgaaccagtgaaatttgttcgttctgtactttcttattaattgtttcctgattagttactttatggttgaggaaaaaaaggaaaatatcttgcactgacatatgtaacttgtttaaaaggtgaaagwtacttgaattttaaattaattgtagtaactcatatgaactctaaattctttataggaatccaatttgtgaagacagaaattattagaaaagtaatttttttaagaaaagtattgtttagggccgggcacggtggctcatgcctgtaatcccagcactttgggaggccaaggcgggcggatcatgaggtcaggagatcgagaccatcctggctaacacggtgaaacccggtctctactaaaaatacaaaaaactagccgggtgtggtggtgggcgcctgtagtcccaggtactggggaggc

SEQ ID NO: 92301 - DNA, 601 bp, Human
atgaaccagtgaaatttgttcgttctgtactttcttattaattgtttcctgattagttactttatggttgaggaaaaaaaggaaaatatcttgcactgacatatgtaacttgtttaaaaggtgaaagatacttgaattttaaattaattgtagtaactcatatgaactctaaattctttataggaatccaatttgtgaagacagaaattattagaaaagtaatttttttaagaaaagtattgtttagggccgggcacggtggctcatgcctgtaatcccagcactttgggaggccaaggcrggcggatcatgaggtcaggagatcgagaccatcctggctaacacggtgaaacccggtctctactaaaaatacaaaaaactagccgggtgtggtggtgggcgcctgtagtcccaggtactggggaggctgaggcaggaggatggcctgaaccctggaggcggagcttgcagtgagctgaggtcacgccactgcactccagcctgggcaacagagggagactctgtctcaaaaaaaaaaaaaaaaaaaaaaaagtattgtttaatagtaaaaagaaagcaaggaggattaactataaggtga

SEQ ID NO: 92302 - DNA, 601 bp, Human
aaacaaacaaacaaacaaaaacgttgggcctagtaaatacagcaagtaggccaaagacacaggattttaaatatattctgcttccctaattttcaaggctttaaatatgcgaaattagtttctttggtttaacacacatttcctatgtttgtaattttaacatatagtaataaaaggaatttgaattttttcaagactctttaaatcttaatgtcaactcagtaatatccctgaaaacaatatcttcattctgtaataaaaccttaatttcaaggcatttatgtgtcttgtactcactagscttcatgctaagtgctacattatcattattgtagttaggtagatgagaaaatgaaatgtcacagagattaatttttcaacgtccacttacaacatggagtcagtatttgaatacaggtttctctgactacaaaacccatttttccactatgtctagttttctccctcacttaaaaataatatataatgtacacacaaatacacatgtatatgtaatacatgcttataaagcaatgtagaacataaagttataacatcagctgtaatctaacaacctacagaatctcagtgaacagtttga

SEQ ID NO: 92303 - DNA, 601 bp, Human
atacacatgtatatgtaatacatgcttataaagcaatgtagaacataaagttataacatcagctgtaatctaacaacctacagaatctcagtgaacagtttgatgtactcttctcatcgtttctttacaccacatacatacccataaggatccatatctaaaattagttggcttctgtttattatatacacctgagaaaagcccattctgatatttttacagtattagaaatgggaagagacacatatggtgataattactatattctacgtagtagtggtttctaaatgctgatctatargctgatgctggttctaataaagttcttactgatccaaggtgaaataaggaaaacataatgataatatgaatttctttcaatgtagggactatcctgtattccaagttttttctttcattgtttttttgggggagggggtggattcaaatgttcattcttctaaaatcttggaaagctgtgttccattgttgtaggtgaagatgataataatgatgatattagctctttgcaaaatacaacaatggtaaccctgtgttgttctctgcctcagtctttaaaaattttgttttactgctgtat

SEQ ID NO: 92304 - DNA, 601 bp, Human
acgtagtagtggtttctaaatgctgatctataggctgatgctggttctaataaagttcttactgatccaaggtgaaataaggaaaacataatgataatatgaatttctttcaatgtagggactatcctgtattccaagttttttctttcattgtttttttgggggagggggtggattcaaatgttcattcttctaaaatcttggaaagctgtgttccattgttgtaggtgaagatgataataatgatgatattagctctttgcaaaatacaacaatggtaaccctgtgttgttctctgccycagtctttaaaaattttgttttactgctgtatgaaatttagaagttttgtaatgactgctgatcatcatcttacacagtttcttgttaattagcagcatatgtaattaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagatt

SEQ ID NO: 92305 - DNA, 601 bp, Human
tggattcaaatgttcattcttctaaaatcttggaaagctgtgttccattgttgtaggtgaagatgataataatgatgatattagctctttgcaaaatacaacaatggtaaccctgtgttgttctctgcctcagtctttaaaaattttgttttactgctgtatgaaatttagaagttttgtaatgactgctgatcatcatcttacacagtttcttgttaattagcagcatatgtaattaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaatatctagcaacagaggcctatttcttgccagatttattaattatggtcttggatacatttatcgtca

SEQ ID NO: 92306 - DNA, 601 bp, Human
attaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaayatctagcaacagaggcctatttcttgccagatttattaattatggtcttggatacatttatcgtcaacaaaaaaaaattattttgagatgattttggttgttttgctttgttgttattattatttgtcagcattacagaaccgatgtgcctgcttatacatacatgtacatgtatagtatctaaaagttgtcactcctagaataatagacattggagactaggaaaggtgggaggaggtgagggatgagaaattacctatgggtacagggtacactattcaagtgatgggtacactatat

SEQ ID NO: 92307 - DNA, 601 bp, Human
agcctgggtgacagagcgagactctgtctacaaaaaaaaaaaaaaaaaaaaaagttctcacttacagtcagcatttctagaaatcacttcttaaaaaaccactcttgtttaaatgtacatatgaattccatctcaaaaggagtatgcattggtcagtttccttatagttgagtcttacatatttaaattagctggaattctagaccataagtcataggttcatttgctaaataagtcctgtattatatattttatgtttctcaagaaaatactttcaaggattgtatgtgccaaaagagatttttttttgtatgaaagtgataattttaatgttcatggagtaattgtaaactattaatactttatatttaaaaattttaaaaataccagcatgaatttggaaggacacacaaaaaataagaaataaattaaggatatattggatgatttaaaaggtaccctcacattttaagaggaaagtaggaaacagcagaacgttgttggtgaattaatcattcaaatgagagtatctttggatggtgcaaaatgtgagaaagagaaagatgctgaggagaagtacgtaaagggatactgccaagtt

SEQ ID NO: 92308 - DNA, 601 bp, Human
tcttctgcctcagcctcctgagtagctgggattacagtcatgcgccatgaagcctggctaattttttgtgcttttagtagaggtgggttttctccatgttggtcgggttggtctcgaactccctacctcaggtgatcttcccgcctcagcctctgaaagtgctgggattacaggcatgagccaccgtgcccggccttgaatttctttttattttagtcattggttctagttttgcttttagagtcacatataatttatttctcttctagttatcatgctttctgaagtcttctttaggttraacatctaaacatctctagtttctctgttataacaatttgtatacacttcctaccttccttgtcttaaccccccaccacacactctgcccattcctacacctcttctccctccctccttttctctacttttacctttctgtggatgctccattgtgttaatgtgctccttaaaatgttattctcattttctggatagactattttcagcaaatgctttactgaggaaatattttttgagtcctcttttataagtaacattgtgctaaactatgtggaattgtaagtaagtgggtatagca

SEQ ID NO: 92309 - DNA, 601 bp, Human
tagattaaaatctaagtcaggcttgtctccagatttatgttctttgcacaacatcatgttttccatagaagactttaatggcggggctttgaaggatgagaagactctgtaggcagataggaagacattcaagataggtgaatggtaggagaaaagcacataagaaggtaaatagtagttttggaaaatacttaatagactagtttggctagagaaaagagttcatgttgagtttagtaggagattaatttgtaaagagattttggttcttatcatggaactcttgaatgtcacagacttwgtatcttggtagctaataaactacaatgaatttcaggcaatgaaatttgaaggtaaacttcatgtcttagagttttatgaaatttatcaaatttccaaatgtgttataattcatgaacttaaaatatagggatgtggagaatacaagaagggactagtgagactgttgtgtttaaggaaggagatactctcctttttcttgtgttctttttaaggaaatatatttctagacttgtaaaagtatgttgtttgtcttctatcagcacaaaaactcgcatatgaaaaaatttgcacaaaggtt

SEQ ID NO: 92310 - DNA, 601 bp, Human
taccagagtgtggcacatttgttaacatcaatgacccttcattatcacctaagtccatagtttacatgtttacattcgtgttctctgttggtgttgtacgttctgtaggctttgacaaatgcagaacaacgtgtatccgccataatagtattatgcggaataatttcactgccctaaaaatgctctgtgttccacctctttattcctcccttcccgctaacccctggacatgactgatctttttactgtctcataggtttgccttttccagaatatcatatagttggaatcgtacagtttrtagacttttcagattggcttctctcgcttagcaatatttaaggtttgatagctcatttctttttagtgagtaacattctattgtcggcatgtaccatagttttccatttacctacttaaggacatcttggttgcttctaagttttgggaattgtgaatgaagctgcattttatatgattgcttttttttttccctctctctctttttagcatttcaattatacttctattttttaacttttcttaatggttaccctagagtttgcaatataaatttacaactaatctcagcccactttga

SEQ ID NO: 92311 - DNA, 601 bp, Human
gcataagtaataattcatatttgagtacattgttggcattcttttgatcaaactgttatcttttagactaattaaaaataaaaggtaaaagtttttattttaccttcacttattcattctctgatgctgttcctctctttacatagttctgtttctgatttgtatcatttttcttctttttgaagaacttttcaatttttcctgaaatatagttttcctggcaacaaatcccctcagtttttgtttgtctgagaatgtatttctctttcacttttgaaggataattctgcagtatatgaartcataggttggtgaggctttttttttcttttaaatatttcacttcactctcttcttacttgcatgatttttaaggaatcagatataattcttatctttgttcctctatgcataaggtgtttttttcctctggcttctttcagggtttttttctttatttttttatattctgtagtttgaaaatggtgtgcctaggtatagttttttttttttggggggggcgggtgggggggtgccatttatccttcttgatattttttgaatttcctggctctgtggtttgatgtaggaaaattttggg

SEQ ID NO: 92312 - DNA, 601 bp, Human
ttttcctggcaacaaatcccctcagtttttgtttgtctgagaatgtatttctctttcacttttgaaggataattctgcagtatatgaaatcataggttggtgaggctttttttttcttttaaatatttcacttcactctcttcttacttgcatgatttttaaggaatcagatataattcttatctttgttcctctatgcataaggtgtttttttcctctggcttctttcagggtttttttctttatttttttatattctgtagtttgaaaatggtgtgcctaggtatagtttttttttttkggggggggcgggtgggggggtgccatttatccttcttgatattttttgaatttcctggctctgtggtttgatgtaggaaaattttggggaattatcagacattattgcttcattccatttccttctggtattcccattacatgtaacttataccttttgtagtaatcccacagttcttggatattctgttctgttttttttttttccagtcttctctttgcttttttcattttgaagtttctattatattctcaagctcagagattcttttctaagtggtgtctagtctactaatgagct

SEQ ID NO: 92313 - DNA, 601 bp, Human
ccaagaatttacattaaaatatcagaagctcttggttagctatacattcgttctttgtatcacaaactccaggaacgagaagacgatgggtgagacaggtagccagtaaaatgccttcaaacaattgcccctgggtttgaggggccagtgactgaagtcccatactcatgtctctctgggcctactaaattttgcatgcctcacatagctcagactgctttgagctctttttcttttctcaatgtattgggcaaaaggaattgcagtaagtgggccttgagtgatgtagtggcaaggggcrtgtgtgtgcatgtatgtgttggtaaggggccattctgtggtcctatgattaggtcccaatctttagtgaggctttgagactgcacagtgaacaccagggcttctcagcttctcagtacccctgccacctctgtacctcccttcctgccttcctgcttagttgggacaggatggctagaaggtgccagacttgggtattgcccctccttctggtaggttagtctctgataataccccagcaggttaggctctgaaaaattccaaacagattaggctctgttaaaatagtttctcctgaggg

SEQ ID NO: 92314 - DNA, 601 bp, Human
gggcaccatgatgttccaaacacgtggggatatgtaggggcagccatactgccaggcacatgtgggggcaagggcaagaggacaacggtgggaatcgccatgttaggtggacccagtttctaatggctaacatttgcatatcaaaggttgccagcccgggtctaagacccaaggctttcattctagataagagctgcgaaaaatcttccaaggacccctttttttcctatgtgcctaaaataatttcttaataactcctacctcaattgagggtacagcaaccaagaactttgtttttttaaaaaaaaaaatttcttgtaaagatgaaaagatttccaaagatgctaattaaagtgttaaatgactagctggaaaaataacagcttgttattttattgagaaacctaagaacggtatgatgttataaagataaacactcaaaggggctattactattattttctactgagaattaccccagtagccttctcccttttgaaggaggcagggaaatgatgcagtggtattgaggagtgaagaaaaatggtattagtagagcagctaataatactggtgcatattgtttggaggaagtagaaat

SEQ ID NO: 92315 - DNA, 601 bp, Human
attagcaagcccagatgtaggctaacagaggtattttcaactgattttgagaaaggtgcaaaagcaaaaataatcttgaacaaatggtgctcaaataagagaccaaaaaaaaaaccccaaataacttccccaaagctctcataaatacaaaaattaattcaaaatgggtcatggatttaaatgtacaacataaaactataaaactgttggaagaaaatattggagaacattttctggatctagggcttggtaaggagtttttagatatgacaaaaaaaatcaataaaaatgaataaatggkacttcattaaaattaaaattatgtgctcaatgaaagaccctggtaagactataaaaagacaagctacaaagtgggagaaaatagttgtcaacataccttacaaaggttttatatctagactatataaagaactctcaaaatacaattaaaaagcccaagcaatctaattacaaaatagggaaaagacaatagacatttcacccaagaggagatagagatggcaagtaagcacatgaaaagatgttcaatatactgatattgaattttacgaaaatgccagttaaaaccataatgagatat

SEQ ID NO: 92316 - DNA, 601 bp, Human
acaaaaaaaatcaataaaaatgaataaatgggacttcattaaaattaaaattatgtgctcaatgaaagaccctggtaagactataaaaagacaagctacaaagtgggagaaaatagttgtcaacataccttacaaaggttttatatctagactatataaagaactctcaaaatacaattaaaaagcccaagcaatctaattacaaaatagggaaaagacaatagacatttcacccaagaggagatagagatggcaagtaagcacatgaaaagatgttcaatatactgatattgaattttaygaaaatgccagttaaaaccataatgagatattattacccacctgtttgaacagttaaaataaaaagtagctaatactaaatgctagcaaggatatggagaaagtggatctcttacatgttgctggtagaaatagaaaatggcacagctactttggaagacagttggacattttttaaaagaagttaagcatgtaacatgatctgacctgtcagttacattcttgagcatttatcccagacaagtcaagatttatattcacagaaaaatctgtacttgtgtgttcatagaggctttatttg

SEQ ID NO: 92317 - DNA, 601 bp, Human
gacttcattaaaattaaaattatgtgctcaatgaaagaccctggtaagactataaaaagacaagctacaaagtgggagaaaatagttgtcaacataccttacaaaggttttatatctagactatataaagaactctcaaaatacaattaaaaagcccaagcaatctaattacaaaatagggaaaagacaatagacatttcacccaagaggagatagagatggcaagtaagcacatgaaaagatgttcaatatactgatattgaattttacgaaaatgccagttaaaaccataatgagataytattacccacctgtttgaacagttaaaataaaaagtagctaatactaaatgctagcaaggatatggagaaagtggatctcttacatgttgctggtagaaatagaaaatggcacagctactttggaagacagttggacattttttaaaagaagttaagcatgtaacatgatctgacctgtcagttacattcttgagcatttatcccagacaagtcaagatttatattcacagaaaaatctgtacttgtgtgttcatagaggctttatttgtaatagcagaataccggaaacaacacaggta

SEQ ID NO: 92318 - DNA, 601 bp, Human
tgaatgggggagtaagtagaaatacaaagaggcagtcagtgtgagggagttcttttgtgataatggaacagttatatattgtgattgtggtggtagttacatgaatctatacacaagataaaattgcacagaactatacatgtacacacatgtacatttttaaaatggcatgtactaggcttctccagagagacagaaccagtaggatatatgtatatataaaagggagtcagttagggagaattaactgacacgattacaaggtgaagtcctatgataggatatctgcaagctggggaargagagaagccagtaatggctcagtccgagtttgaaagccggaaaaccagggaagccgacatggcagccttcagtctgtggctgaagtcctgagattccccgggaagctgctggtgcaagtccaaaggctggtgaacctggagtctgatgtcccagggcagggaaagcggaagcaagcttcatgcactgaaagaagaaagagccagaagactcagcaagcagaattatcccaccttctaacacctgcttgcccacattgagggtgggtcttcctctttcagtccgttgactcaaatgtcag

SEQ ID NO: 92319 - DNA, 601 bp, Human
gagacagaaccagtaggatatatgtatatataaaagggagtcagttagggagaattaactgacacgattacaaggtgaagtcctatgataggatatctgcaagctggggaaagagagaagccagtaatggctcagtccgagtttgaaagccggaaaaccagggaagccgacatggcagccttcagtctgtggctgaagtcctgagattccccgggaagctgctggtgcaagtccaaaggctggtgaacctggagtctgatgtcccagggcagggaaagcggaagcaagcttcatgcactgraagaagaaagagccagaagactcagcaagcagaattatcccaccttctaacacctgcttgcccacattgagggtgggtcttcctctttcagtccgttgactcaaatgtcagtttcctctggtaacactgtcacaaacacacccagatacaatactttaccagccaattaggcatccttcaatccagtcacactgacacctaatattaattatcagagggtgaaaactgaaataaggtctagtctaacactaatgtaccattgtcaatttttttgttttatattgtgctacagttatcata

SEQ ID NO: 92320 - DNA, 601 bp, Human
cccccatgattcagttatctcccactgggtccctcccacaacatgtgggaatcctgggagtacagttcaagatgagattttggtggggacacagagctaaaccagcaactcaagatgatccacgtatgagaattattggacaaagactttaaagcatttagtttaaatatgttccatgaactcaagaaaaacacatttgttttcttccaggtgaaagacatgatagaagtatctcagcaataaaataaaaactataaaagaaacaaatggaaattttaggacggaaaaatacagtattggaaaaaaaaattaaatgtctttgagaggacaaaggagattacataggaataaagtatattcaaattcaatttggatatagatcaataaaaattatcccatgaaaaacagacaaaaagattgaaaaaatgagcagattctcaggaatgaaaaggtgtaacatgcaagtaattggagttccaggtagtgagaatagagacaataggacagaaaagaataatagctccaaacttcccatgtttggagaaatacatgaatttgtagaataaaaaattgcatagtgttacagctcttttagaattgc

SEQ ID NO: 92321 - DNA, 601 bp, Human
aggcgggcagatcacttaagatcaggaattcgagaccagcctggctaacatggtgaaaccctgtctctactacagatacaaaaattagcccggtatggtatcacacgcctgtaatcccagctactcaaggagctgaggcccaagaatcgcttgaacctgggaggcggaggttgcagtgagccaagatcgcaccactgcactttatgtcagtatgaacttctgcagtatttcatacacacacccagtacaccatacatacagctctgtgtggtgaaaataactagaaacagtgaccagcacrtagcagtgagcatccctattgacagattatcgtcctcacatacgatttcctactgcagggaaaacaggctacttggagaaattgctgactcaagatctagataggaagtgtacaagatgagccctgtatgtcttgtcatgccaaatagcaaataagctttcaaagacttttagggtcatgtttgaaggatacaggagtcaaattggaaaggttactagtggcgtaagatgggaaaatttcaaatttaatagggataataatagaaagaaatagaaactcatcagatgtgcctgtattaat

SEQ ID NO: 92322 - DNA, 601 bp, Human
tgaaccattgtaagttagggaccatctatagttaaaaatatagttaaaaactgttacactagagtataggtgaactcaggatgtgcacaattaggaatttttaaatataaatatagttactatattacagttcagttggtatttcagtaactacaaggaatttggggcaactacagagttttagaggaaaccttccagttagaccactccaagttctgacaccaattggaagttcgaggggttcccaaaaccacctcttagttttgataatttgcaagactcacagaactcactgaatgckgttatacttaacagttgtattttattacatggaataccgattttattacatggataccgatttaaatcagccagaggaagaagtattaatatatagggtagagttaaaaaaaaaataccacatgtggagcttacatcattctttcttggtggaattaggacagcccagcatacatatatgatagtgcttaccgagtattgccagccagggaagcccacctaagcctttggtttttatagtttttttagggtggcctcaattacttactgcctgtgtgactgtctttagtctccagccctt

SEQ ID NO: 92323 - DNA, 601 bp, Human
tcttatgggggtaatatttgtaataatcatgcttttggtactgatgttctagtgaagttaaaaaaaaaatcacccatagaatgttgccctttcaatgtaatcgttgttttagaatgctttttttttgagacaggatcttgctctgtcacccaggctagagtgtagtggcatcgtcacggctcactacagctttgacctcctgggcacaggtgatcctctgacctcagcctcttgggtagctgggaccactagcgcaggcgtggaccactattcttggctaatttttgtagtttttgtagcratgaggttgctcacgctggtcataaactcctggactcaagtgttccactggccttgcctcccaaagttctgggattataggcgtgagccattgtgcccagcatagaatgcttttaaagtttttaaaactattattttaaaactaaaatcataaaacttttaacccaaatcttatttacttttgtttagggacaaggaaaattattcattttagaaactttaattagtgtacatgttttgactaatattcaaattatggaaaacttgaataatgtttttacagtaatagatattttatctc

SEQ ID NO: 92324 - DNA, 601 bp, Human
ttgggtagctgggaccactagcgcaggcgtggaccactattcttggctaatttttgtagtttttgtagcgatgaggttgctcacgctggtcataaactcctggactcaagtgttccactggccttgcctcccaaagttctgggattataggcgtgagccattgtgcccagcatagaatgcttttaaagtttttaaaactattattttaaaactaaaatcataaaacttttaacccaaatcttatttacttttgtttagggacaaggaaaattattcattttagaaactttaattagtgtayatgttttgactaatattcaaattatggaaaacttgaataatgtttttacagtaatagatattttatctcttccaaacatttctcagttttcatgaattatcaaagttgaaaataatgttttacctgaactttcctttcactccttttattgacaattcttagtatctggttgtctggctgccacgttatttgcaagacgtcactgactcagagtggttttgaatgccagatgttattttgctgcttcttccagaaaatggaatttgttgggctactgttccacttaacaattgctgtgta

SEQ ID NO: 92325 - DNA, 601 bp, Human
ggacaatcttcttgatgggtgagtggcaaggttctagatgaaaatgtggagtgagagatattattgaggccatgtttgaaaaatatggttttctgtattcataaaacttaaaagttcagggtgccttaattagaaataggattggctacatcttttagaaaattcaaattaataatggtccaaatgtatgaggagggctagtgactgaatgaggtccttctgggctacggccctcacagaagcaactaaaaatctgagcatagcacaaagaccattatcctaaaggcactaaagagtgaayagaagcggggagaacctgattgggaatacatcctcaaagaagatggaggtatatgaaatgacatctcatgttttgcagctctcagcctggggctgggtgaaaatggcatggtgtacattgtggcatgggagaagataacaagaagataagtagaagaactctggtctctatggcctgtgaaagctgaatttggggaaactatgtttgttagagaggggatccaaaatctgtctactgacagctcacatgacccctgagtgatagcttcactcagagctgctcagctaaagacaaaagata

SEQ ID NO: 92326 - DNA, 601 bp, Human
gccttctttactcagttgatagatgttggtcagcagaggcattgaggcacccccactcccgcccctagtgagcactaatgggaattggaatgtgtggcttctcctcactttgtttacactttagagtacagaaagaaccagggtggtccttgtataagttcagcttagttcacatcatactttgccccaaacatttttcttatgactactataaatttagatttaaatgaaaataataggtaagtctgaaggaaaaaggaaacctcagaaggccaagctatagtcttggtcaaatgttttmttttgctcgaggtgataaagtatgtgaatttatgtaagttttacgccttactttcacctggtaatttagtgaaatattcaggccagctagatggaaaagccattttctcttttaccctatgaatccttcaaattctgcctcataccagcattatctattatattgcctcacccccaaaacaaaaataaaacttaaatattttcaaacacaacagatgactagggagaagaaatagcccaccctcctgaggcctcgttatttcgaaggttaggagagtttccgtctgcccaaatagtgacc

SEQ ID NO: 92327 - DNA, 601 bp, Human
ttaaatgaaaataataggtaagtctgaaggaaaaaggaaacctcagaaggccaagctatagtcttggtcaaatgttttcttttgctcgaggtgataaagtatgtgaatttatgtaagttttacgccttactttcacctggtaatttagtgaaatattcaggccagctagatggaaaagccattttctcttttaccctatgaatccttcaaattctgcctcataccagcattatctattatattgcctcacccccaaaacaaaaataaaacttaaatattttcaaacacaacagatgactakggagaagaaatagcccaccctcctgaggcctcgttatttcgaaggttaggagagtttccgtctgcccaaatagtgaccattttaagaacagagacttcagccatggaataaaatgagtaaggatgtggagtgagtcagtaggctacatactttattaaatgtataattgtactcattgttggataaacagagaccaattaatattgtcattttaacatcatggtgcttatctgtgatattgataaccattaactgtttggactaaaatatattgcggactgcagatgatcttagtggctt

SEQ ID NO: 92328 - DNA, 601 bp, Human
aaatgttttcttttgctcgaggtgataaagtatgtgaatttatgtaagttttacgccttactttcacctggtaatttagtgaaatattcaggccagctagatggaaaagccattttctcttttaccctatgaatccttcaaattctgcctcataccagcattatctattatattgcctcacccccaaaacaaaaataaaacttaaatattttcaaacacaacagatgactagggagaagaaatagcccaccctcctgaggcctcgttatttcgaaggttaggagagtttccgtctgcccaratagtgaccattttaagaacagagacttcagccatggaataaaatgagtaaggatgtggagtgagtcagtaggctacatactttattaaatgtataattgtactcattgttggataaacagagaccaattaatattgtcattttaacatcatggtgcttatctgtgatattgataaccattaactgtttggactaaaatatattgcggactgcagatgatcttagtggcttagtgaaaacattttcatattctttgattaaatgattcagacatttacacatgtatttttggtttttaat

SEQ ID NO: 92329 - DNA, 601 bp, Human
acaatttttcctataattaataataggctcaaatttgttttcagttgtttgtcagtactcttaaaatttccttttatgtgtactaaatgcctaacagtacattttcaagtattcgagtacatcaaatcatgtatcaagtcaatttagttcctttctcccaaccttgtaggcagttataattcagcttccttggctctgcattatttatcatatgtatgttctccatctttgaaaattgtgttgacacccatcatcttccattgtcttttcttacattcacttgtgggtttctaccttttarttcttgtattgtcattttactgtagttctggagggagcagagataaacatgtttactcccataaatatttttggggtgatgagggaataagaagaaggatttctgttttctacttttatgtactcctatagtgcatagtattgcatttaattcagtgctgttgcatgctgtaaatgtttaattaatgcttattgaatgttttactttgtcagttgttacattcttatcccaaccctcactctacccccaacatgcttatgggatcctgaaattttatttcctaaaacctgtctttctctc

SEQ ID NO: 92330 - DNA, 601 bp, Human
gtctggagaagcattcatatatgagtactagaagacatttattaaaatattcatccagcattctgtgttttaacaaaataaaaatgggcaacaatcaaaattccgttatcaggagaattgataaattttgatatgtatataattaaaattaattaaaattaatgaattaaaacaatatgtcccaaaatagatgttttagaaacatatatacacacacatatatatgtttggaaacatacacacatatgtttggaaacatatacacacatatatgtttggaaacacacacacatatgtttgkaaacatacatatatgtttggaaacacacatgtttggaaacatacacacatatttatgtttggaaacatacacatgtttggaaacacacacacatgtttggaaacatacacgtttggaaacaaatgtttggaaacatacacacgtttggaaacatatatgtttggaaacacacacatatgtttggaaacacacaaatatacacacacatatatgtttggaaacacacacacacacacacacacacacacacacacatatatatttattttattttatttttttcttttggagacagtttct

SEQ ID NO: 92331 - DNA, 601 bp, Human
caaaataaaaatgggcaacaatcaaaattccgttatcaggagaattgataaattttgatatgtatataattaaaattaattaaaattaatgaattaaaacaatatgtcccaaaatagatgttttagaaacatatatacacacacatatatatgtttggaaacatacacacatatgtttggaaacatatacacacatatatgtttggaaacacacacacatatgtttggaaacatacatatatgtttggaaacacacatgtttggaaacatacacacatatttatgtttggaaacatacacttgtttggaaacacacacacatgtttggaaacatacacgtttggaaacaaatgtttggaaacatacacacgtttggaaacatatatgtttggaaacacacacatatgtttggaaacacacaaatatacacacacatatatgtttggaaacacacacacacacacacacacacacacacacacatatatatttattttattttatttttttcttttggagacagtttctcattccatcacccaggctggagtgtagtgacacagtcacggctcactgcagccttgacctcccaggctcaggt

SEQ ID NO: 92332 - DNA, 601 bp, Human
ggagaattgataaattttgatatgtatataattaaaattaattaaaattaatgaattaaaacaatatgtcccaaaatagatgttttagaaacatatatacacacacatatatatgtttggaaacatacacacatatgtttggaaacatatacacacatatatgtttggaaacacacacacatatgtttggaaacatacatatatgtttggaaacacacatgtttggaaacatacacacatatttatgtttggaaacatacacatgtttggaaacacacacacatgtttggaaacatacacttttggaaacaaatgtttggaaacatacacacgtttggaaacatatatgtttggaaacacacacatatgtttggaaacacacaaatatacacacacatatatgtttggaaacacacacacacacacacacacacacacacacacatatatatttattttattttatttttttcttttggagacagtttctcattccatcacccaggctggagtgtagtgacacagtcacggctcactgcagccttgacctcccaggctcaggtgatcttctcacttcagcctcccaaatagctgggatcgc

SEQ ID NO: 92333 - DNA, 601 bp, Human
gtgacacagtcacggctcactgcagccttgacctcccaggctcaggtgatcttctcacttcagcctcccaaatagctgggatcgcaagcatgtgccatcctgcccagctaatttttcatttttattttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcartgcacagtttggtgtcatttataaagacattttaaaaagtacatagttttatgatgttgtatataggcataatagtataaaatatgcatggatacagcaaacaccaaatttaggatagtagctgtgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataatt

SEQ ID NO: 92334 - DNA, 601 bp, Human
cctgcccagctaatttttcatttttattttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcaatgcacagtttggtgtcatttataaagacattttaaaaagtacatagttttatgatgttgtatataggcataatagtataaaatatgcatggatacagyaaacaccaaatttaggatagtagctgtgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataattactatctataaaataagcaaagatattattgatgcatataaatcctgtctttgcagttcctttaatctcctttacaatctaagaagtactataccagt

SEQ ID NO: 92335 - DNA, 601 bp, Human
ttttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcaatgcacagtttggtgtcatttataaagacattttaaaaagtacatagttttatgatgttgtatataggcataatagtataaaatatgcatggatacagcaaacaccaaatttaggatagtagctrtgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataattactatctataaaataagcaaagatattattgatgcatataaatcctgtctttgcagttcctttaatctcctttacaatctaagaagtactataccagtagaagtaattcgtagtgactgtatag

SEQ ID NO: 92336 - DNA, 601 bp, Human
aaaatatattcacataatatgctttatgtatatgtatatagtttataattactatctataaaataagcaaagatattattgatgcatataaatcctgtctttgcagttcctttaatctcctttacaatctaagaagtactataccagtagaagtaattcgtagtgactgtatagcttaatttttaagataaagaataaaatattttttcctcatctaaaaatggtcttagtaattgctaagcttccttccagaactaaactgtacttctttgatgtttcccctacagcagatctttttcarcaggttagaatacagtcaaatgttgaggattataaagctaataccctatacagattgttgttttcaatcaccctgtctctctttagcaaccatctatcatctacaataggggtttgaaaactttttctataaacagcctgagagtaaatatgttaggctttgtaggccatgtggtctgtgtcacagctactcactttgcctttgtagtgtgaaagcagacataggcaatacctaaatgaatgggcatggctgtgtttcaataaaactttatttacaaaaacaggcagcaaaccagatttg

SEQ ID NO: 92337 - DNA, 601 bp, Human
tgcagaaagtaggtctaccatagtcacattggaatctgtgtaaatcaaaaggaaagatagtaagattaatttaaccagaatgaaaattaccacactactttttatctctagaagaatactgaaattacatgtgtttgagaaagttttaatatgaatcagaaccaggatttgaattaataaagtaattaaatagattttcttagaatattacttttaaaataagttgagatttttttctgacaaaaagaatatcttaccaaacaatgaattgtttatttttccactaaaaattgaatttatktattttttcagagacattaaacctgacaatatactgatggatatgaatggacatattcggttagcagattttggttcttgtctgaagctgatggaagatggaacggtaaataaagataaatcctaaattattttgttcacagacatttcccttgctatttgtctgatatatctgttttagaaaccatctatttatactatctacccatccatccatttgtctatctatgcgccacctccttccacaaaggcatttgggcatacttacagtggggttgtctaaaaagtcacaagccatttc

SEQ ID NO: 92338 - DNA, 601 bp, Human
tagttggtgacttctgttgtactttagatatttcaaagttcaccgggggtaaaagaactaagtctcacatagaaaaagaaaacgcagctttgcccgcacttttacttttttgtctttctttcctaaattgcttagttattctaagggatagtgttcaacaaatgaatccctttttcagaaagttcacaagttgatttagtttcatgttcccatttgcttaacttttgctaaccctaaacccgtcagttggttttttttgtttacttaatagctgggcatggtggtgcgtgcctgtagtccyagctactgaggagtctgaggtgggaggatctcctgagcatgggaggcagaggttgcagtgagccaagattgcaccactgcactccagcctgggcaacagtgaagtcctgtctcccaccccctcactcccccagagccacccagaaaaaaaaggctgggcatggtggctcacgcttgtaatcccaacactttgggaggctgaggcaagagcatcacttgagtccaggagtttgagaccagcttaagcaacatagtgatactctgtctctgttttaaagaaaaaaaaaagtttatatgccac

SEQ ID NO: 92339 - DNA, 601 bp, Human
actggatacaatagttgaagctactgttttccagcagtggacaacaggcagcataatactattatccctgacataaatgaactcgtgaggtattcctcacgattgcgcaaagactggggcagttcctgactctgatgcagaaagctagagtgaaagcagagctggactacctgcagcagctggaatatgcagggcttggcattggagaggagggaattgtgcagagagagggcataaagtgcctcatgaaggttgggctgtgcattgtaccacaagaccatatgaggcttgacaatagcaratgatagcatttgaaaacagaccagaatactaatgatcaagcagatctcccaggcaggaaacagtgctaggggaaattgaattttcatccctggagagccagctaacacctttgtatcacctaagacctactctctaacaacctaagtccaagccctgattagatccatagagtttggaagtcttccttccaagtagaggggcttatgacaaatcttagatttttgtatgaacctacaatcacagagtgtatctgtaagctaactcatggtcaaggagatcagtcagtaatttttttatg

SEQ ID NO: 92340 - DNA, 601 bp, Human
acctcatctctacaaaaaaatataaaaaattagttaggcatggtggcatgcacctatagtcccagttactcaggaggatgagatgggaggatcgcttgagcttgggacctggtcaaggctgcagtgaccgtgatggtgccattgcattccagcctgggtggcagcaagatcctgactccagaaaaataaataaataaaaataaataaaaataaaaaaaaactataatgaagaaactttattttatttcagatttttaaattaatttttagattttattgtcttattttttgaggcagggtyttgctctatcacccacgcaagttcagtggtgctttgagcatttcatttacttacatatttcccataaccatatttgtgctgctgtctcttgattatttatttttagatactaactcatactatcctaccatggtagatgaggattcaggtcttttgctctgctcttgcccatccagtacacatcctctctatcctcccaatgtaattatcacacaatacctcgttaaatcctgtttggtattttattatgacaatacaaatactcatcgtcgtgtcatagtttttttaaattgcatttct

SEQ ID NO: 92341 - DNA, 601 bp, Human
ttgtttagttagttattcctggtttcagtttactgtagattgggtctatttggtatcagatttttttggcattttttgaaatttgctttgtgattttgtaacaggccagtttttatatgttctatgtttatttgaaaagaatacttttttttttctaacttttgggtacagatgtatatgcccataagattaaaattgctaattttgtcattcagtttttttgtgttcttaaccattttatttctctgatctatttattcgttttttaaaaatccttatgatggtaaatgtgttaactttyctttgtaatcatcaatgttttgcacagctcttttgtagctttgctgttaggtatatattattcagaattgacatttcttccagggtattttcttttatattatattaatgaattttaaaaaaatcttacaatgattttggcatgaggatatatttaattgatattactgtagctaccttaagtttcttttctttatcatatgcctgatatatccctttccatccatttacttttaactttcctgcgtccttatgttttaagtgcatcccttttaaacagattattgctgatgtttttccc

SEQ ID NO: 92342 - DNA, 601 bp, Human
ttttctaacttttgggtacagatgtatatgcccataagattaaaattgctaattttgtcattcagtttttttgtgttcttaaccattttatttctctgatctatttattcgttttttaaaaatccttatgatggtaaatgtgttaactttcctttgtaatcatcaatgttttgcacagctcttttgtagctttgctgttaggtatatattattcagaattgacatttcttccagggtattttcttttatattatattaatgaattttaaaaaaatcttacaatgattttggcatgaggatrtatttaattgatattactgtagctaccttaagtttcttttctttatcatatgcctgatatatccctttccatccatttacttttaactttcctgcgtccttatgttttaagtgcatcccttttaaacagattattgctgatgtttttcccatttgttcattttggttttgtgtgttgtcctgtgtaacaggtttgtttaacaggtgaatttaatccatgtataaattttgtgattattaatatacttatttctagtatcttacgtgcagtttattattggttttgcttgtttctttgcat

SEQ ID NO: 92343 - DNA, 601 bp, Human
acagagttaaaattttccaagatgaaaaaattttagagaaggatggtggggactggttgcacaacagtgtgaaggtacttatgccattgaactgcacacttctaaaaatcattaagatagtaaattttatgtctatttttaccaccattaaaaataataattaaaaatttaaaaaacctaagaaatttagaatacttgaatcctgtttacaccctcagtaatatgtttttgtttttccagtgtttaatttccaacttctttttttttttctttttttttttttcagggaggtaaagtgggkggtttttaaaaatttttatttttctatttgtaaactgacaaattatagttgaacacatttatggggtaaacttatttttcagccctaaggtggttactcctgcctctttttctagtccttgtcctccttcttcttcattatgttatccaattaaccaccatttaaatgaattagtaaagtttactaatatctttgttcataattgcttctagtatcacattcttccatcttggttaaatttcttgttttccgaagtataccctttagtgcttgtttagccgaaaggaaatgttagcgata

SEQ ID NO: 92344 - DNA, 601 bp, Human
ttcttctaaaacatgtaaagggctaatattcttttacttcaaagtaccttacaacatgcatacccaggatttttctagttacctgttttattttttcttccacttttttacagagatagggtcttgctgtgttgcccaggcttgtctcaaactcctgggcccaagtgattctcccacattggcttcccaaagtgctgggattacagatgtcagctcccatgcctggttttaattacctgttttctaattaaacctaacctgctataacaagtactcaactttttttctctattggaacttyagattttgaaggatatacctcttcttttatagttttttaaattagtaagtagtttgttgtacattattgacgtgtattttcttaggtttctattaaggagtttgaacataatctccaggcttctcatagtgttggcctaaatatcaggagctttttccccccatctcattgtacaattttgacggtttcatttttttttttttacacgtataggtttgacaggtaattatcaataatgagtgttctaaaccaaatattcagtttgttcttaattggtatgatggtttaaattaaattgtt

SEQ ID NO: 92345 - DNA, 601 bp, Human
acatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgtaagtatgacactgtgaagaagttctgtccctctgtttctttctactatggttatatagtaattttttggtttataagtattttgctaggatgattttacaatgatcagttattagtcagtgatcatggcttcyggtgcttattctgtcacaaatcaaattaagaagaaagttaactgaggtgaacatagttatttgtgactaagaacaaaattaaaattcaaagttttacctcttagataagttatgccattaagcttcgtaagagaacaaattagatatttaaaaaagcagattttatgattgtaaagtgcagaggttggcaaatttctccctaaaaccataaaactggacaaaattatcaaaatcaaccatgtcagggcctgatacaacaattgaagagaaataaattgagaagcatttatttgtgaaaaa

SEQ ID NO: 92346 - DNA, 601 bp, Human
gaaacagtgaatactatttcaatacaataagctgtgatcactgtttgataactgataattgtaaaaccatcctagtactgtattcaaggcagataaaaatttctcatactttcctgtctaaacttcacaaagaataattaaactgacttctcttaccaattttttataaatagaattatatttactgttaacaaattatgaatcattccaaattaaatacatagtacagttgatcctaattattcatggtggttatgttctatatagttgccttgaacactgttagctaatattgaaccawtgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcgctaggaacactagacagcgcttcagcactatgcttgggagcctttgcaagcagtgaatcacataca

SEQ ID NO: 92347 - DNA, 601 bp, Human
atcactgtttgataactgataattgtaaaaccatcctagtactgtattcaaggcagataaaaatttctcatactttcctgtctaaacttcacaaagaataattaaactgacttctcttaccaattttttataaatagaattatatttactgttaacaaattatgaatcattccaaattaaatacatagtacagttgatcctaattattcatggtggttatgttctatatagttgccttgaacactgttagctaatattgaaccaatgctctgagggaaatacagggttaggtttctgtgaccctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcgctaggaacactagacagcgcttcagcactatgcttgggagcctttgcaagcagtgaatcacatacagagggcccaaaaatgtgaaatgcatgacaccaaaga

SEQ ID NO: 92348 - DNA, 601 bp, Human
tatttactgttaacaaattatgaatcattccaaattaaatacatagtacagttgatcctaattattcatggtggttatgttctatatagttgccttgaacactgttagctaatattgaaccaatgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgartgaagcttttctagcacattattttctccataaaggcacatcactgtcctctggcgctaggaacactagacagcgcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcataggacatctcaaatttttctctgctctgcacgtgtctacaaatgatcataaa

SEQ ID NO: 92349 - DNA, 601 bp, Human
cctaattattcatggtggttatgttctatatagttgccttgaacactgttagctaatattgaaccaatgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcrctaggaacactagacagcgcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcataggacatctcaaatttttctctgctctgcacgtgtctacaaatgatcataaaattaccacaagtattgatttggggtttacaaataaatattagcttctacacaaatt

SEQ ID NO: 92350 - DNA, 601 bp, Human
ttatgttctatatagttgccttgaacactgttagctaatattgaaccaatgctctgagggaaatacagggttaggtttctgtgagcctctgatcaactgatcaatatatagtcttgttttatgtgtgcttctctttaaagacactttatataacatatgttgttgattcattaacactgaactcaccactgaactcaccaccagcagcactgtaactcgtgcctgaatgaagcttttctagcacattattttctccataaaggcacatcactgtcctctggcgctaggaacactagacagygcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcataggacatctcaaatttttctctgctctgcacgtgtctacaaatgatcataaaattaccacaagtattgatttggggtttacaaataaatattagcttctacacaaatttgcaaatacagaatacat

SEQ ID NO: 92351 - DNA, 601 bp, Human
cactgaactcaccactgaactcaccaccagcagcactgtaactcgtgcctgaatgaagcttttctagcacattattttctccataaaggcacatcactgtcctctggcgctaggaacactagacagcgcttcagcactatgcttgggagcctttgcaagcagtgaatcacatacagagggcccaaaaatgtgaaatgcatgacaccaaagagaccctgtagaggacacttgtttataatatgagagcttaaatgagaaggcagagcctctcctgttcaacctcagctgggaatgtgagcayaggacatctcaaatttttctctgctctgcacgtgtctacaaatgatcataaaattaccacaagtattgatttggggtttacaaataaatattagcttctacacaaatttgcaaatacagaatacatgaataataatgactgtattctcaatatcagactttgaatcttcattttactttaattagaattttagagtagcagtgttcatggtctaaattttatatcactaaacaactataccaaacttaccagtgttttaaaattgaacagtcacaatttttttttaaatatttctttttg

SEQ ID NO: 92352 - DNA, 601 bp, Human
atattctctagatgtcaagcaggagaactttcaacccattaattctaccatcctttcactgaccctcacttcacttatattccctatttcccccttaccctgtttaaattccattgagaatgattataatcactccttgtatgccatttcagttcctttgactgtctctcattctgttatatttgttttgctaagtgaacattaactattacaattttattctctacctgtacagttccaaatgactagaaaaaatagctgactattcttactggtctactttaaattcatgattaccaayctcaagtcccccttgtctgacaaatgtactgtattaccctagtatattcactcttccactcacctagtaactattttttactttctttttttttaagagatggggtcttgttctgggcagcagaagggctggaatgcagtggtgcagtcctagctcactatagcctcagactcctgggcacaaatgatccccctgcctcagcctcctgagtagctgggacaataggcacaagccaccatgcccagctaatttttaaaacgatttagaaatggagtcttgctgtgctgtctaggctggagt

SEQ ID NO: 92353 - DNA, 601 bp, Human
agtgaacattaactattacaattttattctctacctgtacagttccaaatgactagaaaaaatagctgactattcttactggtctactttaaattcatgattaccaacctcaagtcccccttgtctgacaaatgtactgtattaccctagtatattcactcttccactcacctagtaactattttttactttctttttttttaagagatggggtcttgttctgggcagcagaagggctggaatgcagtggtgcagtcctagctcactatagcctcagactcctgggcacaaatgatccccytgcctcagcctcctgagtagctgggacaataggcacaagccaccatgcccagctaatttttaaaacgatttagaaatggagtcttgctgtgctgtctaggctggagtgcagtggcacagtccatagataactacagcctcctactcctcaagccgtcctctggccttaacctcccctgttgctgggattacagatgtgagccactgcatctggcctatttctttctacttgagtttgaaacctctgtcatcctcactttcagcttgcatctcctttcactgaaaggattgaggcaaaccg

SEQ ID NO: 92354 - DNA, 503 bp, Human
tactcaactccatccacacaggcctcctttctgggctgtgaacatgccagacatactcttgtctcggggctttagtacttctgtttcatctgcttggaacattctttcttttgatattcccttaactggtcccctcacccttacttagctttttccaaagttactttagcagtgacagctttcctaacttctttatctaaatttttatctcctcctcttcaatactttatttctccctttcctgctttatgttttctccttagcatttaacattttctaatgtaatgaatatctccattaktttctttatttctgtctcagtcactggaatataagctctatatgggcaaggatttttgtctgttttgttcaccaccaaatgtccagcagtttcagcatttttatttaaattgtattgaattaaagacagaaacttgcttttgaatttcaaattctagtaaagagggccgtggttggtgctttgactactactgtttcaccta

SEQ ID NO: 92355 - DNA, 601 bp, Human
accttcagtgattgtttactccacctggtttcatccagtccatcctatggtaataagatatgtcttaagattacaatacctaaaactcttctttaatcgcagtttccagcaaatcttttataatctcctgctcataatttttagtgctctctctctgaccccttaactccagtatttcttcactgccaccgttacctacaagtctatcaccgtttaactctgctatttataccctcatttttcgttctctggtcagccatagtcataccctggcatataccttcaaatctattgttcctcwttctctttgtcaaatacctttggcagaaccccaactgtgtttgaatacaactttgtatcttcaactatccagctgaagacagcttgcttaaaacacccacaacgtgctgactaatattaattcagattcacagacactcacctcaagtcagctcttcatgctatttcccctagtctatttccctatcctgtgttgtaaaatccagtgatgatttctgtcttcaccttttaacctatcagcaatatttgaccctatggaccttttattccttctgataacgctctctttttttttttttgg

SEQ ID NO: 92356 - DNA, 601 bp, Human
tgtaactaatcagagttttacaatcacaaaactttactgtcatacttttagaggcccagtagagaaaaaggctgtgtagacatcaatagaatggactattttctgtttttccgtaagttgttaagatctctgcatatgaattacttcccttttgtgactgaaatttttctgtttcttttttttcctgtggtgatacacatatagcaaagtgtgcaagcattctacttttaagtataagcctaataaatatttgtatatgtatacactgatgtaaccttcacccatattcatgtgtagaatwtgtccagcatagggtaaagtcctcacatgtcccttcccagtttgtaacctaccactatgaaataaacatcatcctaagttctttcaccattaatgaatttttaccggtttttgatcttcatataaatggtatcatacagtatattctcttttgtgtatggcatctttcacttgttttttgaaattcacccatgttttgtatatatcagcagtttgctcttttttttttttgtactgctgtttagtatttcattgtatatcagcaataaaaaattacccagtctgttgttggtaaatattt

SEQ ID NO: 92357 - DNA, 601 bp, Human
cttcccttttgtgactgaaatttttctgtttcttttttttcctgtggtgatacacatatagcaaagtgtgcaagcattctacttttaagtataagcctaataaatatttgtatatgtatacactgatgtaaccttcacccatattcatgtgtagaatttgtccagcatagggtaaagtcctcacatgtcccttcccagtttgtaacctaccactatgaaataaacatcatcctaagttctttcaccattaatgaatttttaccggtttttgatcttcatataaatggtatcatacagtatrttctcttttgtgtatggcatctttcacttgttttttgaaattcacccatgttttgtatatatcagcagtttgctcttttttttttttgtactgctgtttagtatttcattgtatatcagcaataaaaaattacccagtctgttgttggtaaatatttgggttatttccagatgttgactactgtgagtaaagttcgtgcaaatatacttatctatttattttggtggtcctatgtactatttctctcagatatatacctgggagtacaatttctgggccatatagtagaggattttcagc

SEQ ID NO: 92358 - DNA, 601 bp, Human
aacatcatcctaagttctttcaccattaatgaatttttaccggtttttgatcttcatataaatggtatcatacagtatattctcttttgtgtatggcatctttcacttgttttttgaaattcacccatgttttgtatatatcagcagtttgctcttttttttttttgtactgctgtttagtatttcattgtatatcagcaataaaaaattacccagtctgttgttggtaaatatttgggttatttccagatgttgactactgtgagtaaagttcgtgcaaatatacttatctatttatttyggtggtcctatgtactatttctctcagatatatacctgggagtacaatttctgggccatatagtagaggattttcagctttagaagatattttcaaagagttttctaaagtgactataccaatatatagttctactaataatgtatgagttctactgtcttcaactcctcaccagaacttatcgtccgcgtttttcacttgtagccattctggtagaagtatagtgatgtcctgccgtgattttaatttgcatttccctgatgaataatgaggttgaatatcttttcatgtatttactat

SEQ ID NO: 92359 - DNA, 601 bp, Human
tttcattccatcaagaattgagcttggacaagactaaattgctttttttttttttttttggagacagagtctcgctctgtcgcccaggctggagtgcagtggtgtgatctcggttcactgcaacctccgcctcccaggttcaagcaattctcctgcctcagcctcctgagtaactgggactacaggcacgtgccaccatgcctggctaattttttgtatttttagtagagacaaggtttcaccatgtaagccaggatagtctcgatctcctgacctcgtgatccgcccgtctcagcctccmtaagtgctgggattacaggcaagagccactgtgcctgcccctaaattgcatttttaattagactcaaccctacctttgatttcaaatgcccagaatcgggagctggatagagcctagttgggcctctttctccttcacttcctaaactatgggagatttattctgttcttcagccttctgccctataccatttccaaatttggtgtcttgatgaagagactggccatgtatttgaagcagattctcttcctcaagcagctctttgtctctgaaataattctgtactatcggagatttctg

SEQ ID NO: 92360 - DNA, 601 bp, Human
aagagtaagatagggaagacaagtggataaccacataagcaggaaatggtcatttcagtagacctaggaattttgaggaaagaggtggcaataatgagcgaggatgcctgccccaccttcatacctgtggtaggtggggtacaggaggaaaagtagctcctattaatgtccatttggtattctttggtcttttgtttgtttgttttttttgagacagagtctcgatctatcacccaggctgggtgtagtggcatgatctcagctcactgcaacctctgcctcccaggttcaagcgtttctyctgcctcagcctcccgagtagctggtattacaggcatgcaccaccatgcgtggctaatttttgtatttttagtagagacggggtttcaccatgttggccaggctgatctcaaactcccaacctcaggtgattcatctgccttggcctcccaaagcgctgggattacaggcatgagccaccgcacctacacctcccctgcattgggtatttttatgtctccccattttctacccccaatttagatgtcttaaaaaataaaaacaatggatgttcttttcaaaataataaatacggaaagga

SEQ ID NO: 92361 - DNA, 601 bp, Human; identical to SEQ ID NO: 81866

SEQ ID NO: 92362 - DNA, 601 bp, Human; identical to SEQ ID NO: 81867

SEQ ID NO: 92363 - DNA, 601 bp, Human; identical to SEQ ID NO: 81868

SEQ ID NO: 92364 - DNA, 601 bp, Human; identical to SEQ ID NO: 81869

SEQ ID NO: 92365 - DNA, 601 bp, Human
ctgccaacaccaggcaacgatgaaaaggtgcccccttctactcctgagccatctatccccacttccactcctgggctatttattctctcttcagatgggatctgttttcagaatactttaaaaatgacatgtccacttcatgagaaatatccaaagacaacagagtcaccgacgtggccacagaacacattggtttccttgtgaaattctgcctacactcactgaagacagtgacgacagtgaaagaactagtgcctcgggtgtgggctgtggccaagaggacaaagagtcactaggtagrgaaggatcttcaaactctctggttatctcatttctaccatcacattcatttgcagctaatcgtccagcaatgatgctgtatctgatatacacctagaaaaatgtcctccaagtcctgacagccagctttggaaattcttaacttaaaactttcccatatcatgacccagagaccatacttccagtgttgagaattacttctaaaaaacaaaacaaaagcctacattaaaatggtccagattttcttagataatgaacaaggaatacacatttgatgaatttcccatcacagagactctac

SEQ ID NO: 92366 - DNA, 601 bp, Human
gagatgatgacaaaccagtaggaactggtaaacctgctacgttgcaggtagggatgaaaggaccccaaaagggtgctctatttttttttctactgctgtttaaagatttcaactcaatactttaaatttactcaacaatcttagctcatactattttgtccagaatcagaccgtgcaccaatatactaattccctcttgccctccaaacagaaatgaatactatttagtatgatattatgaataatattcagtaggataaaagctccaggctacagcttggctaactccaattcttaaaamctatacataatttgcctttcttttgtaagctgtaggtggataacaggtagggtgatgtgaacacaggacaaagtcccaaaagaggcacaaagaaagaacccacttagaggaaggtggggaaataaactgtgagtcccagttaatcctcactgttagactccttttgctctccacatcatctctgaaagtccattttggaatttaaaagaagtctttttggttttcagaactatcccaaattcctggaagctgctttgggtcatttcaacattcagtccagattactgactctgaaatcta

SEQ ID NO: 92367 - DNA, 601 bp, Human
acacgaggggatagtcatcttctgtgagaaacagtggcaccttttcccaaagacaaatagttaagacatcactcctattttttcagctgccccaagtaattgctcttttgacgtttttgaaaaagttccccaaagctgaagagcctctcagtaaaaccaaaaatcaaaagcaccaattaagcgcaaagcgagtttgggtggagtcttcatcctggatgccaaggaacatgaaaatggaaggtcaagttcccatgtgccgcagagatgatgacaaaccagtaggaactggtaaacctgctaygttgcaggtagggatgaaaggaccccaaaagggtgctctatttttttttctactgctgtttaaagatttcaactcaatactttaaatttactcaacaatcttagctcatactattttgtccagaatcagaccgtgcaccaatatactaattccctcttgccctccaaacagaaatgaatactatttagtatgatattatgaataatattcagtaggataaaagctccaggctacagcttggctaactccaattcttaaaacctatacataatttgcctttcttttgtaagctgtaggtgg

SEQ ID NO: 92368 - DNA, 601 bp, Human
aaatggatacacgaggggatagtcatcttctgtgagaaacagtggcaccttttcccaaagacaaatagttaagacatcactcctattttttcagctgccccaagtaattgctcttttgacgtttttgaaaaagttccccaaagctgaagagcctctcagtaaaaccaaaaatcaaaagcaccaattaagcgcaaagcgagtttgggtggagtcttcatcctggatgccaaggaacatgaaaatggaaggtcaagttcccatgtgccgcagagatgatgacaaaccagtaggaactggtaamcctgctacgttgcaggtagggatgaaaggaccccaaaagggtgctctatttttttttctactgctgtttaaagatttcaactcaatactttaaatttactcaacaatcttagctcatactattttgtccagaatcagaccgtgcaccaatatactaattccctcttgccctccaaacagaaatgaatactatttagtatgatattatgaataatattcagtaggataaaagctccaggctacagcttggctaactccaattcttaaaacctatacataatttgcctttcttttgtaagct

SEQ ID NO: 92369 - DNA, 601 bp, Human
ctaacaaacacgcaccagcggaagggctgcgtgaagacatgagtgaatgcgagcaaatgaggtggctgcaggctctcactcggggcatgatgaaatttccaagactgttctaagagagctcttcagagaggtcatgtgagaacactgaaaacaggccgattcaacggagccaattattcactggatttattaattcttaaaagagaaaggttagcatggatttatagctctaacaggaagtgggaggtagagaagcccactcacctccctctccagactcagggaagggaatgagaaggtgccacacagagccctggcaggaccgagggccacacaggctgcctggccgccgtcccagacctgtggccacatgagatttaggtttcgatgtggcacagcttcaaatggatacacgaggggatagtcatcttctgtgagaaacagtggcaccttttcccaaagacaaatagttaagacatcactcctattttttcagctgccccaagtaattgctcttttgacgtttttgaaaaagttccccaaagctgaagagcctctcagtaaaaccaaaaatcaaaagcaccaattaagcgcaaagcga

SEQ ID NO: 92370 - DNA, 601 bp, Human
ttgagaggccgaggcaggcagatcacctaaggttaggagtcaagaccagcctggccaacatggtgaaacctcatctctactaaaaatacagaagaaaatttttagccaggcgtggtgatgcacgcctgtattcccagctatgcaggaggctgaggcaggagaatcacttcaacctgggaggtggaggttgtagtgagccaagatcgcaccacagcactccagcctgggtaacagagtgagactctgtctcatttaaaaaaaaaaaaaaaagatgctaaggaaagaacctgagcatttctcyccccagcccccacaatatgaagaattaggtacaaagcactccagagccccggaccttaggtttggtttggcagctgcagcagaaagtgatggttcctagtgatacaactcagaattaaagtaacttgtacatgccagtttcttagaaaatgaatgaagttatcattttaaaaaaagaagagcctgcccaaaagaaacagcataagctaacaaacacgcaccagcggaagggctgcgtgaagacatgagtgaatgcgagcaaatgaggtggctgcaggctctcactcggggcatgatgaaa

SEQ ID NO: 92371 - DNA, 601 bp, Human
gcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcrgggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcg

SEQ ID NO: 92372 - DNA, 601 bp, Human; identical to SEQ ID NO: 30272

SEQ ID NO: 92373 - DNA, 601 bp, Human; identical to SEQ ID NO: 30273

SEQ ID NO: 92374 - DNA, 601 bp, Human; identical to SEQ ID NO: 30274

SEQ ID NO: 92375 - DNA, 601 bp, Human
atgcctatctgtaaaatgagggggttgaatgagacgacgtctgaaggctcctttcagctcagacattccatgattccatggtgcatttaaaaagtattagcaattaaagtcatagcatgactttttaataaccagaatctgccatgctcctaaatcaggccaaaaaggcttgaattaggcaagcaggaaaacagggcccagattatacatgtgtcgagatgacaggagacccaggtagcacttaagcctgtgcgtcggagctgggctcatgggccagcacatatactttgcctgcttttaygaggggataataacactcatttgtggtccagctcccagtcctgtgcagctccaccatggccgcagggcaaggtcataggcactacttcagccctagaattccatagactttcagtccaaggtagctcacccccaggttctgcttgaatacctgtgatgacaaagagctcactacctgtccaggggcctcctgccctcttttggctgttaagaaaatccctgggtgcagggcaggtcatgaaggggacaagaaagaccaggaggctgagaagtgattcctagaaactgctccctcaaacag

SEQ ID NO: 92376 - DNA, 601 bp, Human
aaaaaattagccaggcatgatggcggatacctataatcccagctactcaggaggctgagatgggagaatcacttgaacccgggagacggtggctgcagtgagccaagatcacaccactgcactccagcctaggcggctgggcgaaactccatctcaaaaaaaaaaaaaaaaatgtaggtgctttatcaacaatagaaatgtatttctcacagttcaggaggatggaagtccaagactaagacagcagatttggagtctggtgagggcccacttcctgggtcatagaatggcgccttcttastgtgtcctcatgtggtggaggaggtgagggtctctctggggcctcttttataagaacactaatcccattatgagggctctgccttcctgacctaattccctctcaaaagccccacctcttaataccatcaccttatggggtaagatttcaacatatgagctttggaggaacataaatattcagaccatagcaatctcgcaggaatcacaccaatattcaaatctggccatgttcctacccaattcaaaagccttccatggctccccgctgaccctggctgaaagtcctagattctccatg

SEQ ID NO: 92377 - DNA, 601 bp, Human
cttgcagtgagccgagatcgtgctgctgcactccaccctgggcgacagagcaagactccatctcaaaaaaaaaaaaaaaaaaaaaaaaaaattagccaggcatgatggcggatacctataatcccagctactcaggaggctgagatgggagaatcacttgaacccgggagacggtggctgcagtgagccaagatcacaccactgcactccagcctaggcggctgggcgaaactccatctcaaaaaaaaaaaaaaaaatgtaggtgctttatcaacaatagaaatgtatttctcacagttcrggaggatggaagtccaagactaagacagcagatttggagtctggtgagggcccacttcctgggtcatagaatggcgccttcttactgtgtcctcatgtggtggaggaggtgagggtctctctggggcctcttttataagaacactaatcccattatgagggctctgccttcctgacctaattccctctcaaaagccccacctcttaataccatcaccttatggggtaagatttcaacatatgagctttggaggaacataaatattcagaccatagcaatctcgcaggaatcacaccaata

SEQ ID NO: 92378 - DNA, 601 bp, Human
tgtagtcccagctactggggaggctgaggcaggggaatagcatgaacccgggaggtggagcttgcagtgagccgagatcgtgctgctgcactccaccctgggcgacagagcaagactccatctcaaaaaaaaaaaaaaaaaaaaaaaaaaattagccaggcatgatggcggatacctataatcccagctactcaggaggctgagatgggagaatcacttgaacccgggagacggtggctgcagtgagccaagatcacaccactgcactccagcctaggcggctgggcgaaactccatctcaaaaaaaaaaaaaaaaatgtaggtgctttatcaacaatagaaatgtatttctcacagttcaggaggatggaagtccaagactaagacagcagatttggagtctggtgagggcccacttcctgggtcatagaatggcgccttcttactgtgtcctcatgtggtggaggaggtgagggtctctctggggcctcttttataagaacactaatcccattatgagggctctgccttcctgacctaattccctctcaaaagccccacctcttaataccatcaccttatggggtaagatttcaacata

SEQ ID NO: 92379 - DNA, 601 bp, Human
taagtgtttgttaaatatataagcccagggtcagcctggcttcctcctcatcctcctcctgctcacctggcctggaccccaacctctcccctagcactgagctcactgcccaggtcccacagcagcactccaggcctggactatttctacagccatctctctgcacctgtcttcgtccgttgctgcagctacaacaaaatatcataaattgggtgctttggccaggcgcggtggctcacgcctgtaatcccagcactttgggaggctgaggggggcagatcatgaggtcaggagattgagrccatcctggctaacactgtgaaaccccgtctctactgaaaacacaaaaacaaaattagccgggcgtggtggtgggcgcctgtagtcccagctactggggaggctgaggcaggggaatagcatgaacccgggaggtggagcttgcagtgagccgagatcgtgctgctgcactccaccctgggcgacagagcaagactccatctcaaaaaaaaaaaaaaaaaaaaaaaaaaattagccaggcatgatggcggatacctataatcccagctactcaggaggctgagatgggagaatcacttga

SEQ ID NO: 92380 - DNA, 601 bp, Human
taacaaacagtatgtaccctataggttgttatggggattgggttaacgtatataaaatattagatggtggtaagaagtgctaataagtgtttgttaaatatataagcccagggtcagcctggcttcctcctcatcctcctcctgctcacctggcctggaccccaacctctcccctagcactgagctcactgcccaggtcccacagcagcactccaggcctggactatttctacagccatctctctgcacctgtcttcgtccgttgctgcagctacaacaaaatatcataaattgggtgctytggccaggcgcggtggctcacgcctgtaatcccagcactttgggaggctgaggggggcagatcatgaggtcaggagattgaggccatcctggctaacactgtgaaaccccgtctctactgaaaacacaaaaacaaaattagccgggcgtggtggtgggcgcctgtagtcccagctactggggaggctgaggcaggggaatagcatgaacccgggaggtggagcttgcagtgagccgagatcgtgctgctgcactccaccctgggcgacagagcaagactccatctcaaaaaaaaaaaaaa

SEQ ID NO: 92381 - DNA, 601 bp, Human
tatcatttacatataatatatccattttaaaacgggagaaataataacaaacagtatgtaccctataggttgttatggggattgggttaacgtatataaaatattagatggtggtaagaagtgctaataagtgtttgttaaatatataagcccagggtcagcctggcttcctcctcatcctcctcctgctcacctggcctggaccccaacctctcccctagcactgagctcactgcccaggtcccacagcagcactccaggcctggactatttctacagccatctctctgcacctgtcttygtccgttgctgcagctacaacaaaatatcataaattgggtgctttggccaggcgcggtggctcacgcctgtaatcccagcactttgggaggctgaggggggcagatcatgaggtcaggagattgaggccatcctggctaacactgtgaaaccccgtctctactgaaaacacaaaaacaaaattagccgggcgtggtggtgggcgcctgtagtcccagctactggggaggctgaggcaggggaatagcatgaacccgggaggtggagcttgcagtgagccgagatcgtgctgctgcactcc

SEQ ID NO: 92382 - DNA, 601 bp, Human
cccacccagggctggctagagggacaagactcttgggcccagggaacacacgcctgcccctgcactgcctgtgggcagggtcatgccatttgccagggcccctacaaactccaggctcaaggccaggctagaagcagctgtcatatcaaccctgcacaaatgctcagctcccgatttcttatttgaatgagacttcacctatctgctcctgactggctgacagatgctgagcaaggccccatctcttattgggccttactttacctatctgtgaaatgatgccaggagaggggtggctggyggggggaggggctaggtttgggggatggtatcttaatggaacccaccaactctgacattccagggatggactacaggcagcaggggaaggtgattaagccctggacactggtggcagatgacatagattgaatgtatgatcctgggctagctacccaacttccctggggctcagtgttgtcatctataaaatgggaatgatagtacaaaaaagactgaaagtaaatgttcatattgattatgtgggatgagaagaggagaagatatgggtaatttattttgtctgttttcctgccttttt

SEQ ID NO: 92383 - DNA, 601 bp, Human
ccaaactcacctcccacccagggctggctagagggacaagactcttgggcccagggaacacacgcctgcccctgcactgcctgtgggcagggtcatgccatttgccagggcccctacaaactccaggctcaaggccaggctagaagcagctgtcatatcaaccctgcacaaatgctcagctcccgatttcttatttgaatgagacttcacctatctgctcctgactggctgacagatgctgagcaaggccccatctcttattgggccttactttacctatctgtgaaatgatgccaggagwggggtggctggcggggggaggggctaggtttgggggatggtatcttaatggaacccaccaactctgacattccagggatggactacaggcagcaggggaaggtgattaagccctggacactggtggcagatgacatagattgaatgtatgatcctgggctagctacccaacttccctggggctcagtgttgtcatctataaaatgggaatgatagtacaaaaaagactgaaagtaaatgttcatattgattatgtgggatgagaagaggagaagatatgggtaatttattttgtctgttt

SEQ ID NO: 92384 - DNA, 601 bp, Human
gcacgccatagaccacgccctgtgcaagaacttcccttgcacttcttacttcatcctgtggctggggccgttatgatgccattttgcaggtgggccaggagagaccctggcccaaggccactcagtgtctgagatggggctagaagccagggctgcatccctggcagcaggcagccccaggagtttgctggcaccagagccagaaataaatgcacagtcagagtacaggagacaactctcaggggacctgcagtgtgggcaaagccccaaactcacctcccacccagggctggctagaggracaagactcttgggcccagggaacacacgcctgcccctgcactgcctgtgggcagggtcatgccatttgccagggcccctacaaactccaggctcaaggccaggctagaagcagctgtcatatcaaccctgcacaaatgctcagctcccgatttcttatttgaatgagacttcacctatctgctcctgactggctgacagatgctgagcaaggccccatctcttattgggccttactttacctatctgtgaaatgatgccaggagaggggtggctggcggggggaggggctaggtttggg

SEQ ID NO: 92385 - DNA, 601 bp, Human
cccttgttgtccgcaatcttagactccaaaccattgctggaggctcgtatctgatttctcaggcaggtctacctggtcagccaggtgtgaaagggaggttggcaggagggggctctgtctgcagtgggctcaattccccagcctgggccaacaccgtggtgcagccttaggaacagccacaggagttgcccagttattgagcacgccatagaccacgccctgtgcaagaacttcccttgcacttcttacttcatcctgtggctggggccgttatgatgccattttgcaggtgggccaggaragaccctggcccaaggccactcagtgtctgagatggggctagaagccagggctgcatccctggcagcaggcagccccaggagtttgctggcaccagagccagaaataaatgcacagtcagagtacaggagacaactctcaggggacctgcagtgtgggcaaagccccaaactcacctcccacccagggctggctagagggacaagactcttgggcccagggaacacacgcctgcccctgcactgcctgtgggcagggtcatgccatttgccagggcccctacaaactccaggctcaaggc

SEQ ID NO: 92386 - DNA, 601 bp, Human
tggtctcaaactcctggcttcccaaagtgctgggattaccaggaggagccaccatgcccagccaaaacattttaaatgtagaaaagaccaaagaaaacaaaattctaccacctagtgataattagcttgatgtctgtctgaatattttgctatgtctgcatgctagggaaagattcttttctcatatccaaacccaaacagtctcattccacacatactactctttctcttaccgtgacatggtggccctctctctaaacagactggtttcttcatggcggccccacagtgctcccgtcctctatccctatccctggcaggtcccaggcctctacagggacgtagtgctttgggtctgacgttgttcctcctcatcctcagagtggggctgtgatctgtgatggggccatggctgccttcggggaccccaccaaacaaagccacacccaggcacagaaatactccagagcacttaaatcaaggggtgtgtggttaatggcggctgtctgtctctgtccgatttgattgtagccctttcaaaaccaactgaaagttctcccagccccagatgctggcctgatatttccctaacccctagggg

SEQ ID NO: 92387 - DNA, 601 bp, Human
cattgtaagtgatctatagatgacttaaagtatacaggagggtgtgtgtaggttacatgtaaacactatactattttatatcagggatttgaatatccacagattttgatatccttgggtgtcctggaagctgaatatttaggaatgactgcacacatatcaccaaaatctttacagaaataaattatctatcaagtataaaattattttattttatttttttttttaatagaggcaatgtcttactttgttgcccaggctggtctcaaactcctggcttcccaaagtgctgggattaccrggaggagccaccatgcccagccaaaacattttaaatgtagaaaagaccaaagaaaacaaaattctaccacctagtgataattagcttgatgtctgtctgaatattttgctatgtctgcatgctagggaaagattcttttctcatatccaaacccaaacagtctcattccacacatactactctttctcttaccgtgacatggtggccctctctctaaacagactggtttcttcatggcggccccacagtgctcccgtcctctatccctatccctggcaggtcccaggcctctacagggac

SEQ ID NO: 92388 - DNA, 601 bp, Human
tctgtagattcaaccaacctcagatggaaaatattcgaaaaaattaaggaaaaataacaatacaacaattaaaaaatacaaatttaaaaatacagtacaatgggccaggcatggtggcttgcacctgtaatcccagtattttgggaggctgaggcgggcagattacttgagatcaagagttcgagaccagcctggccaacatagcgaaaccccatctctactaaaaatgtaaaaaattagctgggtgtggtagtgcatgcctgtgatcccagctacttgggaggctgaggcacaagaatcrcttgaacccgggaggcggagtttgcagtgagctgagattgtgccactacactccagcctgggtgacacagcaagactctgtcttaaaaatatgtatatacagtataataactagttacatagcatttacattgtgttaggcattgtaagtgatctatagatgacttaaagtatacaggagggtgtgtgtaggttacatgtaaacactatactattttatatcagggatttgaatatccacagattttgatatccttgggtgtcctggaagctgaatatttaggaatgactgcacacatat

SEQ ID NO: 92389 - DNA, 601 bp, Human
tccacagttggacagtttggtcacaatgctactgtgcttgcagccacccaaaaccccaagtctttgtcccaagaaaagagtcctagttcccaccttcagaaacccccacagacatctcctccagtgtgactccatcaagccatccttggactctgctcccaactgttccgaaggccagcactggggatgtcatccaggccttaccaaagtccttatgctgtgagtgctgacttcatccctgcagcctgctgatgtcagaccggcctgagtattttattatctaaatatcattataacttgyattgcatacatagttggccctctgtatctgtgggtcctgcatctgtagattcaaccaacctcagatggaaaatattcgaaaaaattaaggaaaaataacaatacaacaattaaaaaatacaaatttaaaaatacagtacaatgggccaggcatggtggcttgcacctgtaatcccagtattttgggaggctgaggcgggcagattacttgagatcaagagttcgagaccagcctggccaacatagcgaaaccccatctctactaaaaatgtaaaaaattagctgggtgtggtagtgcatg

SEQ ID NO: 92390 - DNA, 601 bp, Human
gactcaggagccttttctttgtggggttggatgaggaaaaagaagtggaatctaattagaccaggttcaaagcccagctttgcctcttgctggctgcgtgaccttgcaaatttactcaacctctctgggctcctgcctccttatctgtaaaaagaggacaagactatctagctacaatgcgatggtgaagattccatgagtgaatgcacactaagagtctaattggggacccgccacatgtcaaatgattccaagacagctttttacattttaacatctctgaaactgggatgcaacttayagtttctgttgctttttctttcttaatggattctaaaataagggtacatctcacaacagataagccctgccttgaatgaaataccgcagtagcttagattctttacttcccttgcaaagaggctgaaacgcctgtgagatgggatcaaagaccaagaacacaaatcgttaagggacaagggtctattgaggcctagcattcaccctggatctccagagcttcacggaatttgaaggctcaggcccttccccggcctggcgcccctctggatctgtctcagctgtcctagtcttgctcaga

SEQ ID NO: 92391 - DNA, 601 bp, Human
tttcatctccaaaggaaaactcaagaaaggaacccgcaacaaagaaaaccatacaaggagagtcacttccaagctgtgtgacctcagacaagtcctatggcctctctgagactcagtttcacctccttaaaagagccatctcatctccaaataccttcctttccttgaccggcaccatctgtgccctggactgcagccttttgcagtgaccccggactcagcacattctctactctgcacgcccttcactcctctctcctcctccagattctgtgggactctacgattactgtccatctcycgtttggtctgtgagccctcaaaggcgggcctgtgtctgttttgctgtgcttggtatctctaatgctttacatacagaaagtaatcaatcgtgaacaaaggtcctagtcaaaaaattacattgaaagataactttttagggagcgaatgaatgggtcagtctgggtgaggctccaggattatctgtgtggggcagatatctctacagtctttctccagggcaggccacacaggccgagccactcctgcaatggtttcaacaaggatgaggctagtgaccctgccagcaagctctcaaagc

SEQ ID NO: 92392 - DNA, 601 bp, Human
tcacgttttcatctccaaaggaaaactcaagaaaggaacccgcaacacagaaaaccatacaaggagagtcacttctgagctacgtgacctcagacaagtcccatggcctctctgagcctcagtttcatctccttaaaagaaccatctcatctccaaataccctcctttccttgacctgcaccatcccttcttttgactgcacagtgaactctgtcattaggtgaaaatgctccacctgcttccaaagtcactaattcaagcacccctcctgaccgcaccctccccacctccagcctcctgwcacctgccacatgtgaccagccctttgccagtgtccccaatgatggatcagtaaaaacaggttcaggctcgagtagagggccctggaagccacaaccagagacccctctccaggatgacacaatgcatcaagcaatgccccaactccaccaccatgctcagcaacacctttgctgaaagaccagctccagggatggtgtgggggccatgtgatttccatgggcatgttgtggaaggccatttcttgtccccagtaacctgggacatcagctcactcttatcaacaccctaaaatccctca

SEQ ID NO: 92393 - DNA, 601 bp, Human
attaattagtctggattaacctggattaataaaccaggttaattaattgggataacttgccaaaaacagactaaagagtaagggagtcctcattaccctttctcagagtgtttccccttctctctggagactcctggaccacatgagacaggagactcctggaccacatgaggctgcctgacaccccagctggcgagtgtgtctccacctggcaaatgtgactaaagctgaattctttgttctatttgtttagatattttttcctgcaccccaatgtgcatcttgcatagatcactttggrggcaattgggatagaagatgaagagagtcggagataatttttaagctcaaaggatggcagaaatgatctagtctacccttcactttgcaggtgaggaaacaagaacctgagaagggatgtgacttgtccagggtcacctggctggtcagtggcagatcctggagagaatgcaaatctctaggccttgatgctacaaatggctgctaaaagtggtcacagtctagctctttaccggtccttttactttactggtccttttactttactgtgcctcttggttgggttcactctgaagcctca

SEQ ID NO: 92394 - DNA, 601 bp, Human
ctgggaccacaggcatgagccaccatgcccggctaattattaaacttttccttgaggcggggatttgctatgttgcccaggcttgtatcaaactcctagcctcaagtgatcctctcgccttggcctcccaaagtactgggattacaggccagcactcaacctcttccattcccttgtcttcatgtactagcattattagcatagtaagtaagcactgctaacaagtcacaatttttcagtacgaatctttaaaaaccacgtgtccattctgtaagcgctagttagcttagagtggtgaatwtaatttgtaaatccaatctggattaattagtctggattaacctggattaataaaccaggttaattaattgggataacttgccaaaaacagactaaagagtaagggagtcctcattaccctttctcagagtgtttccccttctctctggagactcctggaccacatgagacaggagactcctggaccacatgaggctgcctgacaccccagctggcgagtgtgtctccacctggcaaatgtgactaaagctgaattctttgttctatttgtttagatattttttcctgcaccccaatgtgc

SEQ ID NO: 92395 - DNA, 601 bp, Human
tattatatacaagtaatcatcatcaacctcgcaagacaaaacgtatacacagagtgagattcatcactaaccagagtgactgtaaatatctatttcaaagtgtcccctaacataaacaaacaaacaaacttgagctgacaaacttgtcagacttattagcttgtcactgtttttgtcctgggtcttgtagctgatgaagtgactgcaatagaaaccccagtgttaattctctcactttttttcttttttaaatttatttttattaaaaacatttttttagagacagagtctcgctctgtcrcctaggctggagtgcagtggtgccatcatagctcattgtagcctccaactcctggactcaagcaatcctcctgcctcagcctcctgagtagctgggaccacaggcatgagccaccatgcccggctaattattaaacttttccttgaggcggggatttgctatgttgcccaggcttgtatcaaactcctagcctcaagtgatcctctcgccttggcctcccaaagtactgggattacaggccagcactcaacctcttccattcccttgtcttcatgtactagcattattagcatagtaagt

SEQ ID NO: 92396 - DNA, 601 bp, Human
ttttttttttttttttgagacagagtctggctctgctggagacccaggctggagtgcagtggcacaatcttggctcaccacaacctctgtgtcccagattcaagcgattctcctgcttcagtctccagagaaactgggattacaggcatgtgccaccacacccggcaaatttttttgtatttttaatagtgatggggtttcaccatgttggcctggctggtctcgaactcctgacctcaggtgatctccaaacttttttgatcattcactccttccacaagaaaaaaaaaaaacaaactgwgctcacaccccattatcttatattatatacaagtaatcatcatcaacctcgcaagacaaaacgtatacacagagtgagattcatcactaaccagagtgactgtaaatatctatttcaaagtgtcccctaacataaacaaacaaacaaacttgagctgacaaacttgtcagacttattagcttgtcactgtttttgtcctgggtcttgtagctgatgaagtgactgcaatagaaaccccagtgttaattctctcactttttttcttttttaaatttatttttattaaaaacatttttttag

SEQ ID NO: 92397 - DNA, 601 bp, Human
tgagatgagcaaggagcttaagagcgtgtagcctttggtctgggtgtggtggctcacgcctgtaatctcagcactttgggaggctgaggcgggcagatcacctgagatcgggagttcgagactagcctgaccaacatggagaaaccccgtctttactaaaaatacaaaattagccgggcgtggtggcgcatgcctgtaatcccagctactcgggagggagaattgcttgaacctgggaggtggaggttgctgtgagccgagattgcgccattgcactccagcctgggcaacgagagtgaarctctgttcccccgcccaccccccaccgccaaaacaaaaaacaaaaaaaaaaaaccaaagagcgtgtagccctggcccatggtaaagttctcaataaacggtagcaaccagtgggccaaggcaagcatttgagtagctttcctaaacctctctgtgcctcagtttcctaagctgtaagctggggtccatgatagcacctaccttatagaggagatgttcattcatataaagtgcctcagagcagtgcttggcaagtgctcagccaggtgttagtctcctacatgtatattcctgttttgtc

SEQ ID NO: 92398 - DNA, 601 bp, Human
tcgcagcccagtacacgtgcttaagatacgggcttcagagtcagagaaacctggatccaaatccagactcacttcccttctctaagtcttgataccacatcgtcaggttgctgtgagatgagcaaggagcttaagagcgtgtagcctttggtctgggtgtggtggctcacgcctgtaatctcagcactttgggaggctgaggcgggcagatcacctgagatcgggagttcgagactagcctgaccaacatggagaaaccccgtctttactaaaaatacaaaattagccgggcgtggtggcrcatgcctgtaatcccagctactcgggagggagaattgcttgaacctgggaggtggaggttgctgtgagccgagattgcgccattgcactccagcctgggcaacgagagtgaagctctgttcccccgcccaccccccaccgccaaaacaaaaaacaaaaaaaaaaaaccaaagagcgtgtagccctggcccatggtaaagttctcaataaacggtagcaaccagtgggccaaggcaagcatttgagtagctttcctaaacctctctgtgcctcagtttcctaagctgtaagctggggtcca

SEQ ID NO: 92399 - DNA, 601 bp, Human
gggagatgcatgggcagacccagacagcgtcacttatgggggagctcagaggatgggggaggcccccatgtaaccagcaagctcaattcagggtcatcagggctaaagccagcgctgcaagttgcagcagggagatggaaatctgggaagtcagggagggcccccgggaggatacgactgagctgagctttcaaggccaagtagagcaagcccagcagaggagggaaggggaggcatggggtggaaggcgctgtgctaggtcatgcctgtctgtggtgtgcggagatggagccaggagctkgcagcgcgggggtggggaggctgggtctgagcaaatgcaggccagcaatggggctgccgctgggagaggtgctgggggcgcagtgctgaggagggggcacctgagacagtggggaggcatcaaagtgtgtaactgggggtgtgacatggtcagagccgaaatagacttaacccctgcaattaggaagtcaggacattgagcctgggaaacgatttctttcctcaactttgggctggtatcgaaggaagaaataagtgggtttcatttcatgtccagctccagtgggctggaggggttgcg

SEQ ID NO: 92400 - DNA, 601 bp, Human
agcgacaaggatcactggggattttccaagacacctccaggaggctgaaaatctggcagctccactccctgctcactgtccgctttctggcacagagctttcagacctgtctttggacagagagggacactgaggctcagagaggaagcgcgccttgcttagcgtcccacagtcagcccgaggcagggctgaagctctgtaactctggtcctggggtgggcatccaaccaggggtcctgcattctgttctcagcgtggacccacaaatcagccctcactctgcctgcctcagggacctggsgcccagagtcagttcagccaacatcattggtgcccactctgagcctgatgccatgctgggcactgtaggggagatgcatgggcagacccagacagcgtcacttatgggggagctcagaggatgggggaggcccccatgtaaccagcaagctcaattcagggtcatcagggctaaagccagcgctgcaagttgcagcagggagatggaaatctgggaagtcagggagggcccccgggaggatacgactgagctgagctttcaaggccaagtagagcaagcccagcagaggagggaagggga

SEQ ID NO: 92401 - DNA, 601 bp, Human
ccacaagggcgacagagctgtccagccatcagctgtcctgagaaggtcttgtcctgcctggaccttctggagacagagcagagcttctttctgtttaatcccccaaatcaagccctgaccaaaactccacacaggtttattgccccacaatctccttatctgggagtttcgagcgacaaggatcactggggattttccaagacacctccaggaggctgaaaatctggcagctccactccctgctcactgtccgctttctggcacagagctttcagacctgtctttggacagagagggacaytgaggctcagagaggaagcgcgccttgcttagcgtcccacagtcagcccgaggcagggctgaagctctgtaactctggtcctggggtgggcatccaaccaggggtcctgcattctgttctcagcgtggacccacaaatcagccctcactctgcctgcctcagggacctggggcccagagtcagttcagccaacatcattggtgcccactctgagcctgatgccatgctgggcactgtaggggagatgcatgggcagacccagacagcgtcacttatgggggagctcagaggatgggggag

SEQ ID NO: 92402 - DNA, 601 bp, Human
aaaataaaaaagcatcattttcccagataatctgtctttgctcatgccccttccctctgcctagaactaagccagctcaggtaagtcgctgggtggctcttagcagggctcttagaatgccccttcctgtcaccccaccttcctggcccagctccaacagaaccacctccaaggagcctccccagctctcagactgagcagtctctccatcccatgaggtcccatcctgacatttggggaggtagccaaaggcagggaaaaagaaggcaccaagttcaagccctggacccctatttgtctstgtgccgtagcattagagtatcctcatatttttctcatagaatctagaagattaaatgaaataatgtatgtaaaagaccttgcatgtgtctggcacaaagtaggagctcagcccatggaagcgcccctcgtctcctttcctgcccactgtgttttttccttctcttccttcctcccccaccaacacacccataggactgtcaaccttagatggttctccccttctgctgtgcccacctacagccctgtgggtacccagggggaggccaacctgactcccagcttgagctttcactcacac

SEQ ID NO: 92403 - DNA, 601 bp, Human
ttgcctaagatcacatagctagttagtggctgggctggaatctgaagccaggctgttcagtcacaggtccacactctctcgcaggggttcctggacacttacataaggtgatacacacagcatgcagagtgatgcttggtgcatacttagtgttcaaaagacgttggctagtaagattgttgtggtcccaatgtgtacaagacactgagatgtgatttaacacacaacaggtatatgctgggaggccagcattttgggtatctaagtaaaaatcccaaaccagaaagcatgaagcagcctsccaggggccaagtggctcgtgagagttccaacccctggtgcaaaccatgatgatggggaaacagacacacacatgcagaaggctagctgacaattcctactgatcaaaaagaatccaagagagtgcatttgtgcatctctccgggctgggttctcctaggtggaggccagaaggccccaccctgccctagtgctgagggacctgggacggggtggaggggtgggggaagaagccctttgctttttctccatcagcacagcccaggcagggaagcagagcgcagccatccagggaccctcc

SEQ ID NO: 92404 - DNA, 601 bp, Human
aggcttctaaattaaagttaaaattaaataaagtgtaaaatccagctccttagtcacactagcaacatttcaagagctcaaaagccacatgtgcttcataatcacagatgaaaccatacaagcaacacccaatgaacagtgtaattaaacaacatgcccatctctgaacaaagttctgatggacagcaccaccctatcatttcctatctgccactctgggcaagttacttaatgtgtctatttcctcaccaggaaaatcaggcactacaaatacacatactagctaacgcctatattactsactaggtgttaagtatgttccacataccaactcaaccctcatgcaagtactgtcatagccccatttttaagataaggaaacagggcacagagaggttatataacttgcctaagatcacatagctagttagtggctgggctggaatctgaagccaggctgttcagtcacaggtccacactctctcgcaggggttcctggacacttacataaggtgatacacacagcatgcagagtgatgcttggtgcatacttagtgttcaaaagacgttggctagtaagattgttgtggtcccaatgtgt

SEQ ID NO: 92405 - DNA, 601 bp, Human
acaaggcttctaaattaaagttaaaattaaataaagtgtaaaatccagctccttagtcacactagcaacatttcaagagctcaaaagccacatgtgcttcataatcacagatgaaaccatacaagcaacacccaatgaacagtgtaattaaacaacatgcccatctctgaacaaagttctgatggacagcaccaccctatcatttcctatctgccactctgggcaagttacttaatgtgtctatttcctcaccaggaaaatcaggcactacaaatacacatactagctaacgcctatattrctgactaggtgttaagtatgttccacataccaactcaaccctcatgcaagtactgtcatagccccatttttaagataaggaaacagggcacagagaggttatataacttgcctaagatcacatagctagttagtggctgggctggaatctgaagccaggctgttcagtcacaggtccacactctctcgcaggggttcctggacacttacataaggtgatacacacagcatgcagagtgatgcttggtgcatacttagtgttcaaaagacgttggctagtaagattgttgtggtcccaatg

SEQ ID NO: 92406 - DNA, 601 bp, Human
cacagaacctctagtcccacaaggcttctaaattaaagttaaaattaaataaagtgtaaaatccagctccttagtcacactagcaacatttcaagagctcaaaagccacatgtgcttcataatcacagatgaaaccatacaagcaacacccaatgaacagtgtaattaaacaacatgcccatctctgaacaaagttctgatggacagcaccaccctatcatttcctatctgccactctgggcaagttacttaatgtgtctatttcctcaccaggaaaatcaggcactacaaatacacatamtagctaacgcctatattactgactaggtgttaagtatgttccacataccaactcaaccctcatgcaagtactgtcatagccccatttttaagataaggaaacagggcacagagaggttatataacttgcctaagatcacatagctagttagtggctgggctggaatctgaagccaggctgttcagtcacaggtccacactctctcgcaggggttcctggacacttacataaggtgatacacacagcatgcagagtgatgcttggtgcatacttagtgttcaaaagacgttggctagtaag

SEQ ID NO: 92407 - DNA, 601 bp, Human
aaagaagcaggagagcacagaggtggcccaggccccggagcttgactgtcaggggtctaatcttggctctaaacggccctgtccaacacagaacctctagtcccacaaggcttctaaattaaagttaaaattaaataaagtgtaaaatccagctccttagtcacactagcaacatttcaagagctcaaaagccacatgtgcttcataatcacagatgaaaccatacaagcaacacccaatgaacagtgtaattaaacaacatgcccatctctgaacaaagttctgatggacagcaccaccstatcatttcctatctgccactctgggcaagttacttaatgtgtctatttcctcaccaggaaaatcaggcactacaaatacacatactagctaacgcctatattactgactaggtgttaagtatgttccacataccaactcaaccctcatgcaagtactgtcatagccccatttttaagataaggaaacagggcacagagaggttatataacttgcctaagatcacatagctagttagtggctgggctggaatctgaagccaggctgttcagtcacaggtccacactctctcgcaggggtt

SEQ ID NO: 92408 - DNA, 601 bp, Human
aaatgtggaatcaacccaagtgtccgttcacagatgaacggatcagtaaaatgtggtatattcaaaccatggaataatattcaaccttcaaaaggaagaaaactctactttgggaggatgaggtggatcgcttgggttctggagttcaagaccagcctgggtgacacagcaagacctcatctctgctagaaataaaaaaaaaattagctgggcatggtggcacacacctgtagtcccagctactcgggaggtcaaggtgggaggatcacttgagctcaggagttagaggctgcagtaagcyatgattataccactgtactccagtctgggtgataaagcaagatcctgtctcaaaaaaaaaaaaaaaagaaagaaaagaaaaaggaagaaagtcttgagacatgctgtaacatggatgaactttgagggcattatgctaagtgaaacaagccagttacaaaaagacagcgcatgattccacttatatgagttactttgagtaggcaaaatcacagggacagaaagtagaatggtggctgccaggggctgagggtagggaggaatgaaaagttattgtttaatggatatagagtttcagttt

SEQ ID NO: 92409 - DNA, 601 bp, Human
attcagcaactccacttctggaatatacacccttaaagaaatgaaagcagggtctagaagagatatttgcacactcatgttcatagcagcattattcccaatagcttaaatgtggaatcaacccaagtgtccgttcacagatgaacggatcagtaaaatgtggtatattcaaaccatggaataatattcaaccttcaaaaggaagaaaactctactttgggaggatgaggtggatcgcttgggttctggagttcaagaccagcctgggtgacacagcaagacctcatctctgctagaaataaaaaaaaaattagctgggcatggtggcacacacctgtagtcccagctactcgggaggtcaaggtgggaggatcacttgagctcaggagttagaggctgcagtaagctatgattataccactgtactccagtctgggtgataaagcaagatcctgtctcaaaaaaaaaaaaaaaagaaagaaaagaaaaaggaagaaagtcttgagacatgctgtaacatggatgaactttgagggcattatgctaagtgaaacaagccagttacaaaaagacagcgcatgattccacttatatgagttac

SEQ ID NO: 92410 - DNA, 601 bp, Human
aaatcttcacaacattgggcttggcaatgattccttggttatgataccaggaacaggcaacaaaagaaaaaaaatagacaaattgtattcatggaaattaaaaacttgtgtgtatttaaggatactagcaacagagtgaaaaggcaacatatggaatgagaggaaatatttgcaaatccatatgataaggtgttaatgttgagaatatataaagaactctgacaactcaacaacaagcaagcaaacaatttgatttgaaacaatctgatttagtgcactgttggtaggaatgcaaaagggyttagttgctatgaaagatagtacggcagttcatcaaaaatttaaaaatagaacgatcatacgattcagcaactccacttctggaatatacacccttaaagaaatgaaagcagggtctagaagagatatttgcacactcatgttcatagcagcattattcccaatagcttaaatgtggaatcaacccaagtgtccgttcacagatgaacggatcagtaaaatgtggtatattcaaaccatggaataatattcaaccttcaaaaggaagaaaactctactttgggaggatgaggtggatcgc

SEQ ID NO: 92411 - DNA, 601 bp, Human
aaatagaagagctaaatctataaaaaaccttagaagaaaacgaagagcaaaatcttcacaacattgggcttggcaatgattccttggttatgataccaggaacaggcaacaaaagaaaaaaaatagacaaattgtattcatggaaattaaaaacttgtgtgtatttaaggatactagcaacagagtgaaaaggcaacatatggaatgagaggaaatatttgcaaatccatatgataaggtgttaatgttgagaatatataaagaactctgacaactcaacaacaagcaagcaaacaatttsatttgaaacaatctgatttagtgcactgttggtaggaatgcaaaagggtttagttgctatgaaagatagtacggcagttcatcaaaaatttaaaaatagaacgatcatacgattcagcaactccacttctggaatatacacccttaaagaaatgaaagcagggtctagaagagatatttgcacactcatgttcatagcagcattattcccaatagcttaaatgtggaatcaacccaagtgtccgttcacagatgaacggatcagtaaaatgtggtatattcaaaccatggaataatattc

SEQ ID NO: 92412 - DNA, 601 bp, Human
agaaagagatgagatggtgtgacctcgagggactgctaacatgcagggcagtggcttgcaactttgcacattagaatcacttaaatcagattactgggtgggggacccagatgccagcactgcttaagcttccagtgcatgtgattccagcgcatgttaggagcaaggataacagaaacacataatggatgtgatgcagtagttctcaaagtgcagtcccccattaaccatatcactagggaactttttatttgcaaattctcaagcctccttccccagacctactgaatcaggtattctgggggtggggctcaccactctgctttaaccagccccccaggttcaagtttgagactcagtggtgtaatggatgggttggcaatacctgaacccactgcccaatcttagcatcactaaaagagataaccagacattatgtgctgctaacatgaagcaacaggaaacactacttataaagtggccttgccaaaaaatgaaacccactgttgaccgagtctttgtatgtaactgtgcacacagagtatggagaaacatgttaacagccacacagatacaatcaggaaaaaaacacaggacatcc

SEQ ID NO: 92413 - DNA, 601 bp, Human
tcaagttgtctgcgagagaggaggctctagaatccatttcttaaagagcccaacataccgaaccatagaatagaaatttcaaagcagaataatccaggaagctttatagagagaggtgaagaggatttcattcaatctccaatcttcatctgatattgacttggtgcttattctgcgccaagccgtgtcaggagcagggctcggaggggtcagagatgaataattcagtcactgctctccacatgttcatacctctcagggaaatgaccaagagcagaaagagatgagatggtgtgacctygagggactgctaacatgcagggcagtggcttgcaactttgcacattagaatcacttaaatcagattactgggtgggggacccagatgccagcactgcttaagcttccagtgcatgtgattccagcgcatgttaggagcaaggataacagaaacacataatggatgtgatgcagtagttctcaaagtgcagtcccccattaaccatatcactagggaactttttatttgcaaattctcaagcctccttccccagacctactgaatcaggtattctgggggtggggctcaccactctgcttt

SEQ ID NO: 92414 - DNA, 601 bp, Human
cctcaacctcctgggcttgcgcaatcctctggcttcagcctcctgcatagctaagaacaagcatgtaccaccgtgcttggctaatttttttgtaaagacagggtttcactctgttgccaggctggtcttgaacacctggcctcaggcgatcctcacacctcagcctctcaaagtgctgggatgacaggcgtgagccaccgtgcctggcttacacgtaacaattctattgtaaattcctggtagccctgactttgtcaagttgtctgcgagagaggaggctctagaatccatttcttaaagrgcccaacataccgaaccatagaatagaaatttcaaagcagaataatccaggaagctttatagagagaggtgaagaggatttcattcaatctccaatcttcatctgatattgacttggtgcttattctgcgccaagccgtgtcaggagcagggctcggaggggtcagagatgaataattcagtcactgctctccacatgttcatacctctcagggaaatgaccaagagcagaaagagatgagatggtgtgacctcgagggactgctaacatgcagggcagtggcttgcaactttgcacatt

SEQ ID NO: 92415 - DNA, 601 bp, Human
tttcctccctccttcaaagcaaaaagggtccttgccgctctccacagaagtagggcaactaactgtcttggtttgcctcggattgtggaggggttccagggaggcaggacttacagcgctaaactgggggaagtcttacttaggcaaacagggataagttggtcactctcccaccactaccaccaccaccagggtctaggtgtaacaattcttttttttttgagatagggcctcactttgctacccaggctggagtgcagaggcgtgatcagtgctctctgcagcctcaacctcctgggcytgcgcaatcctctggcttcagcctcctgcatagctaagaacaagcatgtaccaccgtgcttggctaatttttttgtaaagacagggtttcactctgttgccaggctggtcttgaacacctggcctcaggcgatcctcacacctcagcctctcaaagtgctgggatgacaggcgtgagccaccgtgcctggcttacacgtaacaattctattgtaaattcctggtagccctgactttgtcaagttgtctgcgagagaggaggctctagaatccatttcttaaagagcccaacataccgaac

SEQ ID NO: 92416 - DNA, 601 bp, Human
acttttgccttgcaccggccagcaacaaggtctgaagtgatacagtgggatccagtgtgctaggacctaacagtctcaccccacagggtaatttttcctccctccttcaaagcaaaaagggtccttgccgctctccacagaagtagggcaactaactgtcttggtttgcctcggattgtggaggggttccagggaggcaggacttacagcgctaaactgggggaagtcttacttaggcaaacagggataagttggtcactctcccaccactaccaccaccaccagggtctaggtgtaacamttcttttttttttgagatagggcctcactttgctacccaggctggagtgcagaggcgtgatcagtgctctctgcagcctcaacctcctgggcttgcgcaatcctctggcttcagcctcctgcatagctaagaacaagcatgtaccaccgtgcttggctaatttttttgtaaagacagggtttcactctgttgccaggctggtcttgaacacctggcctcaggcgatcctcacacctcagcctctcaaagtgctgggatgacaggcgtgagccaccgtgcctggcttacacgtaacaattc

SEQ ID NO: 92417 - DNA, 601 bp, Human
cttctcctctgtaagggttttatcacaactgggctctgtgaatctaaggccagaccctggtttaaaccaccacctcttggcacgaggtgtcttaacttttgccttgcaccggccagcaacaaggtctgaagtgatacagtgggatccagtgtgctaggacctaacagtctcaccccacagggtaatttttcctccctccttcaaagcaaaaagggtccttgccgctctccacagaagtagggcaactaactgtcttggtttgcctcggattgtggaggggttccagggaggcaggacttayagcgctaaactgggggaagtcttacttaggcaaacagggataagttggtcactctcccaccactaccaccaccaccagggtctaggtgtaacaattcttttttttttgagatagggcctcactttgctacccaggctggagtgcagaggcgtgatcagtgctctctgcagcctcaacctcctgggcttgcgcaatcctctggcttcagcctcctgcatagctaagaacaagcatgtaccaccgtgcttggctaatttttttgtaaagacagggtttcactctgttgccaggctggtcttg

SEQ ID NO: 92418 - DNA, 601 bp, Human
ctgtgtcgttttgtgggtgtgcatgcacgtgtgcatccctttggatgtttaactgaggctgtgtatatacacatgcatgagcgcatgcgtgtatccgtgcatgcatgactttaatgactcagtaattcagagaacaggagttcattttccctacaagcaggcacttgcccacaagtgagtactgtagcgggcccttcgcctacaggctgggccagaacagccgattcgagccaggtctatcccaggccactcatcttatcctgccccattccatctggctgggcccacatcaaagccacarcaggcattctcaggtgtggcactctgggacagcctgctgggcacaaggcgggaggtggcatccattctgctgctgtgatcccatgcaggcttggtgggcctgatgccatgggattaggctccggggcctgtgaattcccaactcccagaaaggatgtagtcatctctgggttttgcatcgcactgagtttatttctttttttttctttgagacggagtctcgctctgttgcccaggctggagtgtgcagtggtgctatctcagctcactgcaacctctgcctcctgggttcaagcgattc

SEQ ID NO: 92419 - DNA, 601 bp, Human
ctagcaaggccagctacctctccctttgtatgtggcatggaagtgtatgtgtatatgcatgggtgaagcttgtgcatgcgtgctggcctgtgtgcgtactgtgtgtgcacaagaactgcattcatcaggaagttcatgagcgcctgtgtcgttttgtgggtgtgcatgcacgtgtgcatccctttggatgtttaactgaggctgtgtatatacacatgcatgagcgcatgcgtgtatccgtgcatgcatgactttaatgactcagtaattcagagaacaggagttcattttccctacaagyaggcacttgcccacaagtgagtactgtagcgggcccttcgcctacaggctgggccagaacagccgattcgagccaggtctatcccaggccactcatcttatcctgccccattccatctggctgggcccacatcaaagccacaacaggcattctcaggtgtggcactctgggacagcctgctgggcacaaggcgggaggtggcatccattctgctgctgtgatcccatgcaggcttggtgggcctgatgccatgggattaggctccggggcctgtgaattcccaactcccagaaaggatgt

SEQ ID NO: 92420 - DNA, 601 bp, Human
gcagaggaaaggatagagcaggtaagaggcaatggtcacccgggctggagtagggcagtgaagtggacgggatggtggggagaggatgttactgaaataccaaggaggtgggatcaaccaaatgtggtgcctgagtgcatgtggcgggcctggggtagtcgctgaaatcgacatgagcttacattaacaacagccctggccccttccggaccctctgagctgtctccctccacagcctgtctgtgcacctgtagggggtacctggggtctggcccaactcctgagagccactctccatccwggaggagtgaggaggccgtgagaggcctgggcaacacctcccctggagctcacagtcacctctgtggcaataagaagtcatggtttttgagtgcttacaagctgccaggcgccattccaaatgctttccatgcatgaatagagcaagtgggtgctaccttgctcccccgttcagatgtaggtgttcaggccagtaaccgggtcacacagctagtgaacagcaggcctgggggctgcactcagctgtctcaagcctgcagcttttgagcctgcagctccaggtcctcacagacaataccca

SEQ ID NO: 92421 - DNA, 601 bp, Human
tctataagataaaagccacaagttgctaaggagcagcacatcttttctctatagtgagttttgagagaaatgggtactgggggtccccttggaaagaaacaacaaggacaaatgacctccctagggtcttggcaacttggtggcagtggaggagccaccttgggcctgggctcgggtgggaaagcaaggagcaaatcagcaggctccgctccaggcccccccactcctccctcaccttgagcaactgctgggggtggcgggagtgcacctgtctgtggcagctggtgatgctcaccagacktcccattgctcccctcatgtccaggccccttccagtcaggcagccatagcacacatcactgcctcctatgacccgttagccagtggatcatgggaggcagtgatgtgtgtcacttccaggccaaagcacatgagacctgcctgtgaccctctaggactctcgtccttggccaaagggatgagaagggtgcatgtttcagatggtgcatctataaggtagttggtccctcaggaaccatgtgtagcagagcactttcttctactgacatacagtgcaacagagaaatacacttgtagagtg

SEQ ID NO: 92422 - DNA, 601 bp, Human
tagacctcagatttgggtctgagcttcctagtggccaattcaacaaggaaaagagaatcagaaagggatttatttggtgtctataagataaaagccacaagttgctaaggagcagcacatcttttctctatagtgagttttgagagaaatgggtactgggggtccccttggaaagaaacaacaaggacaaatgacctccctagggtcttggcaacttggtggcagtggaggagccaccttgggcctgggctcgggtgggaaagcaaggagcaaatcagcaggctccgctccaggccccccsactcctccctcaccttgagcaactgctgggggtggcgggagtgcacctgtctgtggcagctggtgatgctcaccagacgtcccattgctcccctcatgtccaggccccttccagtcaggcagccatagcacacatcactgcctcctatgacccgttagccagtggatcatgggaggcagtgatgtgtgtcacttccaggccaaagcacatgagacctgcctgtgaccctctaggactctcgtccttggccaaagggatgagaagggtgcatgtttcagatggtgcatctataaggtagtt

SEQ ID NO: 92423 - DNA, 601 bp, Human
gagctacaggaagctgcacagaatgtagggatggactgactaattaatgcccatgtgattccagaaaggatttaagaagactcacaaaaatagaacacaagatagaaggaaatgaaaaagctacaagagaaaaaatagggacacaaggaaaatgcaggtaaaaagagatcacctgaaacgcaggaggagttaagctaggtgtgcggccaggtccaccacacagaggaggtagacctcagatttgggtctgagcttcctagtggccaattcaacaaggaaaagagaatcagaaagggatttrtttggtgtctataagataaaagccacaagttgctaaggagcagcacatcttttctctatagtgagttttgagagaaatgggtactgggggtccccttggaaagaaacaacaaggacaaatgacctccctagggtcttggcaacttggtggcagtggaggagccaccttgggcctgggctcgggtgggaaagcaaggagcaaatcagcaggctccgctccaggcccccccactcctccctcaccttgagcaactgctgggggtggcgggagtgcacctgtctgtggcagctggtgatgctc

SEQ ID NO: 92424 - DNA, 601 bp, Human
gaaattccaactctcctttcgggagctttgccctaaaccctggctgcatttgccagagctacaggaagctgcacagaatgtagggatggactgactaattaatgcccatgtgattccagaaaggatttaagaagactcacaaaaatagaacacaagatagaaggaaatgaaaaagctacaagagaaaaaatagggacacaaggaaaatgcaggtaaaaagagatcacctgaaacgcaggaggagttaagctaggtgtgcggccaggtccaccacacagaggaggtagacctcagatttggstctgagcttcctagtggccaattcaacaaggaaaagagaatcagaaagggatttatttggtgtctataagataaaagccacaagttgctaaggagcagcacatcttttctctatagtgagttttgagagaaatgggtactgggggtccccttggaaagaaacaacaaggacaaatgacctccctagggtcttggcaacttggtggcagtggaggagccaccttgggcctgggctcgggtgggaaagcaaggagcaaatcagcaggctccgctccaggcccccccactcctccctcacctt

SEQ ID NO: 92425 - DNA, 601 bp, Human
caagccctttagacagcaccaggtagcacgtcagtcttgcaggggcttgtgtatcccataaagctcagaaattccaactctcctttcgggagctttgccctaaaccctggctgcatttgccagagctacaggaagctgcacagaatgtagggatggactgactaattaatgcccatgtgattccagaaaggatttaagaagactcacaaaaatagaacacaagatagaaggaaatgaaaaagctacaagagaaaaaatagggacacaaggaaaatgcaggtaaaaagagatcacctgaaaygcaggaggagttaagctaggtgtgcggccaggtccaccacacagaggaggtagacctcagatttgggtctgagcttcctagtggccaattcaacaaggaaaagagaatcagaaagggatttatttggtgtctataagataaaagccacaagttgctaaggagcagcacatcttttctctatagtgagttttgagagaaatgggtactgggggtccccttggaaagaaacaacaaggacaaatgacctccctagggtcttggcaacttggtggcagtggaggagccaccttgggcctgggc

SEQ ID NO: 92426 - DNA, 601 bp, Human
cttccctagctcccaagccacttcctccagagagtcctccttgatatcccaagtagcagagatctcgctctcctctgttccctgacagccacctctccccttgcctttagcccttgacactgtctaccctgatttggggttcagggtcagttctcattttctctgctggcttggagcttcctcagagaaggctctgctccaggagtgtccagcacagtgtctatcccccttgggcccccaccttccccacttaggggaaggcaggtttggctgggcctacgctggtcaagataaagaagakgctcacccagcccacacggctgacccatgaggctcttctctgtgctcaattcctcagaacgagattacactgtgtgacctcaggcaagtcatagcgataagggcctgacccctgaggcaagccctttagacagcaccaggtagcacgtcagtcttgcaggggcttgtgtatcccataaagctcagaaattccaactctcctttcgggagctttgccctaaaccctggctgcatttgccagagctacaggaagctgcacagaatgtagggatggactgactaattaatgcccatgtgattc

SEQ ID NO: 92427 - DNA, 601 bp, Human
tttccctttttttggtggggaaggtggctttggagactttcccaatttcctgtaatcccagtaaagcattaaaaaattatattttattcaggaggaaataaattcgcagaattatattgcagagaagaggagaggtgctacgagtagctaagccaactgctagaggctaaaattcaggacaggtgtatttttcccagtgaggaaaccaaggctcaaagagatgaaatgacttactcaaggtcacacagctagtaatgggcagggctaggactttctagaaacccaggctctttccactttccctctgtcctgccctgcctccagagagctgtttgggcctgggggtgtccttacctggtgcagggggatgacgaggaaggcccctccaccagcacactcagtcacaactgcaatgaagtgggggttcacggcacagaagtggttgtcgtgaacgctgcgggtgataggcacggagtcgtagcagttctccttgctggctggtttgccaaagacatgacggaacttggagctccggtactgggggtgccatgacatctgcaggagacaaatgggacaaagggtatgaggctcactgccctga

SEQ ID NO: 92428 - DNA, 601 bp, Human
tttgtgatctttgtggattcatatttctctatgtttaatctgtggggatcctgtccacattgtggatgctttcctctggagaggcttcatgtcagtttctgctgtgagccagtggcactactaacctgggatccctctagccccttcaggtgttctgccttaaggtagagactcagggttggcatcctgaatggaactactattaggttgatctatgtgaaaatgttgcttttttggggtcaaaccagttgaatatccacaattttatatggtccaacctacgctagcaacacttgcactmaggacaaaagcctgttcttcctgcttgcttactgtttgcctctcctagctagttttgactcaatgtttgtttccctttttttggtggggaaggtggctttggagactttcccaatttcctgtaatcccagtaaagcattaaaaaattatattttattcaggaggaaataaattcgcagaattatattgcagagaagaggagaggtgctacgagtagctaagccaactgctagaggctaaaattcaggacaggtgtatttttcccagtgaggaaaccaaggctcaaagagatgaaatgact

SEQ ID NO: 92429 - DNA, 601 bp, Human
cagtttacactcccatcagaagtgtctgatcgtttacacaactctgtatacttgctgtcatttactagtgttagacatttttgacaatctgatgtgtagtggtattgcactggtttactaatgaggttgagtagtttttcaaatgcttattagccatttggattttctttgctatgaagtgctggttcagtgttttgtggatttttcggtacattttatacattcaagaaatgagtcttttgtcatgtttattatatccttttccactctatagctcgcctttccttttgctattttcttkaagggaaatttttattgctcaattttttttttttttttttttttgagatggagtctggctctgtcacccaggctagagtgcagtggcatgatctcagctcactgcaacctctgcctcctgcgttcaagcaattctcctgcctcagcctcccgagtagctgggattacaggtgcccgccactgtgcctggctaatttttgtatttttagtagagacggggtttcaccatgttggttaggctggtctcgaactcctgacctcatgatccacccacctcagcctcccaatgtgctgggattaa

SEQ ID NO: 92430 - DNA, 601 bp, Human
cgaactcctgacttcaagtgatctgcccgtctgggcctgccaaggtgctgggattacaggcgtaagccagcgcatccggctgataactttttttttttttttttaagagatggggtcttattctgtcacccaggctggagtgcagtggtgctttcatagctactgcaacctcaaattcgtggcctcaagcaattctcctgcttcagcctctcgtgtagctgggactacaggtgtgtaccactgtgcccagctaactaaaaagcaattttttaagagatggggtcttgctatactgcccagrctatatgtctgtaacttctctgtttccaaacacacacacacacacacacacacacacacacacacacacacactcacacacacaccccgagaggcaaaatgttaaaaccggtaaaccaggtgaaggttaatcaggaattagttcagttttatttgcaaatcttctgtaggcttgaaattgcttcaagataaaaaggttttaaaatgctgtttactataggtcagtgaaattctcccttatccttcatttgctaattttctttttgttgctgctgagtttttctcatggctgggtattggg

SEQ ID NO: 92431 - DNA, 601 bp, Human
ttttttttgagacggagtttcgctctgtcgcccaggctggagtacagtggcgcgatctcgactcactgcaagctctgcctcccgggttcacgccattctcctgcctcagcctcccatgtagctgggaccacaggcgcgcgccaccatgcccggctaatttttgtatttttagtagagatggggtttcaccatgttggccaggctgctctcaaactcctgacctcagatgatccacctgccttggcctcccaaagtgctgagattacaggcatgagccactgcacccggcctcttttgctgttttttttttttgttttttctttaagggacatttttattgctcaatgtttagtagttagaggactattcaggctttctgtttctacttgaattggtattgacaagttacatttttctagtcttactgtgcaggccatgaccttttatcttattcctgattttattttattttatttattttgagacagggtgtcgctttgtcacctaggctggagtgcagtggcacgttcatggctcatagcagccttgaactcctgggctcaaggcagcctcctgcctcagccttctgagtagctgggac

SEQ ID NO: 92432 - DNA, 601 bp, Human
aactaattattgaattaattaagaatgcagtttgtttggtggacgtaatcttttacaagcatgcaaagcttggaagaaacaagtagcaaaatcggccatctatagggggtccttcccattttgacctttttatgtctttctacaaattccattttgcacttgtccctccctagctcgaaacattctctctctctttaggatacaggtcacatgcctcaccccagcattcaaggctctgctcagctagccccagtccacttccttagggtacttcccttcttctccttcacagattatttgwtctggccagacagctgctctctgcattgcttcctgaacattctatatacagttgcacctccatgcctttgcttgtgcccttccctttgccatttatgccctccctatttatttggatgaacaaccatgagataatttgtggagttaatgaaaatttatgagcaacaattatgcacccaactacattaggaggtactagcagaaaagcacaaaggactctaattcaaagtagtcagggcatggttctaaggaaaaaataggcttggaatatgtcctaaaaaaagagaatgctgtgggaatt

SEQ ID NO: 92433 - DNA, 601 bp, Human
cgccttcacagtccaggccctactccccaatctgacctcacctcctcccaccactctgtggtcacagcacatgtgtccacgtgctgacaatgcacagacacaccaaacccattcccactcaggggaatgtttgcatgttctatttgttctgccagcatactctccctttagagcctcaagtggctctcggctcaaagatcaccttcccaggaatgccttcccagaccatcctgcctaaactaggtcccctctcccaaaccacgtcacactctatcacatcacaccaatttattttctttayatcagttgttagtacccatttacaccgagcagttcatgcaagttagaaacagtgacagttctgagagtttgagtaataaaaggaaaaccaactaattattgaattaattaagaatgcagtttgtttggtggacgtaatcttttacaagcatgcaaagcttggaagaaacaagtagcaaaatcggccatctatagggggtccttcccattttgacctttttatgtctttctacaaattccattttgcacttgtccctccctagctcgaaacattctctctctctttaggatacaggtcaca

SEQ ID NO: 92434 - DNA, 601 bp, Human
actggactcaggatagagcccagactcctgcctgggcttacgacgccttcacagtccaggccctactccccaatctgacctcacctcctcccaccactctgtggtcacagcacatgtgtccacgtgctgacaatgcacagacacaccaaacccattcccactcaggggaatgtttgcatgttctatttgttctgccagcatactctccctttagagcctcaagtggctctcggctcaaagatcaccttcccaggaatgccttcccagaccatcctgcctaaactaggtcccctctcccaamccacgtcacactctatcacatcacaccaatttattttctttatatcagttgttagtacccatttacaccgagcagttcatgcaagttagaaacagtgacagttctgagagtttgagtaataaaaggaaaaccaactaattattgaattaattaagaatgcagtttgtttggtggacgtaatcttttacaagcatgcaaagcttggaagaaacaagtagcaaaatcggccatctatagggggtccttcccattttgacctttttatgtctttctacaaattccattttgcacttgtccctc

SEQ ID NO: 92435 - DNA, 601 bp, Human
ctgtgttgtaacactaaagtatgagaagctctgatcagtggctcctgggtgtgttagtccattttgcattgctatataggaatatgtgaggctgggtatttacaaagaaaagacgtttgtttggctcacagttctgcaggaggcaaaagaagcctggcaccagcatctgcttctggtaaggactgcaggggagcttccaatcatgcagacagtgtaggggggatcaggtgtgccgcaggccacggggaggtgtcccagactgttttcaacaatcagatctcaggtgaactcattatcacagggagggcatcaagccattcatgagctgcccccatgacccaaacacctcccatgaggccccacctccaacactggggatcacatttccacatgaaaattggaggggacaagcatccaaactgtatcacagctcctgttggatctggattcctaggagtctgtgatgatagcaattaacatgtatctttgagctatttattatatttcaaaaagcccaaagagaatcacacattttatctaggatcaggctgtgtaggacaagtgagtttctttttctctttcttttttttttttgagagag

SEQ ID NO: 92436 - DNA, 601 bp, Human
ggcatcctgtattttatcaggcatctctgggagcttgttggagatgcagattccctggccccacttcagacccactacatcagaatctgtgttgtaacactaaagtatgagaagctctgatcagtggctcctgggtgtgttagtccattttgcattgctatataggaatatgtgaggctgggtatttacaaagaaaagacgtttgtttggctcacagttctgcaggaggcaaaagaagcctggcaccagcatctgcttctggtaaggactgcaggggagcttccaatcatgcagacagtgwaggggggatcaggtgtgccgcaggccacggggaggtgtcccagactgttttcaacaatcagatctcaggtgaactcattatcacagggagggcatcaagccattcatgagctgcccccatgacccaaacacctcccatgaggccccacctccaacactggggatcacatttccacatgaaaattggaggggacaagcatccaaactgtatcacagctcctgttggatctggattcctaggagtctgtgatgatagcaattaacatgtatctttgagctatttattatatttcaaaaagcc

SEQ ID NO: 92437 - DNA, 601 bp, Human
actgtagtcttataagatgttaccactggaagaaacagggtaaaggatacacagaattgcactgtactatttcttataactgcttgtgaatctactatgatgtcaaaataaaacttttaattaaaaagaaaaaagcaaaaataacgatttgttgtttatctgaaagtcaaattaaactgggcatcctgtattttatcaggcatctctgggagcttgttggagatgcagattccctggccccacttcagacccactacatcagaatctgtgttgtaacactaaagtatgagaagctctgatyagtggctcctgggtgtgttagtccattttgcattgctatataggaatatgtgaggctgggtatttacaaagaaaagacgtttgtttggctcacagttctgcaggaggcaaaagaagcctggcaccagcatctgcttctggtaaggactgcaggggagcttccaatcatgcagacagtgtaggggggatcaggtgtgccgcaggccacggggaggtgtcccagactgttttcaacaatcagatctcaggtgaactcattatcacagggagggcatcaagccattcatgagctgcccccatg

SEQ ID NO: 92438 - DNA, 601 bp, Human
ctgaaaatataaaaactagccaggtgtggtggcatgtgcctgtagtcccagttacttgggaggctgaggcaggagagttgcttgaacccaggaggcggaggcttcagtgagccaatatcatgccattgcactccagcctgggcgacagagcgagactccatctcaaaaaaaaaaaaaaaataagataaataaataaataaaaatttaaaaaaagaaagaaggaacacataattgaggccaggtgcagtggctcatacctgtaattccagaagtttggggtgggtggatcacttaagcccaggggttcaagaccaacctgagcaacatagcaaaacctcacctctacataaaaaatatacaaaaattagctgggtgtgatggcatgcacctgtagtcccagctattcaggaggctgacgtaagaggattgcttgagcccaggaagtggaggcttcagggctgcagtgagatatgatcatgccactgcattccagcctgggtgaaagagccagagcttgtctcaaacaaaacaaaacaaaacaaacaaacaaaaaaaacaaaacacacacacacaaaacacaaaaaaaaatgatcaatactca

SEQ ID NO: 92439 - DNA, 601 bp, Human
cagattaactgaggtcaggagtttgagaccagcctggccaacatagcaaaaccccatctctactgaaaatataaaaactagccaggtgtggtggcatgtgcctgtagtcccagttacttgggaggctgaggcaggagagttgcttgaacccaggaggcggaggcttcagtgagccaatatcatgccattgcactccagcctgggcgacagagcgagactccatctcaaaaaaaaaaaaaaaataagataaataaataaataaaaatttaaaaaaagaaagaaggaacacataattgaggcyaggtgcagtggctcatacctgtaattccagaagtttggggtgggtggatcacttaagcccaggggttcaagaccaacctgagcaacatagcaaaacctcacctctacataaaaaatatacaaaaattagctgggtgtgatggcatgcacctgtagtcccagctattcaggaggctgacgtaagaggattgcttgagcccaggaagtggaggcttcagggctgcagtgagatatgatcatgccactgcattccagcctgggtgaaagagccagagcttgtctcaaacaaaacaaaacaaaa

SEQ ID NO: 92440 - DNA, 601 bp, Human
aaagaaaaaaaaaaagaggccaggcaaggtggttcatgcctgtaatcccagctctttgggaggctgaggcaggcagattaactgaggtcaggagtttgagaccagcctggccaacatagcaaaaccccatctctactgaaaatataaaaactagccaggtgtggtggcatgtgcctgtagtcccagttacttgggaggctgaggcaggagagttgcttgaacccaggaggcggaggcttcagtgagccaatatcatgccattgcactccagcctgggcgacagagcgagactccatctcaaaaaaaaaaaaaaaataagataaataaataaataaaaatttaaaaaaagaaagaaggaacacataattgaggccaggtgcagtggctcatacctgtaattccagaagtttggggtgggtggatcacttaagcccaggggttcaagaccaacctgagcaacatagcaaaacctcacctctacataaaaaatatacaaaaattagctgggtgtgatggcatgcacctgtagtcccagctattcaggaggctgacgtaagaggattgcttgagcccaggaagtggaggcttcagggctgcagtg

SEQ ID NO: 92441 - DNA, 601 bp, Human
tcaggagtttgagaccagcctgggcaacatcatgagacctcgcctctattaaaaaaaaaaagaaaaaaaaaaagaggccaggcaaggtggttcatgcctgtaatcccagctctttgggaggctgaggcaggcagattaactgaggtcaggagtttgagaccagcctggccaacatagcaaaaccccatctctactgaaaatataaaaactagccaggtgtggtggcatgtgcctgtagtcccagttacttgggaggctgaggcaggagagttgcttgaacccaggaggcggaggcttcagygagccaatatcatgccattgcactccagcctgggcgacagagcgagactccatctcaaaaaaaaaaaaaaaataagataaataaataaataaaaatttaaaaaaagaaagaaggaacacataattgaggccaggtgcagtggctcatacctgtaattccagaagtttggggtgggtggatcacttaagcccaggggttcaagaccaacctgagcaacatagcaaaacctcacctctacataaaaaatatacaaaaattagctgggtgtgatggcatgcacctgtagtcccagctattcag

SEQ ID NO: 92442 - DNA, 601 bp, Human
taaactgtagtgcatccataccatagaatactattcagcagtaagaaaggacacagaggcaggagtggtggctcatgcctgtaatcctggcactttgggaggctgaggcaagaggatcacttgagctcaggagtttgagaccagcctgggcaacatcatgagacctcgcctctattaaaaaaaaaaagaaaaaaaaaaagaggccaggcaaggtggttcatgcctgtaatcccagctctttgggaggctgaggcaggcagattaactgaggtcaggagtttgagaccagcctggccaacawagcaaaaccccatctctactgaaaatataaaaactagccaggtgtggtggcatgtgcctgtagtcccagttacttgggaggctgaggcaggagagttgcttgaacccaggaggcggaggcttcagtgagccaatatcatgccattgcactccagcctgggcgacagagcgagactccatctcaaaaaaaaaaaaaaaataagataaataaataaataaaaatttaaaaaaagaaagaaggaacacataattgaggccaggtgcagtggctcatacctgtaattccagaagtttggggtgg

SEQ ID NO: 92443 - DNA, 601 bp, Human
agacttacttatattcacccaaaaatatgaacacaaatgtttgtaacagcttaatctgtaatagccccaaactcgaaacaacccactggctttcagtgagtgaatggttatataaactgtagtgcatccataccatagaatactattcagcagtaagaaaggacacagaggcaggagtggtggctcatgcctgtaatcctggcactttgggaggctgaggcaagaggatcacttgagctcaggagtttgagaccagcctgggcaacatcatgagacctcgcctctattaaaaaaaaaaagaaaaaaaaaaagaggccaggcaaggtggttcatgcctgtaatcccagctctttgggaggctgaggcaggcagattaactgaggtcaggagtttgagaccagcctggccaacatagcaaaaccccatctctactgaaaatataaaaactagccaggtgtggtggcatgtgcctgtagtcccagttacttgggaggctgaggcaggagagttgcttgaacccaggaggcggaggcttcagtgagccaatatcatgccattgcactccagcctgggcgacagagcgagactccatctcaaaaaa

SEQ ID NO: 92444 - DNA, 601 bp, Human
cccatctggactttgaggcaaacaaaccacaagcaaagtggcatgtatgaggcaaccagggaccattaacatgaattaggaatcaggtgacacaagagttattattaatgtgatcctggcattatggttatgtcagaaaatgtccctggttttagaattgcatactgacatgtggtagggggcggggggcagaggttgaaatgacaaaatgtctaggatttgctttaaaatacttcaggtaaaagggatgagtgaagcaagagggcaaacttgataattctagaatctgggctgaggaaakttcatcatattatttttatctacttttgtgcttgagatttttccataattatgaacctgagctagattagagccttgctattgaaaatgcaattggcaaacaagtagatcggtatcacctgggaggagggaagtcagatttagcaagtaaaatacaggatgcccagtaaaattcaaattgcagataaacaacgaatattttagcataaggaggttccatgcaatattttacttacactaaaaatttgtaaaaataaagtgacagtttcttataaggctaaacatgcaactaccttatgac

SEQ ID NO: 92445 - DNA, 601 bp, Human
accctgggtcacaacaggcaagagggagggaccctgcctgcagtgtcactccctttgggacatctgaaactgcctggggcagcccggcccctctgagaaggacttcctgcacgctgtggcaaggccagacatctcccaatctcaatgcaatttatgtacttaattaaatcattagctagcttgtcccttccttgttctcacatcactcacctactgatacatctctgtgcctggcacagaacgtaatcctggtaacaagtaggagctgatgcaaatcagtgccaaacctcaggggcctcawgtcagtgaagtgagagcaaggcccgaggccacacccaggtctgggctcccattcgggtcctggacacactgcacagggtcctctgggaagtcatcttcctgagcctcagcgacctcatctgtgcaatggggcaagatcccctataaatggggctaatgttcataaggtatcagcataatcactccaaccctggttacaacataataaagagcctctaaggcctgtctgtgcaggtaagtgctatggcatggtgcctgcacagtagtaatggatgtggttacttaataagaaacatattgg

SEQ ID NO: 92446 - DNA, 601 bp, Human
ccaactccttggatatttgaagacagaggacccattccttgagtatgttcttgtccaggatgaacaaacccctagaactggaagagacttccaaaatgccagactagcccataccctgcctttctagaagggcaatttgtatggagggaacagatatgtgctatggaaggctctgaggttccaaacagttggctaggacagggcatagagggctttgatgagagaggcagaacattatctgcaggcagcaaggagtcctgggaggcatctgagcagcggagtgatgtggacacacatcggsttgagaagggtcaggttggccttggttttttgtttgtttgttttttgagacagagtattgctctgtcgcccaggctggagtgcaatggtgcgatcttggtttactgcaacctctgtctcccgggttcaagtgattctcctgcctcagcctcccaagtagctgggactacaggcatgtgccaccacgcccagctgattttttatttttggtagagacagggttttggtatgttggccaggctagtctcgaatgcctgacctcaagtgatctcctgccttggcctcccaaagtgccaggatt

SEQ ID NO: 92447 - DNA, 601 bp, Human
tgggccttaaagagagggagactttgaccaggtcaggtggaggggaggaatctcaagtcagaaaggcagggccacaggtaggttttaagtgggaggaggctgaagcagccagcgggcacggtaggctggaggacagggcaagagaggaggctgagcaagaggggtgaggctgagggcatggagtctactcaccctgcccagggtgcaaggctggacccaatagagaggtggacaaatggataggtgagccatgtcctgactggagagggtgagatgtgggaccagggaccgcccagaggargctgggattgagcagagggagagatgagaggagcatttcttgaccctaggaatggcagcacttctaaaatgcacagcacattcccatgatttagggcagagcatccttcatcacccctctccttatgagcacccagatgagcctttggagggtttactgtagaatccaacatccagggatgaaagcggtgaaccacagctggtgtccccacttggtcacctgtggggacagggagctcacttcctcctgaggtaattcatcctactttcagaccttgtgaatttggagaaaatgtttcct

SEQ ID NO: 92448 - DNA, 601 bp, Human
tactatgtgccagactgcatgcaggtgatggcagagatgcggtactcacaatcctgggctataggagccatctaccttatggaggaggcaggaaggaatatactttgagctcagaggagaggcacacaagagacctgggggatgaaccagagaaggctccctggaggaggaggactttaaattgggccttaaagagagggagactttgaccaggtcaggtggaggggaggaatctcaagtcagaaaggcagggccacaggtaggttttaagtgggaggaggctgaagcagccagcgggcayggtaggctggaggacagggcaagagaggaggctgagcaagaggggtgaggctgagggcatggagtctactcaccctgcccagggtgcaaggctggacccaatagagaggtggacaaatggataggtgagccatgtcctgactggagagggtgagatgtgggaccagggaccgcccagaggaggctgggattgagcagagggagagatgagaggagcatttcttgaccctaggaatggcagcacttctaaaatgcacagcacattcccatgatttagggcagagcatccttcatcacccct

SEQ ID NO: 92449 - DNA, 601 bp, Human
ctcgcagaccccacagaaccctggcttgggccgccctgcctggagaggcatcacctccaagtctccaaggggctgccctggggcagagggggaagacaggacagaaggacccaggaggagtcaggcgggtgggggaccagactggggactctctacggctgacctccattgccagaaagggagaggttgtgaggccactgtcacgaccctcagcagtcaagggagcagctgttcctacaacagcatcatagtcatggcctcaaatgagcatcccaacagctcagggtggagactgggaggsaggggtggcaggacgggcagagggaggacacacagtgtagcagaggtgaagtgggcaggcagactctggcttccaggggtggaatccctgccacatcccttaccatggtgcagccttgggcaagtgacctcagttctctatgcctcagtttccttatctacgaaatgacaacagtagtagcacctcattcacagtaaagcactgaagacggtgcccagtacttgctaagtactcagtacattagccaggagaagctcatcacagctcattaccattacccagtttcattgttgctcagta

SEQ ID NO: 92450 - DNA, 601 bp, Human
tgaaaaaatgggtccatccaggattagccaaaaacttctgttataaaactgtagctcttgaagggctctagagaccaggaatggagcccacagctgcactgtcttatcctgcacctgtggcaggcattgcgaatggatcccagcaccctctctcggacctcagacttggggaaatccagcatggagtagggacttgcccagggtcactgcaaaggtgaggggcagagctgggcttgagcccaggcctctggttccccaagtgtgagcctggtgctgtacttcctgtgctctgagggagcaycagtgagtgctctgtgagtccctgccctggcctccttcctgcacacagcctttcctttctctgggatcatttcctgggtcaaaggccatgagcagtactgtgtctttggctgtggggcactgattgctctccgggcctttagactctggcccagggccatgccccaatttccgcagtgcggtttcccaagaaaagccagatgagccaatagtcaggctgccctcgggctgacgggaggcaaagtgcccaggagccccattcagacacacacctcccacctcccacagactcagggaaggc

SEQ ID NO: 92451 - DNA, 601 bp, Human
tcagtaacagaagctattattatatgtatatgtatgtatatttgtatgtcaaaactgagaaaaaaaaactaaaaggaatgagccaaaatgttaatcatggttatatctagatggtggaataaatggctggctttaatatctttgtcttatttttagctatgtaagttttgcaattaaaaaaggtgtttaaaaacaaaaatacagattttctgaaaaaatgggtccatccaggattagccaaaaacttctgttataaaactgtagctcttgaagggctctagagaccaggaatggagcccayagctgcactgtcttatcctgcacctgtggcaggcattgcgaatggatcccagcaccctctctcggacctcagacttggggaaatccagcatggagtagggacttgcccagggtcactgcaaaggtgaggggcagagctgggcttgagcccaggcctctggttccccaagtgtgagcctggtgctgtacttcctgtgctctgagggagcaccagtgagtgctctgtgagtccctgccctggcctccttcctgcacacagcctttcctttctctgggatcatttcctgggtcaaaggccatg

SEQ ID NO: 92452 - DNA, 601 bp, Human
gaactcctgggctcaaacaatcttcccaacttgccctcctaaagtgagggattacaggcatgggccaccgtgcctggcctatgcatgcattttagtagctctgcaaacagaggaggtggtcctgtgcctccctctggaaatactctggctaatccaggtctctcccctcaggaaaaagtgatcagacacctccgcctagactggatcccctactggaggggacaacgctataaaggacattatttaacaaatctaaacaagaacggtagattacagtattatcacaacattaaacttatakaagttgataatgtactgcagtaatgtaagagaatatttgtatttttaggaaacagtatttagggatgaagggctaagatggatgtaacttaccctcaaagagttctgaaaacaaaaaattatacacacacctacacattcagagggagaaagagaaccaaaaaaaaaggaaagaatgtggacttgtgtcctttgttagtgatgtgcatggagggaggtgaaaattttctctctttcaagtggtctctgcctcttctacagcaggacaggggagagaggtgcatgcttcctgccctgtcct

SEQ ID NO: 92453 - DNA, 601 bp, Human
ggcatgtgtcaccaagctcagctaatttttaaaattatttgtagagatggggtcttgctatgttgcccaggctggtcttgaactcctgggctcaaacaatcttcccaacttgccctcctaaagtgagggattacaggcatgggccaccgtgcctggcctatgcatgcattttagtagctctgcaaacagaggaggtggtcctgtgcctccctctggaaatactctggctaatccaggtctctcccctcaggaaaaagtgatcagacacctccgcctagactggatcccctactggaggggwcaacgctataaaggacattatttaacaaatctaaacaagaacggtagattacagtattatcacaacattaaacttatataagttgataatgtactgcagtaatgtaagagaatatttgtatttttaggaaacagtatttagggatgaagggctaagatggatgtaacttaccctcaaagagttctgaaaacaaaaaattatacacacacctacacattcagagggagaaagagaaccaaaaaaaaaggaaagaatgtggacttgtgtcctttgttagtgatgtgcatggagggaggtgaa

SEQ ID NO: 92454 - DNA, 601 bp, Human
agcagaatactactgtccctaaaaagaggaatgaagtactggtccctgctacagcatggattaacctagaaaacactagaagaagaggccaggcacaaaaggccacacgttgtgtgattccacttagatgatgttccagatgtggtttcattgcctgagcacattaatgcatccccctggtacctggtatctggaaccctaagtaatgcatatgaaaaatgcagaacgggctgggcgcggtggctcacgactgtaatcccagcactttggggggccgaggcgggtggatcacgaggtcagsagatcgagaccatcctggccaacatggtgaaaccctgtctctactaaaatacaaaaaattagcccggcgtggtggtgcacgcctgtagtcccagctactcgggaggctgaggcagtagaatcgcttgaacccaggaggcagaggttgcagtgagccaagatcatgccactgcactacagcctggcgacagagcaagattctgtctcaaaaaaaaaaaaaaaaagaaagaaaaatgcagaacgatacattcatggagacagaaggcaagattctggttgcctcaggcttgggagaaggggc

SEQ ID NO: 92455 - DNA, 601 bp, Human
aggtcaggagttcgagaccagcctggccaacatggtgaaaccctgtctctactaaaaatacaaaaattagccgggcgtggtagcatgcacctgtaatcccagctactcaggaggctgaggtagaacacttgaacctgggaggtggaggttgcagtgagctctgattgcgccattgcactccagcctgggtgacaagagtgaaactatgtctcaaaaaaaaaaaaaaagaaactggttcaccaatgttcacaacaatattcttcataatatcagaaagtggaaacaacccaaatgcccatcragtgaagaatggacatacaaaatgcagtatattcatgcagcagaatactactgtccctaaaaagaggaatgaagtactggtccctgctacagcatggattaacctagaaaacactagaagaagaggccaggcacaaaaggccacacgttgtgtgattccacttagatgatgttccagatgtggtttcattgcctgagcacattaatgcatccccctggtacctggtatctggaaccctaagtaatgcatatgaaaaatgcagaacgggctgggcgcggtggctcacgactgtaatcccag

SEQ ID NO: 92456 - DNA, 601 bp, Human; identical to SEQ ID NO: 27329

SEQ ID NO: 92457 - DNA, 601 bp, Human; identical to SEQ ID NO: 27330

SEQ ID NO: 92458 - DNA, 601 bp, Human; identical to SEQ ID NO: 27331

SEQ ID NO: 92459 - DNA, 601 bp, Human; identical to SEQ ID NO: 27332

SEQ ID NO: 92460 - DNA, 601 bp, Human; identical to SEQ ID NO: 27333

SEQ ID NO: 92461 - DNA, 601 bp, Human; identical to SEQ ID NO: 27334

SEQ ID NO: 92462 - DNA, 601 bp, Human
caaagggaacaacgttataatagcagcaactccaaggaagcagccacagctctcagctctcagacctggggctgccgctcatcatcagctacagctaggtttgatgggagtgcccccatttcaggggacagcaggcccccttcactccccgactcagtccccatctgcagcagcacagccttccttggcctcaccagggaagaagaacaggccccgctctcagacaagccttcccagaagcctgaggactcaaacacccaaatgtgtctgggtccctgccccgagccggccacccaggcascagccctgaatcactcggtcagccagcggcagggcaggccaatgggctggagggtaggcaggcaggcagacccacctctgcatctctgctgactgcctcggctgaggaaaggcagcaccagcccccaaccctgaagttctagatctcatgcagcctctctgttctggaaccatccagaggcactgcccttatacatggtccacccccaggctcagacaatgagaattccacaagcagaggggactctatttggggcacagagaggttaagtaactcccctcctaaggtctctcagcaagg

SEQ ID NO: 92463 - DNA, 601 bp, Human
aggacccagcccaggccgaccggggctctagccctgtctcccaaggttcctttgttttaaaccctacatttctccatcttgcgcacggaaggagaaatacagattacaaagacccggcaaatggattttataaactcttattttcttgccacagaactgcctttaattagctccgaggactacaaagggaacaacgttataatagcagcaactccaaggaagcagccacagctctcagctctcagacctggggctgccgctcatcatcagctacagctaggtttgatgggagtgcccccayttcaggggacagcaggcccccttcactccccgactcagtccccatctgcagcagcacagccttccttggcctcaccagggaagaagaacaggccccgctctcagacaagccttcccagaagcctgaggactcaaacacccaaatgtgtctgggtccctgccccgagccggccacccaggcagcagccctgaatcactcggtcagccagcggcagggcaggccaatgggctggagggtaggcaggcaggcagacccacctctgcatctctgctgactgcctcggctgaggaaaggcagcac

SEQ ID NO: 92464 - DNA, 601 bp, Human
gtgctactgccagccacctcccaggctccgaggatcaggacccagcccaggccgaccggggctctagccctgtctcccaaggttcctttgttttaaaccctacatttctccatcttgcgcacggaaggagaaatacagattacaaagacccggcaaatggattttataaactcttattttcttgccacagaactgcctttaattagctccgaggactacaaagggaacaacgttataatagcagcaactccaaggaagcagccacagctctcagctctcagacctggggctgccgctcatmatcagctacagctaggtttgatgggagtgcccccatttcaggggacagcaggcccccttcactccccgactcagtccccatctgcagcagcacagccttccttggcctcaccagggaagaagaacaggccccgctctcagacaagccttcccagaagcctgaggactcaaacacccaaatgtgtctgggtccctgccccgagccggccacccaggcagcagccctgaatcactcggtcagccagcggcagggcaggccaatgggctggagggtaggcaggcaggcagacccacctctgca

SEQ ID NO: 92465 - DNA, 601 bp, Human
cagatccaaacatctccacagaccctagcctatgaggcgccttctgtgccactgctggccaggatcagcccgctctgcccagcggcctcctgtctctgggcgcatacatgacatgttgggccaaagccacctctccctttgtgccctttgtgctactgccagccacctcccaggctccgaggatcaggacccagcccaggccgaccggggctctagccctgtctcccaaggttcctttgttttaaaccctacatttctccatcttgcgcacggaaggagaaatacagattacaaagacccrgcaaatggattttataaactcttattttcttgccacagaactgcctttaattagctccgaggactacaaagggaacaacgttataatagcagcaactccaaggaagcagccacagctctcagctctcagacctggggctgccgctcatcatcagctacagctaggtttgatgggagtgcccccatttcaggggacagcaggcccccttcactccccgactcagtccccatctgcagcagcacagccttccttggcctcaccagggaagaagaacaggccccgctctcagacaagccttcc

SEQ ID NO: 92466 - DNA, 601 bp, Human
tggacaggcagggtggtctggggagacgggtgtgtgcagggcagcctcagaagccgccatcaaagggacctagcagacgtggcgccaggcaagcgccatagtgggcacggaagggctggcggtcagtctgttcctctcccagggatggcggggagggggaggccccatggacacatgtgctcagggtgaccagccatcaggggttgcctgggatgaaggggtttcctgggacgtggagctttcagtgctaaaacagagagtcccctgttattggaacttcctggaccttcggaaaggatayagtgactgacctctctggtctgggcagcctcctccctgtccggtgacctctgagtcagaccatctcggccagacctgcccagggccattttgtccaccccctgcctccacacaggcctgcctcatacccaagagtccactttccatttctcccaggcatcttcaggggaggagctgccggccaactccaaccactgctagggggacctcggccagacccacaccacgctcccagccctccctgtggctcccgagccagctcatactttcctgcttccacacctttgcccaggacgttcct

SEQ ID NO: 92467 - DNA, 601 bp, Human
tatagccgcattttacattgctttctctccgaagagtgccttcctttatccctgggagccattgacaaggggtctgacagtccctctagtcttgtgcctgctcagccctctctagccctgaaaaaaccagggcttggcgctggagaaagagcaggagggtgagatgtggaaacatctgttgagtggcaggggatcacgctggcgcagaggggcccgagccgatcaggaggccggcctgtgccaggccagtgctccctgtgtaccaggtgccacatgcggggctcagggtagggccacagtygctcctcccaaccaccctttgaggtcagtgttactagcccattttacagaggaggaaactgagaccttaagaggtgaattaacatgtcaggtcacccagctaccatgcagtttaagcctagattgttctgactcctaaactgtgtgcaaggcggatgattggaccccagggaggcaaggaaagtcagttttcctgctgctgaattcaatgttttacaagaccacacacctctttagacctcagtttcgtcatgtatgaaatgaggaggggaactctctgcctccgggctctgatatgctc

SEQ ID NO: 92468 - DNA, 601 bp, Human
gcagctgaggcttatagccgcattttacattgctttctctccgaagagtgccttcctttatccctgggagccattgacaaggggtctgacagtccctctagtcttgtgcctgctcagccctctctagccctgaaaaaaccagggcttggcgctggagaaagagcaggagggtgagatgtggaaacatctgttgagtggcaggggatcacgctggcgcagaggggcccgagccgatcaggaggccggcctgtgccaggccagtgctccctgtgtaccaggtgccacatgcggggctcagggyagggccacagttgctcctcccaaccaccctttgaggtcagtgttactagcccattttacagaggaggaaactgagaccttaagaggtgaattaacatgtcaggtcacccagctaccatgcagtttaagcctagattgttctgactcctaaactgtgtgcaaggcggatgattggaccccagggaggcaaggaaagtcagttttcctgctgctgaattcaatgttttacaagaccacacacctctttagacctcagtttcgtcatgtatgaaatgaggaggggaactctctgcctccgggc

SEQ ID NO: 92469 - DNA, 601 bp, Human
tcctttcctccccacccctttccactccatccgcctttccctttgcgttctccaagcgttccgtcccccagatgccctctgtttcctctgctccagccttttaactcctctcaacaaaggccaaggaatcaggcagactgtggacactcaggtgtgcatgatgggaagggacctgcatttacaaaagctcccccccacagggactgcatgtgctggtggaatctcagtcaccatgtcccacgttgaaggatgtttggagggggctgactttggtcacccttcaaatcataagttatatgcrtctgccctttccgcccacacgtaagtctgaaccttttgccaaaaacacttttcccagactcgaaagaaaaccccaaagaggaacctaaaccttcacgctgcctgcaccgattggaccggagtgctcaggctcgcgccaacaagtgtttcaaagaagaagccagacagtgaagggggaagtgagggagaagctggaaaactctcaggctgaccaatcgtcagcccattcattcgttcatccatccatccatccatccatccatccatccatccatccatccattctttctttctttcctct

SEQ ID NO: 92470 - DNA, 601 bp, Human
gcatgaccaaaatggacccctcctttcctccccacccctttccactccatccgcctttccctttgcgttctccaagcgttccgtcccccagatgccctctgtttcctctgctccagccttttaactcctctcaacaaaggccaaggaatcaggcagactgtggacactcaggtgtgcatgatgggaagggacctgcatttacaaaagctcccccccacagggactgcatgtgctggtggaatctcagtcaccatgtcccacgttgaaggatgtttggagggggctgactttggtcaccctycaaatcataagttatatgcgtctgccctttccgcccacacgtaagtctgaaccttttgccaaaaacacttttcccagactcgaaagaaaaccccaaagaggaacctaaaccttcacgctgcctgcaccgattggaccggagtgctcaggctcgcgccaacaagtgtttcaaagaagaagccagacagtgaagggggaagtgagggagaagctggaaaactctcaggctgaccaatcgtcagcccattcattcgttcatccatccatccatccatccatccatccatccatccatccatcc

SEQ ID NO: 92471 - DNA, 601 bp, Human
ctttctccaccccccctggacctagcacctcttcccgagacacaggggtgcgaagagctgggggaggtacgtcagcaggcctcccctcctgcccctgcttaccccacggaggtggggtgggacagaactcaggcttgaggaaggagcactggaggccaagccacaggtgctggtcctcagccctggtgcccaggcaagttgggtttgggaataggggcatgaccaaaatggacccctcctttcctccccacccctttccactccatccgcctttccctttgcgttctccaagcgttccgtsccccagatgccctctgtttcctctgctccagccttttaactcctctcaacaaaggccaaggaatcaggcagactgtggacactcaggtgtgcatgatgggaagggacctgcatttacaaaagctcccccccacagggactgcatgtgctggtggaatctcagtcaccatgtcccacgttgaaggatgtttggagggggctgactttggtcacccttcaaatcataagttatatgcgtctgccctttccgcccacacgtaagtctgaaccttttgccaaaaacacttttcccagactcgaa

SEQ ID NO: 92472 - DNA, 601 bp, Human
gaagggatatagctgctctgtaggagatgtgggggcaccaggctctctccatgggctctttatcacttctgacttggaggtcctttctccaccccccctggacctagcacctcttcccgagacacaggggtgcgaagagctgggggaggtacgtcagcaggcctcccctcctgcccctgcttaccccacggaggtggggtgggacagaactcaggcttgaggaaggagcactggaggccaagccacaggtgctggtcctcagccctggtgcccaggcaagttgggtttgggaataggggcmtgaccaaaatggacccctcctttcctccccacccctttccactccatccgcctttccctttgcgttctccaagcgttccgtcccccagatgccctctgtttcctctgctccagccttttaactcctctcaacaaaggccaaggaatcaggcagactgtggacactcaggtgtgcatgatgggaagggacctgcatttacaaaagctcccccccacagggactgcatgtgctggtggaatctcagtcaccatgtcccacgttgaaggatgtttggagggggctgactttggtcacccttca

SEQ ID NO: 92473 - DNA, 601 bp, Human
ctgccatcatggcggaccacacagtattaactactatggacttttcagtgtttccctctagtcttttttctgaggtggctttgctctcagaggtggctttctctccccctgggaagggatatagctgctctgtaggagatgtgggggcaccaggctctctccatgggctctttatcacttctgacttggaggtcctttctccaccccccctggacctagcacctcttcccgagacacaggggtgcgaagagctgggggaggtacgtcagcaggcctcccctcctgcccctgcttaccccayggaggtggggtgggacagaactcaggcttgaggaaggagcactggaggccaagccacaggtgctggtcctcagccctggtgcccaggcaagttgggtttgggaataggggcatgaccaaaatggacccctcctttcctccccacccctttccactccatccgcctttccctttgcgttctccaagcgttccgtcccccagatgccctctgtttcctctgctccagccttttaactcctctcaacaaaggccaaggaatcaggcagactgtggacactcaggtgtgcatgatgggaaggga

SEQ ID NO: 92474 - DNA, 601 bp, Human
ttagatccttcaggtgttctacaacgtaaaatgcagacagggtggggacgttggttggagtcatgttttccctaatgttcttactggttctaaaatcttcaagctatgctctcacccaaggcttcacttattattattttaacactgtggattcataaagaatggaagcccacacaagtccagggaaggaaggaaaggcagacagaggcttattttcaggcctgggcagttgcacagggtcccttgcttagaagggcctcatgcttggtttcgtgttctgtggtcgctgtcctgaaattcmtactgatttttgaacaagggatcctgtattttcattttgcactgtgccctgaaaatcatgccgccgtcactagccctgggattctccccaggacaggtttcccttcagctgctctaagccttcgcccttgtccttgtccaaccacggacgtggccatccacggagccctctacgtgcctcagagcaagtgtgcttcggctgctcaggtgtgtgtctagagactgataaaaacagggctcgtgagtgggtgcgggaggcccctgtggtctctgttcacacacgtacctaccctcaaggcca

SEQ ID NO: 92475 - DNA, 601 bp, Human
caacaaggtagccattagcatatcaaagactctgacaagtcctgcagcaaaacaccattgaacattgtttgaaacaaccaatcccaatcttgtttgaccacagagttccattatttctgctcaacagctgataacatctgaacacacgttgggagatgccaccctcatttcctgctttctaggaaatggcaaggggagtcagagctgtgaggaacaccctctcgcagggatgagtggctccacctctacagaaatcatctccagtcatgtgcaccatcgctaggccattcctcctgttctyaccttccttgtctgattcagcccccacagcggcctggagaggtcactagcatcaatgtctccatcatacagatgaggaaattgaggttcacaaaggttaagtgggcacatagccagtaagtggcagatccggtagacaaacccacagcttctgattctaaaccccacattcgttcttctgtatgttgactggaaaagtaaaaatagatcctattctaacaggatcaatcttcccccatcataggcttttaaaaaactcaggtattttttttttccggtagcattgaatgctttaaaaact

SEQ ID NO: 92476 - DNA, 601 bp, Human
catctcaccccaagagataactcaataaacagttgagcatacactattttagatctccatggcccaacaaggtagccattagcatatcaaagactctgacaagtcctgcagcaaaacaccattgaacattgtttgaaacaaccaatcccaatcttgtttgaccacagagttccattatttctgctcaacagctgataacatctgaacacacgttgggagatgccaccctcatttcctgctttctaggaaatggcaaggggagtcagagctgtgaggaacaccctctcgcagggatgagtgsctccacctctacagaaatcatctccagtcatgtgcaccatcgctaggccattcctcctgttctcaccttccttgtctgattcagcccccacagcggcctggagaggtcactagcatcaatgtctccatcatacagatgaggaaattgaggttcacaaaggttaagtgggcacatagccagtaagtggcagatccggtagacaaacccacagcttctgattctaaaccccacattcgttcttctgtatgttgactggaaaagtaaaaatagatcctattctaacaggatcaatcttccccc

SEQ ID NO: 92477 - DNA, 601 bp, Human
tgccgtaagaagggcagcataggccgggcgtggtggctcacgcctgtaatcctagcaccttgggaggctgaggtgggtggatcacgaggtcaggagattgagaccctcctggataacatggggaaaccctgtctctactaaaaatacaaaaattagccggttgtggtggtgcgtgcctgtaatcccagctactcggaaggctgaggtagaagaattgcttgaaccagggagttggaggttgcagtgagccaagatcatgccactgcactccagtctggcaacagagagagactccatctcaaaaaaaaaaaaaaaaaaataaggcagcatgggtgcctgctgagagagagagaaagaagctctttccctgcatgtgttgccatgggattctggcccagctccctggggtgctctctgagctcagctttggccctgtccctctctctctgtgcctcaatttctctaactatgcactgagcaaggagaagaccaccacacctcaagtaccttctgcatgggccatacactgagttttatgaatctcccctctcttgttccacaaatgattactggcccatttctcagacgaggaaactgaagc

SEQ ID NO: 92478 - DNA, 601 bp, Human
ttttgagtgttgggaacatacagtatggggtcctttaaacctgcttttgaaatcccccaacatgtgtgtatgtgtgttctcctgttttcttaaagcctccctgatggcaggggacaagtggctgctagacaagcctggtaggggccagggtgtggaaagcccattccccccctactcatggaccaccatagttcccttgtgatgggctgtttagggggtttccagatttctgtcagggaacaccctgcgtggatgtcttagctgcatccctggttccttccttaggacagattctgggacyggggttgctgagaccagtatagacactgagaggctccggacaccgccccacatcctccccacagctgctctccagccccactcccactggcagcctggacttctcagcttggcagaaagccgggggcagtattccacctcctccagagaaaagccttgtctacacccaaggcctcactgattccatccaacgctgaaaatacccatttactcagctatttctccacgttatggtctaaggcccagatgcttagttccaaccaaaatagccacagaggtcactgtggtctgagggtcctct

SEQ ID NO: 92479 - DNA, 601 bp, Human
aacggaggcatagcaaggtcaggaacgtgttcaagttcacaccctaggtgagtatcagagctgagccttgaacctcagcagcctgatcccagattgtgtttcctggcctggctgtgtggggagctcagacttcatggaaacaaaagacagaacggtggctccagggtccacagcggatcccaagggaccagaggccagcaggggggttggctggggttggaggatgctgcctaggagatctgctcccagagtgatgctagccctgtgtgatgacctgagtccccgcctccttacagggtcwtggctgctggggaggtgctgaggctgtgggtacagccaaacggagctagagcaggctttggactccctgcctggcaagtccaggtgacaggctcagacactgggcactctgtcatttgctgttggcataagtttccactggcaggaatgtgacatttatcacctgagtgggcttccagaagcccactgaatgtcctcagacctggggtggggggccctctcactgcctcacctctgagccttaatcaaatccagggtggctggatgatctgaaggcccttttagctcacggaggcctggg

SEQ ID NO: 92480 - DNA, 601 bp, Human
cctcagtttcctcatctatgaaatggggagaacaaattatttccaagagctccagcaagtcacatcccctattgttggtctttcaggtcatcccagaatttctgctcttataaatagaaaatgacattgaaggtgaaaagcagacagacaagcaagagaatagttaatacaaaaatcatagctaggcgtggtaacttgtgtctgtaatctcagctacttggaagggtgaggtggggggatctacttgaggcctagagttcaagactagcctgggcaacaaagtgagactctgtatctaccaaaaaaaaaaaaaaaaatcaggagagtggtccccaccacttgccacctgtgatgagtagggagagggatgcagtcagggaagggacactggtgggagccctaaggtcccattagtgctttgttttttaaagccaggtggtaggtagatagatgtctgctttattcttcttctttaaacaatacttatattttatacattcttctgtacatgtattttacatgtttaaaaatattttaaaggaaagcaaaagataaaatatagaaaaagttcccctgccccaaacctctgaaaaaatggaca

SEQ ID NO: 92481 - DNA, 601 bp, Human
ggtgctctgctttgaggatgggagagagaaagggaggcaaggacggagaaaagagacttcttttgcgggagcgcagagcagaaaaaccgtctccatcggttaccagggaaggggtttctggtttcagatcccatcacttggtggggccttcctaccaccctccctgctactcgctcttgtcatctgtaaatcagggaaatacttctggaagacagttatctggtctgtgactttgatcattggtctatgactaataattgccctaattttttgaacacctgccgcatgctgggagttttcygccaattgtcgctcaccctcaggtgcctctgaagggcagagattttattctttccatttcacagatggggaaacccaagctccgaaagtaaagagcttttcctctgtgggcctcagaatctgagaagttcaaacaggttctcaggagcccttccagcaccccactcctcgatcagggaggggctgtctgcactctgaccgctgctctcagcgcagagctctccatccaaagcagcaggtgcgtgcagagctacctgccagcagagccatcaaacacggactcttctactgggagccatgg

SEQ ID NO: 92482 - DNA, 601 bp, Human
cgcccaggggaagtgctaatcagacgtgtttccctctgggcctcagtgtttgcatctgaatgcgggggtgcactttcaaggcccctctacatgccatgcgggttccataggaccccagggtttggttgtgacccgaggcccctcctccccacccacctcctctccacctcccgcggggcgccagctcccttgcgtccacatgacctcggatccttccacgcccatccccaccctgttctgcaggtgggtggtcagagggtgctctgctttgaggatgggagagagaaagggaggcaaggamggagaaaagagacttcttttgcgggagcgcagagcagaaaaaccgtctccatcggttaccagggaaggggtttctggtttcagatcccatcacttggtggggccttcctaccaccctccctgctactcgctcttgtcatctgtaaatcagggaaatacttctggaagacagttatctggtctgtgactttgatcattggtctatgactaataattgccctaattttttgaacacctgccgcatgctgggagttttccgccaattgtcgctcaccctcaggtgcctctgaagggcagagat

SEQ ID NO: 92483 - DNA, 601 bp, Human
gagactgcagcccagtcctgggcctcatacactagcaccctgatgccacattcagtgcctctcgcccaggggaagtgctaatcagacgtgtttccctctgggcctcagtgtttgcatctgaatgcgggggtgcactttcaaggcccctctacatgccatgcgggttccataggaccccagggtttggttgtgacccgaggcccctcctccccacccacctcctctccacctcccgcggggcgccagctcccttgcgtccacatgacctcggatccttccacgcccatccccaccctgttcwgcaggtgggtggtcagagggtgctctgctttgaggatgggagagagaaagggaggcaaggacggagaaaagagacttcttttgcgggagcgcagagcagaaaaaccgtctccatcggttaccagggaaggggtttctggtttcagatcccatcacttggtggggccttcctaccaccctccctgctactcgctcttgtcatctgtaaatcagggaaatacttctggaagacagttatctggtctgtgactttgatcattggtctatgactaataattgccctaattttttgaacacctgc

SEQ ID NO: 92484 - DNA, 601 bp, Human; identical to SEQ ID NO: 29802

SEQ ID NO: 92485 - DNA, 601 bp, Human; identical to SEQ ID NO: 29803

SEQ ID NO: 92486 - DNA, 601 bp, Human; identical to SEQ ID NO: 29804

SEQ ID NO: 92487 - DNA, 601 bp, Human; identical to SEQ ID NO: 29805

SEQ ID NO: 92488 - DNA, 601 bp, Human; identical to SEQ ID NO: 29806

SEQ ID NO: 92489 - DNA, 601 bp, Human; identical to SEQ ID NO: 29807

SEQ ID NO: 92490 - DNA, 601 bp, Human
actgaagcctggggcgccttcctgctccttgcacagcattaggtcctattcaggtacccaactccctcaggcctggattctctcctcactggaacttgggtgacccctctggctctgctgtcatcaagatcccattcaatagtgactgctaaaaggtcttctaaactacaaagggtcacatttctgagaaagagaggggtgggccaaccttcagtgcaccaagctgaaaatgccttggggaggtgggatggagctcaggaagctggctggctctatttcattcattcattcattcattcaktcagtcagtcagtcagtcattcattcattctgtggacacagagcctcagcctaccctcccacttccccagccttaatctgaccttcagcaagcagagagaattaaacacaaactcgctttgatggaccagaactccctgctcatagggtctgggtgcccggactctgggtgacctgagcaagtcacatgctaagattcaaagactcagtttccaaggaagaggcctggcctcacagccagaccagcccctgacttttgatcactcctgccctccatgcatccctcagccacccgcagaga

SEQ ID NO: 92491 - DNA, 601 bp, Human
agagcaggcaggggattctgctggaatctcccacaggcagggctgagtctccatgctcatccaggggtcccagcagggcagagtgggcggctctggggtgggctgggctgagcatggagggctctcagaggggccaaccttgcccggtcccttggatcttcccaccaagcgtcaagaccccgtcccgtgcctccctctttctggagtggctcccctctttctggagtggcttctgagtgccgcatccccacccagagcccaactgaggctcctgtccatgctgaccctgcccctggagacrtagggcagggctgccacctccttcaatggagacttgatacctgcacctctattaccaaggcagccacccagctgctgcccatgagagagctcaccgttgactaatggtggtggtgggagtgcaggaagggggctgggtactgaggacgacaaaacgctgcggacccagtgactcatgggacccctctgtgctacggccacgtgctgtccacatgtcgcccctgatctccaggtccgcagggtgggtggcatcatcacacttcatggaggagggagctgaggcccagagaggtcagtgact

SEQ ID NO: 92492 - DNA, 601 bp, Human
cctccctcttgttgcctcgtcctgagccacgcatttaccttccagctcaccccagaaggggccatctcaggtctgggagacccaggcagggaagagcaggcaggggattctgctggaatctcccacaggcagggctgagtctccatgctcatccaggggtcccagcagggcagagtgggcggctctggggtgggctgggctgagcatggagggctctcagaggggccaaccttgcccggtcccttggatcttcccaccaagcgtcaagaccccgtcccgtgcctccctctttctggagtgkctcccctctttctggagtggcttctgagtgccgcatccccacccagagcccaactgaggctcctgtccatgctgaccctgcccctggagacatagggcagggctgccacctccttcaatggagacttgatacctgcacctctattaccaaggcagccacccagctgctgcccatgagagagctcaccgttgactaatggtggtggtgggagtgcaggaagggggctgggtactgaggacgacaaaacgctgcggacccagtgactcatgggacccctctgtgctacggccacgtgctgtc

SEQ ID NO: 92493 - DNA, 601 bp, Human
gttctgtaaataaaaccactgatccagccgctgccggggcccagagagggaggtcacctgtctcaggtggtgcagcaagcctggcttctgacgccgtgggtctccaggcccagcctctgtccctccctcttgttgcctcgtcctgagccacgcatttaccttccagctcaccccagaaggggccatctcaggtctgggagacccaggcagggaagagcaggcaggggattctgctggaatctcccacaggcagggctgagtctccatgctcatccaggggtcccagcagggcagagtgggyggctctggggtgggctgggctgagcatggagggctctcagaggggccaaccttgcccggtcccttggatcttcccaccaagcgtcaagaccccgtcccgtgcctccctctttctggagtggctcccctctttctggagtggcttctgagtgccgcatccccacccagagcccaactgaggctcctgtccatgctgaccctgcccctggagacatagggcagggctgccacctccttcaatggagacttgatacctgcacctctattaccaaggcagccacccagctgctgcccatgagag

SEQ ID NO: 92494 - DNA, 601 bp, Human
gtgacccagacacagcagccactgtctacccagcagcagggtggggcgccgggcccgaggccggctctgcggcctgtcaggagatttacacccgactcttaacagcctcgcggaatcgcaggcgggtgccgggcctggggtggtctgctgtgaatcggccccctgtgagcagatgaaagccgggtcggtggctgggcagggaaacgggctggccgggggccagcgggcagggaggcgagcggttccctcccagggctgcaagtggggcttccagcggcctggggttgattaggagaacccrggaggtctgtggttaaccccttccctcctgctgggcagactccgctagccctgcccctagcgcaggagacactcctgggggttgtggggatcttgggagccagggacctggagcagctgcctctcctcagcccaggaagaaactacagaaactctaaggccttcaaaggcccaactgcgggctcagggtcacttctcctgcccacgccaaaccctcggcagccacactctgctggctgctcacttcaggcccctgctcaaaggtcacctcttcaggaggcctccccgccccatcccttgt

SEQ ID NO: 92495 - DNA, 601 bp, Human
agccttcttggccgcctggtgcggctgtgacccagacacagcagccactgtctacccagcagcagggtggggcgccgggcccgaggccggctctgcggcctgtcaggagatttacacccgactcttaacagcctcgcggaatcgcaggcgggtgccgggcctggggtggtctgctgtgaatcggccccctgtgagcagatgaaagccgggtcggtggctgggcagggaaacgggctggccgggggccagcgggcagggaggcgagcggttccctcccagggctgcaagtggggcttccagmggcctggggttgattaggagaacccgggaggtctgtggttaaccccttccctcctgctgggcagactccgctagccctgcccctagcgcaggagacactcctgggggttgtggggatcttgggagccagggacctggagcagctgcctctcctcagcccaggaagaaactacagaaactctaaggccttcaaaggcccaactgcgggctcagggtcacttctcctgcccacgccaaaccctcggcagccacactctgctggctgctcacttcaggcccctgctcaaaggtcacctcttca

SEQ ID NO: 92496 - DNA, 601 bp, Human
gtaatctgaccccggaacccacgctcccaccacatgctcccttgccctccgtagggcagacttcccggaggaggggagtccaacagcacttcggaaatagcttccttgttactgtggaacgctggagccactgccagggaggggagaggggagccaaggcggccccacgtggccagggcgccagagagtctcagagccacagggccagggctctcacactgggaataggacagaagttccagtgcctgaggaaagaagatggtcttcagaaaaagcctctttcattcggttacccagagcragagctgcgtggggagctctggctctaacccactccgtcaccttgggcccagtcctgctacgcctcagtttcccctctgcacagtctgctcactgaggccccttccttttgaaagtccctgatttaaggtagcaaagatcagccgctggtcagaggggccccagaaagaaaagaaggcagggctgctggccccagggcccacccactaccacttcttcctgctgctgctgttcccagtatttcttgaatattctctgccccccactcttcagagcctcagctcaggacagcctctgccag

SEQ ID NO: 92497 - DNA, 601 bp, Human
agagaatggtcgttatgtgccaccccacatatctaaacctctacaacacacggtgatccaaacctctacaacacgcggtgatctaaacctctacaacacgcggtgatctaaacctctacaacacgcggtgatctaaacctctacaacacactgtgatgtaaacctctacaacacgcggtgatctaaacctctacaacacacggtgatccaaacctctacaacacacggtgatctaaacctctacaacacacggtgatctaaacctctacaacacactgtgatgtaaacctctacaacacgyggtgatctaaacctctacaacacactgtgatgtaaacctctacaacacgcggtgatctaaacctcaaccacacgcggtgatctaaacctctacaacacgcggtgatctaaacctctacaacacgcggtgatccgaacctcaaccacacgcggtgatccgaacctctacgacacacggtgatccgaacctctacgacacgcggtgatccgaacctctacgacacgcggtgatccaaacctctatgacacgcggtgatccgaacctctacgacacgcggtgatccgaagctctacgacacgc

SEQ ID NO: 92498 - DNA, 601 bp, Human
tctggggctggctgctgaagtggcttgtggtgctgagtgagcctcgggggctgggtgtgctcggtgtcacccgcatgcgcagccgttccaggtccccaaagcggtcagggaacggcttggtctggtcctccagcttctgccggtgccctgcagagcacaggaagcccatcagccgttgcttccccagagtctcagtggagacagaaatgcctcactctgctgggaagttcttcctgaggtctgaccttaggcctctgctgggagaaccctgaggtcaccgccagcctcttcacagaggttktcaaaagactttctgaacagagaatggtcgttatgtgccaccccacatatctaaacctctacaacacacggtgatccaaacctctacaacacgcggtgatctaaacctctacaacacgcggtgatctaaacctctacaacacgcggtgatctaaacctctacaacacactgtgatgtaaacctctacaacacgcggtgatctaaacctctacaacacacggtgatccaaacctctacaacacacggtgatctaaacctctacaacacacggtgatctaaacctctacaacacactgtgat

SEQ ID NO: 92499 - DNA, 601 bp, Human; identical to SEQ ID NO: 27471

SEQ ID NO: 92500 - DNA, 601 bp, Human; identical to SEQ ID NO: 27472

SEQ ID NO: 92501 - DNA, 601 bp, Human; identical to SEQ ID NO: 27473

SEQ ID NO: 92502 - DNA, 601 bp, Human; identical to SEQ ID NO: 27474

SEQ ID NO: 92503 - DNA, 601 bp, Human; identical to SEQ ID NO: 27475

SEQ ID NO: 92504 - DNA, 601 bp, Human; identical to SEQ ID NO: 27476

SEQ ID NO: 92505 - DNA, 601 bp, Human; identical to SEQ ID NO: 27477

SEQ ID NO: 92506 - DNA, 601 bp, Human; identical to SEQ ID NO: 27478

SEQ ID NO: 92507 - DNA, 601 bp, Human; identical to SEQ ID NO: 27479

SEQ ID NO: 92508 - DNA, 601 bp, Human; identical to SEQ ID NO: 27480

SEQ ID NO: 92509 - DNA, 601 bp, Human; identical to SEQ ID NO: 27481

SEQ ID NO: 92510 - DNA, 601 bp, Human; identical to SEQ ID NO: 27482

SEQ ID NO: 92511 - DNA, 601 bp, Human; identical to SEQ ID NO: 27483

SEQ ID NO: 92512 - DNA, 601 bp, Human; identical to SEQ ID NO: 27484

SEQ ID NO: 92513 - DNA, 601 bp, Human; identical to SEQ ID NO: 27485

SEQ ID NO: 92514 - DNA, 601 bp, Human; identical to SEQ ID NO: 27486

SEQ ID NO: 92515 - DNA, 601 bp, Human; identical to SEQ ID NO: 27487

SEQ ID NO: 92516 - DNA, 601 bp, Human; identical to SEQ ID NO: 27488

SEQ ID NO: 92517 - DNA, 601 bp, Human; identical to SEQ ID NO: 27489

SEQ ID NO: 92518 - DNA, 601 bp, Human; identical to SEQ ID NO: 27490

SEQ ID NO: 92519 - DNA, 601 bp, Human; identical to SEQ ID NO: 27491

SEQ ID NO: 92520 - DNA, 601 bp, Human; identical to SEQ ID NO: 27492

SEQ ID NO: 92521 - DNA, 601 bp, Human; identical to SEQ ID NO: 27493

SEQ ID NO: 92522 - DNA, 601 bp, Human; identical to SEQ ID NO: 27494

SEQ ID NO: 92523 - DNA, 601 bp, Human; identical to SEQ ID NO: 18466

SEQ ID NO: 92524 - DNA, 601 bp, Human; identical to SEQ ID NO: 18467

SEQ ID NO: 92525 - DNA, 601 bp, Human
gcaggaatattttctaagaggataattgaatttggtggatataacacttgacttctgaggtactgaagtagcctcaaattagcaccattaatcagtcattcagctgtcctcacataagtatctaggagagaagacttagataccaccaatagaagtaagaagacctgttgctataagaaagtaaaatagtataaatgagttctggataagcagctgctggacatctttactaacccatttatgccggaggctgcaaatttttttgcgtgaaaattcagaccttggttatgaccttgagcagtaggatataaataactctcacaaacttagcattccaataatgaaacactaggcataaatcggttaagaggtagatatgattccataagatagttaatctctacttttacatttctgttcctctacaaaacaaaaatacttcaagcttaatcatcagctctgatgaaattactttagtagatctgactttactccttttaatttagtaaacaaatactgactgtactaatttgctgtgtgcaccataaagatcagatgcaaagaggaaggatgcctatttgcacaagattggagaattcaa

SEQ ID NO: 92526 - DNA, 601 bp, Human
atacataatcagcagactggctcactagatactgaggaccaactgaatggcacaagacaagatattttgagatcctctatactagggtcaaattttagaattaaaaaaaaatattcaccaggatatagagcacttgcctatacgaatcctgctactgctcattttagttttgatgctgtagacttatggttagtaaagaatgtactatgagtggacaataagtcttagaggagacatgtttcataggtgatgattcatttaaaatttcactgtctgccttgttaatctgagatatctgackttgaataagcatgtaatgtgaccatggacaacataaagttaagcagatcagtgagaaatcaactaattagtggccaaagtcataaacagataaggcagcaggacaggcaggaatattttctaagaggataattgaatttggtggatataacacttgacttctgaggtactgaagtagcctcaaattagcaccattaatcagtcattcagctgtcctcacataagtatctaggagagaagacttagataccaccaatagaagtaagaagacctgttgctataagaaagtaaaatagtataa

SEQ ID NO: 92527 - DNA, 601 bp, Human
caatatgataataaccacagatgctattatccacagaatattcaaaatagcatcaacattatttcaaatatttggcaaaacaaagatataaaccaaaaccaaaatgaacagtaacacaaataaaaatttcaacattaaaaagggaaataatactgaaaaaaaaggtataaaatgggccgggcacagtggctcacgcctgtcatcccagcactttgggaggccgaggcgggtggatcacgaggtcaggagatcaagaccatcctggctaacacggtgaaaccccgtctctactaaaaatacaaaaaaaaaaaaaaaaaaaaattagctgggcgtggtggcaggcacctatagtcccagctactcgggaggccaaggcaggagaatggcgtgaacctaggaggtggcagggcttgcagtgagtggagatcacgccactgcgctccagcctgggcgacagagcgacactctgtctcaaaaaaaaaaaaaagggtataaaatggtttctagaaagctgctttctaagactttctggtgaggtaactcaagatttagaaaaattttaatttagtatttcctgaaaatagataaatgtgtgagaaac

SEQ ID NO: 92528 - DNA, 601 bp, Human
atcaacaacattgggcaatatgataataaccacagatgctattatccacagaatattcaaaatagcatcaacattatttcaaatatttggcaaaacaaagatataaaccaaaaccaaaatgaacagtaacacaaataaaaatttcaacattaaaaagggaaataatactgaaaaaaaaggtataaaatgggccgggcacagtggctcacgcctgtcatcccagcactttgggaggccgaggcgggtggatcacgaggtcaggagatcaagaccatcctggctaacacggtgaaaccccgtytctactaaaaatacaaaaaaaaaaaaaaaaaaaaattagctgggcgtggtggcaggcacctatagtcccagctactcgggaggccaaggcaggagaatggcgtgaacctaggaggtggcagggcttgcagtgagtggagatcacgccactgcgctccagcctgggcgacagagcgacactctgtctcaaaaaaaaaaaaaagggtataaaatggtttctagaaagctgctttctaagactttctggtgaggtaactcaagatttagaaaaattttaatttagtatttcctgaaaatagat

SEQ ID NO: 92529 - DNA, 601 bp, Human
ggagataggctggaagaataacttgtgttaaggcttaacatatcaacattaccctgagacatcaaaatttctcttaaaaactagcttctgacacagaacaaagctgcttaataaaagtaaattaaataattaaagttgatctttttggagctactacaaattctagataacatctcacttctagtcacattactttgagtgtaccagaataactcactgatctcacatacgtaggtatacagaggagtggtatatgctgtgataaagttacttttgaaaatcattttctattttcaataayttaaaagagacattgcttattctaaactcacaatatttcctttttgttataactagttattagcaaacaatgactagcaagctgttagtgaaaagtgacactggaagaggatttatacattttgtgagtcacatatcaacaacattgggcaatatgataataaccacagatgctattatccacagaatattcaaaatagcatcaacattatttcaaatatttggcaaaacaaagatataaaccaaaaccaaaatgaacagtaacacaaataaaaatttcaacattaaaaagggaaataat

SEQ ID NO: 92530 - DNA, 601 bp, Human
ttgcaatttaatatacatcattcctatcttattcagagactgtaatcttaaattccactgcctacttggataaccaaagaaaagagaatcaatatacacctaaatttttaaagaaggaagacaaccaagtgttcctttaaagaaagactttactcctaggattcttctttgctgctaggatttttatgattgatcagtttatctcaaaagttagttaaaataagtataaatggcaaattacttatataggtccaatgctcctcttaagatatattttttggagtgctttctgtgatgtccrcaaaaagactactaacacaactgataagtaattttatttattttttttattttttgagacggagtcttgctctttcgcccaggatggagtgcagtggcacgatctcggctcactataagctcccgggcttacaccattctcctgcctcagcctcccgagtagctgggactacaggcgcccgccaccacacccggctaattttttgtatttttagtggagacggggtttcaccgtgttagccaggatggtcttgatctcctggccttgcgatccacctgcctcggcctcccaaagtgctgg

SEQ ID NO: 92531 - DNA, 601 bp, Human
cccattaccaaaacctactgcaaacaccaatgaataaatatgccttgagatttgaatctggaaaatggcaatatgatttattccacacctctttacctgacccaagacaaatatgtgtgagtttcaaatgagcaacagagagatgtgagaaagtaacaataatgcttcaaaggaaaaaaaactttgaaaagctaactgataaattgttagtccaggataaaatagttaaaattataacccacgtgaaagcacccaagaaaaaattttaaattataattgtatctctggttataactaagayaaagacactgttctcaaatatttatctagctattaatagatctactatacttacaaattcttaatatgttcaattaatcaatctctaatgtgcccatatttacactctgagaatgaattcactgtttggaatagcaatgcctggaaaactgtggtgtagtgaacttaggagacaaaagaatcagaatctagagtccaaatctgctatatatgagcaaagttactataggcaagtctcttagttttgttgttttctcatatatacaatgccagccctacctgaaaacattattgtgattat

SEQ ID NO: 92532 - DNA, 601 bp, Human
ctcaggtaaacaattatatcacaagatatttaatttaatccatgcatttgtacataaacattgtcaagaacaaatgtttctggatgcaatgaaaggaaattatgtcaaaaccaattaagagccatagatgcacattaggagacaaagtcagaaaatgcccattaccaaaacctactgcaaacaccaatgaataaatatgccttgagatttgaatctggaaaatggcaatatgatttattccacacctctttacctgacccaagacaaatatgtgtgagtttcaaatgagcaacagagagaygtgagaaagtaacaataatgcttcaaaggaaaaaaaactttgaaaagctaactgataaattgttagtccaggataaaatagttaaaattataacccacgtgaaagcacccaagaaaaaattttaaattataattgtatctctggttataactaagataaagacactgttctcaaatatttatctagctattaatagatctactatacttacaaattcttaatatgttcaattaatcaatctctaatgtgcccatatttacactctgagaatgaattcactgtttggaatagcaatgcctg

SEQ ID NO: 92533 - DNA, 601 bp, Human
ttccttttatttgtctgctctgttcctgctggattcccactatacccttatgttaaaaccaatgtatgttgccatgttatactgccagcacactaagtagagataacagagtaagttaaaagttgcattttgtgtatcaaaatattcataattactatcttaaatgcttggaaataatttttcaaggttaaatatttgggttgatactaagctctgctaccttcaagcagacctgctgcatgttgacaacctttactttttctgatatatcattctgttagtgctgggcaaatactgccaycagatttttttttttttctttctgagttgcactgaagggctagccattagatttcaagagagaataaaaacttcatacaaagcacacatagatgagaatcatttctcacttaaggccccaatgctgcccttttgaattcatttaacgcttcagagaaaaaagtctagactttaatgtcattcattacataaaaagacagtttctaggcgataacacagtctggggcctaagctgataagctcaaacacctttacacatcaatcattctcagaattattcctttatgcttcaccatctgcc

SEQ ID NO: 92534 - DNA, 601 bp, Human
attgggtactaggtactcaaactggaggtaatcttttttgggggtaaaaaaaataacttcagaataccatcaatgtaatgttctccaccactacaacttttgaacaagaggcctttttgaaccagatgtttgacaaagccgttacttctaatgagaaagactagtcctaatttaagcttatcttttattagttgaataactgtggactggtcacttcaataattacaaaaattcacaggtaggtatcatcatagttacaaatctgctaaaactgggtttctacaatcccagggtaaaatgmaaatttaatatcatcactaagccttactgtagatcataaaagattccactcattatgctgggtcagaaatactaaaataagcccgttatatatcatcaatgagagtcaaactaaattactccctgaaaaaaaaggcttccttttatttgtctgctctgttcctgctggattcccactatacccttatgttaaaaccaatgtatgttgccatgttatactgccagcacactaagtagagataacagagtaagttaaaagttgcattttgtgtatcaaaatattcataattactatcttaaa

SEQ ID NO: 92535 - DNA, 601 bp, Human
actgtgatgatctttctgggttctcttctttggccaggttgagatcttcgtgacccaacattcaacaactaggacaagaatattacagctattcagagtacttacaatttattggctttgttgtgctgttcaagtcaagtctgatgactacgccaagcaatgctagatgcaaagattgggtactaggtactcaaactggaggtaatcttttttgggggtaaaaaaaataacttcagaataccatcaatgtaatgttctccaccactacaacttttgaacaagaggcctttttgaaccagawgtttgacaaagccgttacttctaatgagaaagactagtcctaatttaagcttatcttttattagttgaataactgtggactggtcacttcaataattacaaaaattcacaggtaggtatcatcatagttacaaatctgctaaaactgggtttctacaatcccagggtaaaatgcaaatttaatatcatcactaagccttactgtagatcataaaagattccactcattatgctgggtcagaaatactaaaataagcccgttatatatcatcaatgagagtcaaactaaattactccctga

SEQ ID NO: 92536 - DNA, 601 bp, Human
gcattaatccaagtgccttaaatacatcttcactgtcaatgatgaagatccagtaggaagttttaactatctttataagccatttaggcccattatcattaagcatttctcacggagattggagagaaggacaaaaaagacttttttttcttttttccaaaaaaggttgagatatgttgaaatggagagaattatctcagcaatgtgatgaaggatgtccttaggaaccctgtggcaaatgtttggggataatcactaaagagataaacaaaagcaaaccgccaagtacagtttgacagcrtggctagttgttggattgcctcatcttcatctttgttttgtattaactactctgtgggttcgcttatttactgaacaattatttactgagaatttactctctctaacagtggtcctcaaccttttggcactaggaactggttttgtggaagataatttttccacagaccagggttgggggtggggttgagcggggaagaggaaagtggtttttaggataaaattgttccacctcagatcatcaggtattagttagattctcataaggagcgtgcaacctagatcgcttccatgtacagtt

SEQ ID NO: 92537 - DNA, 601 bp, Human
agatgctgaggagggaggatcgcttgagcccagcaggtcaaggctacagtgagctgtgacagagccactgaactttaaccttggtgacagagtgaaaccctgtctcaaaaaaaaaaaaaacatttcgctataactaaatatctagttgatgtccagtaaattctgtgttaggtacaaatgaagcacgaaacacagttattgccttctacagaatcaaaatctagttgcagggacaatacatttaaaaacgaagtgataaagcaagtactagggttgattagagaccagaaaggggaatagyttaggtacatgaggtcagaggaactggattagtcgaggaatgcctttagaaggaaatgagggccgggggtggtggctcacgcctgtaatccccgcactttgggaggccgaggtgggcagatcacgagttcaggagatagagaccatcctggcttacacggtgaaacctggtctctactaaaaatataaaaagttagccaggcatggtggacacgcctgtaataccaactacttgggaggttgaggcagaagaatcacttgaacctgggaggcggaggctgcagtgagccaagatcgcacc

SEQ ID NO: 92538 - DNA, 601 bp, Human
ttaagaccctctttcaaaaaaaaaaagcctgggcatggtagttcatacctggaatcccagcaattgggaggctaaagcaggaggaccgcttgagcccaggagttcaagaccagcctgggcaacagaatgagacctggtctctacaaaaaaatcagccaggcatggtggcacatgcctgtagtcccagatacttgagatgctgaggagggaggatcgcttgagcccagcaggtcaaggctacagtgagctgtgacagagccactgaactttaaccttggtgacagagtgaaaccctgtctcaaaaaaaaaaaaaacatttcgctataactaaatatctagttgatgtccagtaaattctgtgttaggtacaaatgaagcacgaaacacagttattgccttctacagaatcaaaatctagttgcagggacaatacatttaaaaacgaagtgataaagcaagtactagggttgattagagaccagaaaggggaatagtttaggtacatgaggtcagaggaactggattagtcgaggaatgcctttagaaggaaatgagggccgggggtggtggctcacgcctgtaatccccgcactttgggagg

SEQ ID NO: 92539 - DNA, 601 bp, Human
ggaaggctgaggtgggagcccaggaggttgaagcttcagcgagccatcattgtgccactgcactccagcctgggcaatagatttaagaccctctttcaaaaaaaaaaagcctgggcatggtagttcatacctggaatcccagcaattgggaggctaaagcaggaggaccgcttgagcccaggagttcaagaccagcctgggcaacagaatgagacctggtctctacaaaaaaatcagccaggcatggtggcacatgcctgtagtcccagatacttgagatgctgaggagggaggatcgctygagcccagcaggtcaaggctacagtgagctgtgacagagccactgaactttaaccttggtgacagagtgaaaccctgtctcaaaaaaaaaaaaaacatttcgctataactaaatatctagttgatgtccagtaaattctgtgttaggtacaaatgaagcacgaaacacagttattgccttctacagaatcaaaatctagttgcagggacaatacatttaaaaacgaagtgataaagcaagtactagggttgattagagaccagaaaggggaatagtttaggtacatgaggtcagaggaac

SEQ ID NO: 92540 - DNA, 601 bp, Human
tttttaggcccaggagcagtggctcacgcctgtaatcccagcactttgggaggccaaggagggcagatcacttgaggcccggagttccagagtagcctggtcaatgtggtgaaaccccgtctctactaaaaatacaaaaaattagccgggcatggtggggcatgcctgtagtcccaactactcgggaggctgaggcaggagaatcgcttgaacccaggaggcggaggttgcagtgagctgagatcgcgtcactgtactccagccagggcgacacagtgagactccatctcaaaaaaaaacaaaaaaaaacaaaaaaaaattaacaaattagccaggtatagtggtccatgcctatagtcccagctacttggaaggctgaggtgggagcccaggaggttgaagcttcagcgagccatcattgtgccactgcactccagcctgggcaatagatttaagaccctctttcaaaaaaaaaaagcctgggcatggtagttcatacctggaatcccagcaattgggaggctaaagcaggaggaccgcttgagcccaggagttcaagaccagcctgggcaacagaatgagacctggtctctacaaaaaa

SEQ ID NO: 92541 - DNA, 601 bp, Human
gggctgaggcaggaagatcgcttgagcctgggaggtcaagccttcagtgagctgagatcatgcctctgcactccagcatgggtaacagtgagaccctgtctccaaaaaaagaaaaattacacacacacacacacacacacacacacacacacacacaaaatcatttattggataagctacaggagctcatgcctgtaatcccaacactttgggaggccaaggcaggaggactgcaggaggccaggagtttgggcaacactgcctctaaaaaatttttaggcccaggagcagtggctcacgyctgtaatcccagcactttgggaggccaaggagggcagatcacttgaggcccggagttccagagtagcctggtcaatgtggtgaaaccccgtctctactaaaaatacaaaaaattagccgggcatggtggggcatgcctgtagtcccaactactcgggaggctgaggcaggagaatcgcttgaacccaggaggcggaggttgcagtgagctgagatcgcgtcactgtactccagccagggcgacacagtgagactccatctcaaaaaaaaacaaaaaaaaacaaaaaaaaattaacaaatt

SEQ ID NO: 92542 - DNA, 601 bp, Human
gctctttggaaggcagaggagggcagattgcttgagctcaggggtttcgagaccagcctgagcaacatggcgaaaccccatcactataaaaaatacaaaaattagctgggtgtgtagtaagcacctgtagtcctagctacttgtggggctgaggcaggaagatcgcttgagcctgggaggtcaagccttcagtgagctgagatcatgcctctgcactccagcatgggtaacagtgagaccctgtctccaaaaaaagaaaaattacacacacacacacacacacacacacacacacacacacaaaatcatttattggataagctacaggagctcatgcctgtaatcccaacactttgggaggccaaggcaggaggactgcaggaggccaggagtttgggcaacactgcctctaaaaaatttttaggcccaggagcagtggctcacgcctgtaatcccagcactttgggaggccaaggagggcagatcacttgaggcccggagttccagagtagcctggtcaatgtggtgaaaccccgtctctactaaaaatacaaaaaattagccgggcatggtggggcatgcctgtagtcccaactactcg

SEQ ID NO: 92543 - DNA, 601 bp, Human
cagctctttggaaggcagaggagggcagattgcttgagctcaggggtttcgagaccagcctgagcaacatggcgaaaccccatcactataaaaaatacaaaaattagctgggtgtgtagtaagcacctgtagtcctagctacttgtggggctgaggcaggaagatcgcttgagcctgggaggtcaagccttcagtgagctgagatcatgcctctgcactccagcatgggtaacagtgagaccctgtctccaaaaaaagaaaaattacacacacacacacacacacacacacacacacacacacaaaatcatttattggataagctacaggagctcatgcctgtaatcccaacactttgggaggccaaggcaggaggactgcaggaggccaggagtttgggcaacactgcctctaaaaaatttttaggcccaggagcagtggctcacgcctgtaatcccagcactttgggaggccaaggagggcagatcacttgaggcccggagttccagagtagcctggtcaatgtggtgaaaccccgtctctactaaaaatacaaaaaattagccgggcatggtggggcatgcctgtagtcccaactact

SEQ ID NO: 92544 - DNA, 601 bp, Human
gaagaaacacttgaacctgggaggcagcggttgcaatgagctgagatcgcaccactgcactgcagcttgcgcaacagagtgagactctgtctcaaaacaaaaaagatggaaaaaaatatgaaaactataaatcactgatgaaggaaatcaaagagggcttaaataaatgaagatatatatcatgttcttgtattagaagattcattattgttaagatgtcagttttccccaaagtgatctgcagatatatcatcataatccaaatcctaatagggccttttgttttttgttttgggtagamaacaaggagctgattctaaaatttatatgaacacacacacacacacacaaaaccctagaagagcctaaataattttgaagaaaaacaaaaagttggagaattgaattcacacaaccagatttcaaaactttctatataaagacagagtggtgttggccagaggacagacacatagctagatgaagaagaatgtagagtctagaaatagatgcacacatatacgatgaactgattttcaacaaagatgccaaaacatttcaatggagaaaggataatcttttcaacaaatggtgctggaac

SEQ ID NO: 92545 - DNA, 601 bp, Human
tttcttcatattccaatccaatttgtacttattgccagatcatttcaaaggccattttcatcaatatcactcctccattaaactacctaaacaccacttaactgcctatctgataaaattcaaaactgggaaagagcattaaagtgtgatccagaggatctgggatctagtcctaattttaatgagtcatggatgtcatggctaccacaatgaaaatgagagcccagaaatggagaattagtttgcttccatataactatggcacatcaggaggcactatggcaagtgattgagttaaatmatccctgatttgaattctagcaatgccacttactagttacatcaccctgagaagttatttttccttttcaagctcagcttttggttcaataaagtggggctagtaacactgaccattcaggattagaataaccattaaaaataatatgtatatataaagcctctatccatattgcaacttagtaggtgctgaatagactatttttattataataatcatcctcattctatagccaacattcaaaaccttcacaaattggacctaaaaggtctaacatagtttcaatttatttagggctta

SEQ ID NO: 92546 - DNA, 601 bp, Human
ttctatgaactgcccatatttttattaggctgtttttttcctactgatttgcttctttttcttccttaatcctggattctaatattctgtcagttaatgcactccaaacagatactcctaggttgtggttttatctttgtatttatttatagtatcttttgctgcatcaaagattataaattttaacagtcaaatcttatacctttatccttcatgttttgaattttgctaaagaaatctttccctactcaaaagttcatgaaaatagcctccttgatattcttataaaaggttagctttycaaatttagatatttaataatcccataatgtttgatgtgtgtagtaggattctatgtttctatgttcactgttaccattttatttcagtctctcaatccctcaaaagtaatcaactacagtgtcagaagtcaggacagtggttaccttttttgctttccctgagactaggtctcactctgtcaccaggctggagtaagtaccatagtattatcatggtccactgcagccgtgacctcctggactcaagggatcctcccacctgagcctccctagtagctgggactacaggtgggactact

SEQ ID NO: 92547 - DNA, 601 bp, Human
tttcctttttaataatcgccattctgactggcatgagatggtatctcattgtggttttgatttgcatttctccgatgatcagtgatgttgaactttttttcatatatttgttggccgcgtaaatgtcttattttgagaagtgctgtcattgattatcttttctaaagtttatcacccagtggattttcatttctatgaactgcccatatttttattaggctgtttttttcctactgatttgcttctttttcttccttaatcctggattctaatattctgtcagttaatgcactccaaacaratactcctaggttgtggttttatctttgtatttatttatagtatcttttgctgcatcaaagattataaattttaacagtcaaatcttatacctttatccttcatgttttgaattttgctaaagaaatctttccctactcaaaagttcatgaaaatagcctccttgatattcttataaaaggttagcttttcaaatttagatatttaataatcccataatgtttgatgtgtgtagtaggattctatgtttctatgttcactgttaccattttatttcagtctctcaatccctcaaaagtaa

SEQ ID NO: 92548 - DNA, 601 bp, Human
tataatgctaaacaatttccaaagtggctgttgcaatcagtatgcgagagttcttgttgtttcacgtttgtaaatatctggtacatttagcaatttgatgttattgcatagtacatgaacatcttcaacattattgcccaattgccctcataaatggttatattcgtctttaaaaacatttaaaatgggattttttttttcaatctagtgggggtgaattttacagaactatggtttatcttttcttagtttatcacttccctaataatgaataacattgaatgtcttttttttttccttaaaaaaaaaaaaaaccacgagatacaggtgcaggatgtgcaggtttgttacataggtatacatgtgccatggtggtttgctatacctactgacctgtcctttaagttccctcccctcaacccccatcccccaaaaagccctggtgtgtgttgttcccctctctgtgtccatgtgttctcaatgtgaaactaccacttatgagtgagaacatgcagtgcttagttttctgttccagtgttattttgctgaggatgatggcttccagcttcatccacgtccctgaaaaggacatgatctcatt

SEQ ID NO: 92549 - DNA, 601 bp, Human
acaacatttttgtatatatttcctagcatatgagatatgtatgtttattggttgtgtatatacctaagaattgaaatgctagttatggcagaaaaacttcagctttagtatataatgctaaacaatttccaaagtggctgttgcaatcagtatgcgagagttcttgttgtttcacgtttgtaaatatctggtacatttagcaatttgatgttattgcatagtacatgaacatcttcaacattattgcccaattgccctcataaatggttatattcgtctttaaaaacatttaaaatgggattttttttttcaatctagtgggggtgaattttacagaactatggtttatcttttcttagtttatcacttccctaataatgaataacattgaatgtcttttttttttccttaaaaaaaaaaaaaaccacgagatacaggtgcaggatgtgcaggtttgttacataggtatacatgtgccatggtggtttgctatacctactgacctgtcctttaagttccctcccctcaacccccatcccccaaaaagccctggtgtgtgttgttcccctctctgtgtccatgtgttctcaatgtgaaacta

SEQ ID NO: 92550 - DNA, 601 bp, Human
acttactcttgtgagaatccatgcccatgtagttgtacttcagattcactgtccttgtataaacatgctacgatttatccattctactattaacaggcattttttcatttttctttcctgtataaaaaatgctacaacatttttgtatatatttcctagcatatgagatatgtatgtttattggttgtgtatatacctaagaattgaaatgctagttatggcagaaaaacttcagctttagtatataatgctaaacaatttccaaagtggctgttgcaatcagtatgcgagagttcttgtkgtttcacgtttgtaaatatctggtacatttagcaatttgatgttattgcatagtacatgaacatcttcaacattattgcccaattgccctcataaatggttatattcgtctttaaaaacatttaaaatgggattttttttttcaatctagtgggggtgaattttacagaactatggtttatcttttcttagtttatcacttccctaataatgaataacattgaatgtcttttttttttccttaaaaaaaaaaaaaaccacgagatacaggtgcaggatgtgcaggtttgttacataggta

SEQ ID NO: 92551 - DNA, 601 bp, Human
tgaacattaaataacaaatcatgtagtatctttttgggtctgccctcttttactcaaacttactcttgtgagaatccatgcccatgtagttgtacttcagattcactgtccttgtataaacatgctacgatttatccattctactattaacaggcattttttcatttttctttcctgtataaaaaatgctacaacatttttgtatatatttcctagcatatgagatatgtatgtttattggttgtgtatatacctaagaattgaaatgctagttatggcagaaaaacttcagctttagtakataatgctaaacaatttccaaagtggctgttgcaatcagtatgcgagagttcttgttgtttcacgtttgtaaatatctggtacatttagcaatttgatgttattgcatagtacatgaacatcttcaacattattgcccaattgccctcataaatggttatattcgtctttaaaaacatttaaaatgggattttttttttcaatctagtgggggtgaattttacagaactatggtttatcttttcttagtttatcacttccctaataatgaataacattgaatgtcttttttttttcctta

SEQ ID NO: 92552 - DNA, 601 bp, Human
aggtaatccgcctgccctggcctcccaaagtgctggaattacagctgtgagccactgcgcccagccttgcttttgtttcacaaagaaaacatgcaacctttaacactatagacaggtatccccaaacaccaaagttagtttttgtttcatttttgaacattaaataacaaatcatgtagtatctttttgggtctgccctcttttactcaaacttactcttgtgagaatccatgcccatgtagttgtacttcagattcactgtccttgtataaacatgctacgatttatccattctactatyaacaggcattttttcatttttctttcctgtataaaaaatgctacaacatttttgtatatatttcctagcatatgagatatgtatgtttattggttgtgtatatacctaagaattgaaatgctagttatggcagaaaaacttcagctttagtatataatgctaaacaatttccaaagtggctgttgcaatcagtatgcgagagttcttgttgtttcacgtttgtaaatatctggtacatttagcaatttgatgttattgcatagtacatgaacatcttcaacattattgcccaattgccct

SEQ ID NO: 92553 - DNA, 601 bp, Human
cagctggccactttttcagtttttaagaaactaaatattacagtaaaacttaaaagcctatagtggtttttaagcttttcactctattgcttgtttttgtttcaaaaattttttaaggttcagcaataaattatgaaaaagcaaactccataaataccaccaggtatggtaaccaggtcaagatacagaacactgaaagcttctcagaagctccacttaaatttccttccaaagcacatccacaaccccttgtctccaaagttatacaaaagcctcctagacttttataactttcttgcctttttttttttttttttttttttgagacagagcctcactctgtcggccaggctggagtgcagtggcatgatctcagctcactgcaacctcaacctccctgcctcaagcaattctcctgcctcaagcaattctcctgcctcagcctcccaagtagctgggattacaggcatgcgccaccatgcccagctaatttttgtatttttagtagagatggggtttcaccatgttggccaggctggccttgaactcctgacctcaggtaatccgcctgccctggcctcccaaagtgctggaattacag

SEQ ID NO: 92554 - DNA, 601 bp, Human
gttgagatcagactcccagatactagttcaattttttattcactgtcttcagtttctttgattctgttgggaggtattatttttcaagctaataattaccttaagggaattcttttaaatgcctgtggtctagaggtttggaaaatgttgtatacagtagatctttcctgtctgacttcacaggaaacattagcatagtaaacaggggcttgaaggaaacaaatctgcttatgccagcattgctgaaacacatactaacagctcaattttgggcatttcacttttgggcaacactggcccrtggacatgtcatcttgaaaaagcaattgggtagactccatttcttttcttttctctgtcttttttttttgagacagggtctcgctctgtcacccagactggagtgcagtggtgcaatcttggcttactgcaacctccacctcctgggttcaagtgattctcgtgcctcagcctcccaagtagctggcgtgataggcatgcgccaccatgcccagctaattcatttcttttccaacagtacaaaataacatagcacacactcaggtatccattgtccaaatgtgtcaaatcttaccatttt

SEQ ID NO: 92555 - DNA, 601 bp, Human
gtagagcttggtggacacaggcagctgcatatatggatggatatgtacatatgtatctgtatgtgtgtgtatacagtactacagagcaacgagggaaagctgaatccattatatcaatttcctctataaatctaaaagaatctttcttaaaggcctaccctttaagacttcaagaaaaaattaacaaacaaaataattttatactctaggattcacctaatcactgcaaagttacaaaagaggttttaaatggaggtgtgcaatcaatgtgaatgacatggaaagagaaaaatggcttaamaactgctctaaacaatgagaacacatattctcctaaatcttacaatctcaacaatctaggctgggtttttaaacctcaacactactgacatttggggtaggataattatttcttgtggagggctctcctgtgcactatagaaagctcagcagcatcctcaccccatacccactaagatgccataccaataaccaagaaggcctccagacactgccaaatgtcctgaagtgggggtgggagggaatgtccctggttgagatcagactcccagatactagttcaattttttattcactgtct

SEQ ID NO: 92556 - DNA, 601 bp, Human
aaaaaattgtttaataaaccaacataactctcaggtccatggtgacatactattttctatcagtggttatatcgtgaccttaggcaatttaacctgccaaaactgtacataatactctgcatactatgaacacatctatcaaaatggatctctgttagatatacctgaagaggtatagtgttaaaggatatgcacaagattcaaaagggagtggtcagttatgaaagtataagtcatctctgatcattttttcttcaacacattataaaaatcttccatcaggacagttacaaatccctcstcctccagttgaccggtcactcgctgttgcccaaggctgacttgtcatgtctgcaattccgggctttattttttatgggatttaactgcctctctttttctctcggtgtctcttcctattctcagtcctgtcattctcctcatgttttgcttttaaacacttaaagtggcaatactacaagctctgtatctggcataacagtatacagaatgcttaaaaatctgcctttagtgccattctttgtagctgaggtatgtatgtctcccacagcacagacaaaaagtaacaaaactacagtct

SEQ ID NO: 92557 - DNA, 601 bp, Human
ggccgggtgcagtggctcacgcctgtaatcccagcactttgggaagctgaggcgggtggatcacgaggtcaggagattgagaccatcttggctaacatggtgaaacccagtctctactaaaaatacaaaaaattagctgggcgtggtggcgggcgcctgtagtcccagctattcgggaggctgaggcaggagaatggcttgaacccgggaggcgaagcttgcagtgagccgagattgtgccactgcactctagcctgggtgaaagagcaagactacgtctcaaaaaaaaaaaaaaaaaaaraaagtgaagtaaacagcaatatggtaattaaaaaaaaattgtttaataaaccaacataactctcaggtccatggtgacatactattttctatcagtggttatatcgtgaccttaggcaatttaacctgccaaaactgtacataatactctgcatactatgaacacatctatcaaaatggatctctgttagatatacctgaagaggtatagtgttaaaggatatgcacaagattcaaaagggagtggtcagttatgaaagtataagtcatctctgatcattttttcttcaacacattataa

SEQ ID NO: 92558 - DNA, 601 bp, Human
aataagtattttggtttaatagaacacacaaaaatgacataagacaagggagaatttgctggttatcgcaaaactgttgtaggtgagatccttattgtatttatgcagaagttgggatactgggggatttttgagatatcttttcattggggaatgtcataatgttagcacttaccttgactataaatatagtatgtttactgcttattgcttatgtgccatgagaatatactagttctccaaaagtttggaagcaagatccttacaaggtttccatccaaatccaataataattgttttctaatagttgtaatagctcaaggttacttgtaaccaaacacagagacattcttatgaacatatttagaatataaagacagtagactgcagcagggattctactaaaatattctaatttacagatgacatccctctgagcaccattttgaacagctatttcataatatgatacaacagtttttctgggatgacaaagtggctcccaaagttctgaaatgtatgtatggtctttgccctaggtataacagaagatctttgtgaaaactgggtacactgcatccatactcacaaaataattaat

SEQ ID NO: 92559 - DNA, 601 bp, Human
tgttgccaatggatctccgccgggctttgtccttggcttcttccagttcatcatgaagccttgtcctctcctctggctgttgtgtaaggaggaataatagcatcttgatgatgaaagttgtactgcacaataaacactgagattcatggggtcagaatccccgtgagaatctgatagcaagtgtagaatctactgctcagaaaactgaactatacccatccatttcagatttttggaactcagtgacctgactcaggcttagattgaatggctggcatggaaaatttagctgtcccctatrttaggcactaaaaggaacaaagcattcccctaaacattaatatgttgtttctacatggaaaaaaaaaggccataggtccctcttaaggtagcagggagatgctgtatctagcttcctgaaatttctactttacagtgctcaaagtgtacaagcactgtctttctatgaaaatacttacagcactggcagcctcaagttctttctgcttcttctcaaagacatcatcatctgctttatctttttcaaactccttctggcaacggttcagtagcagcttccggaaattcactgtgttaccag

SEQ ID NO: 92560 - DNA, 601 bp, Human
acaagcatgagccaccgtgcccggctgaccctgttacttaaaaaaaaaaaagagagagagaggaggtggctgtgtcttttgccccttttcctaccttctctggtgagaataattaggacaagggttaaactttaggagtcacagaatgttaagctgaaaggacttacctcagagctttgtttacataaataagaagtaaacctcaatcttgtataaaccactgggttttctgtcacagctaagcataatcctagctgaatcagatgttatggagcgtttctgacattatttctttgaagcmtttctaatttctataccccttaaatagcatacattattacagtatttttaatgatttcttatattatggttagatggctgtgtcatcaattagagtataaactctagaagcactactgggtcttcatttctgcactacccttaggccatagtttttctttgcatatttctgttcccaaattgggaaatggttacagaagaagaaaaaagaatatgggacaaataatctgaagaatctacaaactggcttttacacaatttgggaccctcctcatctctgactctgatggaaatgtaagga

SEQ ID NO: 92561 - DNA, 601 bp, Human
agtttcactcttgttgcccagcctggagtgcgatggcgcaatcttggctcactgcaacctctgcctcccgggttcaagcaattctcctgcctcagcctcccaagtagctgggattacaggcatgcgccaccatgcctggctaattctgtatttttagtagagacgggatttctccatgttggtcaggctggtcacgaactcctgacctcaggtgatctgcccgcctcagcctcccaaagtgctgggattacaagcatgagccaccgtgcccggctgaccctgttacttaaaaaaaaaaaagagagagagaggaggtggctgtgtcttttgccccttttcctaccttctctggtgagaataattaggacaagggttaaactttaggagtcacagaatgttaagctgaaaggacttacctcagagctttgtttacataaataagaagtaaacctcaatcttgtataaaccactgggttttctgtcacagctaagcataatcctagctgaatcagatgttatggagcgtttctgacattatttctttgaagcatttctaatttctataccccttaaatagcatacattattacagtatttttaa

SEQ ID NO: 92562 - DNA, 601 bp, Human
tttttcagatggagtttcactcttgttgcccagcctggagtgcgatggcgcaatcttggctcactgcaacctctgcctcccgggttcaagcaattctcctgcctcagcctcccaagtagctgggattacaggcatgcgccaccatgcctggctaattctgtatttttagtagagacgggatttctccatgttggtcaggctggtcacgaactcctgacctcaggtgatctgcccgcctcagcctcccaaagtgctgggattacaagcatgagccaccgtgcccggctgaccctgttacttaaaaaaaaaaaagagagagagaggaggtggctgtgtcttttgccccttttcctaccttctctggtgagaataattaggacaagggttaaactttaggagtcacagaatgttaagctgaaaggacttacctcagagctttgtttacataaataagaagtaaacctcaatcttgtataaaccactgggttttctgtcacagctaagcataatcctagctgaatcagatgttatggagcgtttctgacattatttctttgaagcatttctaatttctataccccttaaatagcatacattatta

SEQ ID NO: 92563 - DNA, 601 bp, Human
gctgcagtgagccgagattgagccactgcactccagcctgggcgacagagtgagactctatctcaaaaaaaaaaacaaagcgcaaacaaaattgcaatatggtttgataatcagaataaggagaagaagcacgtaactggcaataggccttttgtcccttctcagaactctcccacggaaagtttgccaatccaaattctgagtcctgaagcaaaagcactatctttacacatgtaaacaacaggacatccttccccaacccaattcctttaaagagactggaccagcaggcttattattwttttttttcccactcaccagccttaggtctataacatcttgaagcatgaaccgaatcctagatgaggtttttctttctttcacaattttctccatctgattaaagtactggtccatacgtggctgcaagagacaaaatcattagtactcctgtctgagaaacttaaacgtaattttaccaatttacagttatttatttatgtagttatctatttatttttttagagatggggtttcactccgttgcccaggctggagtgcagtagcacaatcacggctcactgcagcttcaacctctcag

SEQ ID NO: 92564 - DNA, 601 bp, Human
cctgacctcaattgatccacccacctcagcctcccgaagtgctgggattacaggcatgagccactgcgtccggcctgctacaaagtgcccctttcttaaataaagttttctttcagctttctgtctctcttctttttctctaaattttaacagttaatggagaacacatttcataattgatatactatcttccatttgcttaacaaatgttcctcttttgcttgtcaaaagttttaccttaccagataaactgtacactttgagagggaagtaactacattttccacttccttttctagtgtcaccaattctgagtatatagaagatgctcaataaagtcttattgcttactggcttttaagtagtgaaagaaatcatgctttgttcctgcattctctacttttactcagtaactttactcttcaggtgaaactgcttcacctaacaatcaccactctattctttgggctgttctttctgatctcattttatacctaaatacataattcttaatatgtattcctgaaacttccaagttctctaaaccctggtggattccggcctcacctggtcttctcttctctttggtcatgagttgctg

SEQ ID NO: 92565 - DNA, 601 bp, Human
ggcacacatcactatgtccagcaaattttttagtagagacggggtttcatcatgttggtcaggctggtctcaaactcctgacctcaattgatccacccacctcagcctcccgaagtgctgggattacaggcatgagccactgcgtccggcctgctacaaagtgcccctttcttaaataaagttttctttcagctttctgtctctcttctttttctctaaattttaacagttaatggagaacacatttcataattgatatactatcttccatttgcttaacaaatgttcctcttttgcttgkcaaaagttttaccttaccagataaactgtacactttgagagggaagtaactacattttccacttccttttctagtctcaccaattctgagtatatagaagatgctcaataaagtcttattgcttactggcttttaagtagtgaaagaaatcatgctttgttcctgcattctctacttttactcagtaactttactcttcaggtgaaactgcttcacctaacaatcaccactctattctttgggctgttctttctgatctcattttatacctaaatacataattcttaatatgtattcctg

SEQ ID NO: 92566 - DNA, 601 bp, Human
caaaaagagaggaaagcagacagagtctcttaaatccttattacagaatgatttctagtaggccctctgtggtttcctttacgccttggataaggcaaatctttcatggttaggtttaaacaggtgattgcttttttccccagagctacggatacattgtgtaaaagcctgcaattgacttaggcttctaaaatatctttgttattacctcttgtatattaagcatcttatgtctaagaagtaacctagtcttttcctctttagtaaatccttatagaagtagaaatgaggccgggcgcgrtggctcacgcctgtaatcccagcactttgggaggccgaggtgggtggatcacaaggtcaggagatcgagaccatcctggctaacacggtgaaaccccgtctctactaaaaaatacaaaaaattagccgggtgtggtgacgggcacctgtagtcccagctacttgggaggctgaggcatgagaatgttgtgaactcgggaggtggagcttgcagtgagccaagatcgtgccactgcactccagcctgggcgacagagtgagactccatctcaaaaaaaaaaaaaaaaagaaaatgtagaaa

SEQ ID NO: 92567 - DNA, 601 bp, Human
gcctgatatctcatgtttaatcttccaagcacaactttactacaagtgaaataaaattacgctgtaatgcatattattataaaatacatataacataaaagctgtaatgtagcgctttgtaaaaaaggtatttctatggtctgacagctcataatatatatgttgctatgctatgtaatatgctttcacacaaaccactcccaattaacaataaatatgtataacggttttgttctaggatacccatgtatagtacctccagtataactatctgaatacacaaagtttattagcaatttayatacttaaaaatattaaggtagtaatgttggaggtttgataccagcactgtttttatagtatccaagcacggaaagcataatatttaaaaatacaaatgttgttattaaataccgacacatttttcaaaatgctggaggacttctttaaacataaacttttggttaaaactgtctctagatggaaatggagatgggtaagactcaaattgtattcagcaatggaattcctactctgagatataaacaactagaagaaagtaccagaatcttggagaaaaggatcctagctaattacatta

SEQ ID NO: 92568 - DNA, 601 bp, Human
cttagtggctgagtgtggctcataactgtaatcccagcacgcaggaggccaaggtgggaggatcactgcagcccacgagtgcaagactagcctaggcaacacagtgagactccatctctacaaaaaattaaaaaaaaaaaaaaaaatcagccaggtgtgatggcgtgcacctgtagtcccagctactcaggagactgaggcaggaagattgcttgaacctaggtggttgaggctgtggtgagttgtgatcatgccactacactccagcctgggtgacagagcgggatcccatctcaaaaatataataaataaataaataaataaataaataaataaaggtcttaattaaatagtctaaatgaatgaattgaaattaaaaaaatacttaaaattatttaaggatcctgagaaaggatctatgttgaaaggaaagggctaccaataaaattttaggcatgattagtctacacatctttcccaaaaaccatcattcgatgactatgggaatgcgctgtaaggcaaatgctaacaagccacagccaggtttgagaagggacacacacacttaccagtctcacttgcctttgctccaccactgctg

SEQ ID NO: 92569 - DNA, 601 bp, Human
acaatgtttctttattcttttacagctccctaaaattatagtaaatgctctgcatattaagattcttttatcagcataatgagtttcccttttaatttagggtcccagtaatttctctagctatattaaatttgtgaacaacaacaaaaagggaacctaaaaaattaaggtcttagtggctgagtgtggctcataactgtaatcccagcacgcaggaggccaaggtgggaggatcactgcagcccacgagtgcaagactagcctaggcaacacagtgagactccatctctacaaaaaattaaaaaaaaaaaaaaaaatcagccaggtgtgatggcgtgcacctgtagtcccagctactcaggagactgaggcaggaagattgcttgaacctaggtggttgaggctgtggtgagttgtgatcatgccactacactccagcctgggtgacagagcgggatcccatctcaaaaatataataaataaataaataaataaataaataaataaaggtcttaattaaatagtctaaatgaatgaattgaaattaaaaaaatacttaaaattatttaaggatcctgagaaaggatctatgttgaaagga

SEQ ID NO: 92570 - DNA, 601 bp, Human
tccaaacatctttggtcctgaggtcaaatctctcaaaatctgattttcgaaaaagattttgaacaatgtttctttattcttttacagctccctaaaattatagtaaatgctctgcatattaagattcttttatcagcataatgagtttcccttttaatttagggtcccagtaatttctctagctatattaaatttgtgaacaacaacaaaaagggaacctaaaaaattaaggtcttagtggctgagtgtggctcataactgtaatcccagcacgcaggaggccaaggtgggaggatcactrcagcccacgagtgcaagactagcctaggcaacacagtgagactccatctctacaaaaaattaaaaaaaaaaaaaaaaatcagccaggtgtgatggcgtgcacctgtagtcccagctactcaggagactgaggcaggaagattgcttgaacctaggtggttgaggctgtggtgagttgtgatcatgccactacactccagcctgggtgacagagcgggatcccatctcaaaaatataataaataaataaataaataaataaataaataaaggtcttaattaaatagtctaaatgaatgaat

SEQ ID NO: 92571 - DNA, 601 bp, Human
acaaaactttaacaaagctaaccagcacaaatgctccaatctcatttgtgcacaaatatgcatgtgggttttactgaataatgacattttttaaaatttaaagaaaaaaaggttgaaattacttagtagaagggacatataggaagtaggttaacattaaattttttttctttccattgggcttcctcaagctagtaagatgtgtttgtgagatccaaacatctttggtcctgaggtcaaatctctcaaaatctgattttcgaaaaagattttgaacaatgtttctttattcttttacagytccctaaaattatagtaaatgctctgcatattaagattcttttatcagcataatgagtttcccttttaatttagggtcccagtaatttctctagctatattaaatttgtgaacaacaacaaaaagggaacctaaaaaattaaggtcttagtggctgagtgtggctcataactgtaatcccagcacgcaggaggccaaggtgggaggatcactgcagcccacgagtgcaagactagcctaggcaacacagtgagactccatctctacaaaaaattaaaaaaaaaaaaaaaaatcagccagg

SEQ ID NO: 92572 - DNA, 601 bp, Human
cccaattatgttcctatcttagaaattatagtgtgtgaagattaaagaaatcaactttaggaataaaaggaatgcatccataaggattactatcaaaacccttgttcttatcttgccacacatactggcaagcgggccagccttgagtagacataaaaagcagggttctcacctagttaaggtccttcgggaatcaaactctacaggcgtggatggcgtggaccctgagggtgctggaggttgcagggcagagaatctgtttaaactggaagcacttgaccgtaaggcatctacacatgtygaggatttagaaaaaaatacaaatcacatgactaaaatgcaaataatcagtcatctgcatccctaggtaaggcctgagaccaggcattcctaacaagcttaggtgacgcccatctcctggtccctctaccatattctgagaagcaaagtgttagagggaatttgcacataatagagtttagaagtctttatttatttcaaccattggttcctttaaaaacatagtaaacaggggtgggagtggcatataggaggaggaaggcaagcgaaaacagaacaaaactttaacaaagctaaccag

SEQ ID NO: 92573 - DNA, 601 bp, Human
tttatgacagggcaaagcgccacaagtgatactcaatgacaacctgaatcatcatgaaaagctgccttgtgctaactatactttgtttcaatagaagtcaagggaataagaacacagtttacaaagtctacctaatcaaacttattacaataataataataaaaagcctgatgggagcatcgcttgagaccaggagttcaatgccagcctgggcaacatagcaagatgccatctctaaaaaataataattaaaaaaaaaaagttttagagcttaaagaaacttcaattctgaaagtgcttrtgtaaaaaatgttattttttgtgactgcactacagggtgcccattcattttatgtaaaccagccaacaggatacttgactgtatcaatcctagaaaagcaaaagcagaaagatagtgaaatatggagactagcaaaaactgaaggacaacctcaaatataacatgaagagtgtgacagagaaatgtatgggtggattgtcatgttctttaattcccatggttgagaatgctaggtgcttctagaacatctggaggattagcttgcggagcccctagacatgcctccagggctgtttgggt

SEQ ID NO: 92574 - DNA, 601 bp, Human
ggagagactcgggcaggaaaatggtctaactattgtgaaagaacatacacaagtgcttaggaagcagaaccattaggggacatttatgacagggcaaagcgccacaagtgatactcaatgacaacctgaatcatcatgaaaagctgccttgtgctaactatactttgtttcaatagaagtcaagggaataagaacacagtttacaaagtctacctaatcaaacttattacaataataataataaaaagcctgatgggagcatcgcttgagaccaggagttcaatgccagcctgggcaacayagcaagatgccatctctaaaaaataataattaaaaaaaaaaagttttagagcttaaagaaacttcaattctgaaagtgcttatgtaaaaaatgttattttttgtgactgcactacagggtgcccattcattttatgtaaaccagccaacaggatacttgactgtatcaatcctagaaaagcaaaagcagaaagatagtgaaatatggagactagcaaaaactgaaggacaacctcaaatataacatgaagagtgtgacagagaaatgtatgggtggattgtcatgttctttaattcccat

SEQ ID NO: 92575 - DNA, 601 bp, Human
gtatctccccactggaatgtaagctccatggaagcagattttgttgttcactacaaatatggtatacccagtcataacccctaaaatgtggctagcacacttaggtattcaataaataaatagcatagaggctaaaacatgcacggtggggtcagacagaggtgcatttgaaccctggctctgccacttactactttagagtttaggagtttaacttaatctcttgggcttaactttttagagttaccgtgaggaatgtatataaaatataggtataagaacttggcacagtgccaggcayaaaataaaccctcaataaatattaatttgaatcactgttaaaaacaatagcacctaataggaagatatttggaaaaaatatttttaagatcagctctttaagtctttagcctgacacactaataccccaaaggtaatgagataaagcattttctcctctgaagctagaaacttagctttgaatcctcaatctggcacttattagcagttaagattttgaacaagttgatttacatctttgcacctcagtttccttatctgaaaaatgggtatgataataacatcaacttcaggagaatgt

SEQ ID NO: 92576 - DNA, 601 bp, Human
aatagtggtttgtagttctccttgtagcgatccttcacttcccttgttagctgtattcctaggtattttattctttttgtggcaattgtgaatgggagttcactggagatttggctttcagcttgactgatgctagtgatttttgcactttgattttgtatcctgagtctttgctgaagttgcttatcagcttaataagcttttgggctgagatgatggggttttctagatacaggttcatgtcatctgcaaacagggagagtttgacttcctctcttcctatctgaatatgctttatttytttctctagcctgattaccctggccagtactatgttgaataggagtggtgagagaggacattcttgtcttgcgctggttttcaagggtaatacttccagctatatcattatactcacagtgtcatagcagttcataacctcgcccttccatctggttttcttatggtttgcttctttttgtctttgagcttttagttgaaatgatacttcctgtcttccctgactccatcaaatcacataattttagtttttggcactgaaaacatttttttggtagctactgtttatttattaatttac

SEQ ID NO: 92577 - DNA, 601 bp, Human
tcaagaaaaaaaataaataataaataaataaaaaataaaaaaaatacatatatatagtttgaagtagggcagtgtgatgcctccagttttgttctttttgcttacgactgccttggctatttgggctcctttttttggttccatatgaatttttaaatacttttttctagttctttgtagaatgtcagtgggagtttaatgggaatagcactgaatctataaattgctttgggtcgcatagccattttcatgacagtgattcttcctatccacaagcatgggatgtttttccagttgtttrtgtcatctctgatttctttgaatagtggtttgtagttctccttgtagcgatccttcacttcccttgttagctgtattcctaggtattttattctttttgtggcaattgtgaatgggagttcactggagatttggctttcagcttgactgatgctagtgatttttgcactttgattttgtatcctgagtctttgctgaagttgcttatcagcttaataagcttttgggctgagatgatggggttttctagatacaggttcatgtcatctgcaaacagggagagtttgacttcctctcttcc

SEQ ID NO: 92578 - DNA, 601 bp, Human
tgtttttgtcaggtttgttgaagataagataattgtaggtgtgtagtcttatttctgggttctctattccgttccactggtctatgtgtctgttcttgtaccacaccacgttgttttggttactgtagccctgtaatatagtttgaagtaggctgggcgcggtggctcacgcctgtaatcccagcactttgggaggccaaggagggcggatcacaaggtcaggagatcaagaccatcctggctaacaccgtgaaaccccgtttctactaaaagtacaaaaaattagccgggcatggtggcrggcgcctgtagtccgagctacttgggaggctgaggcaggagaatggtgtgaacccaggaggtggagcttgcagtgagccgagatcgcgccactgcactccagcctgggcaacagtgcaagactccatctcaagaaaaaaaataaataataaataaataaaaaataaaaaaaatacatatatatagtttgaagtagggcagtgtgatgcctccagttttgttctttttgcttacgactgccttggctatttgggctcctttttttggttccatatgaatttttaaatacttttttctagtt

SEQ ID NO: 92579 - DNA, 601 bp, Human
cgccactgcactccagcctgggcgacaagagcaacactccatctcaaaaaacaaacaaaaaaaagacaacaacaaaaaaaacctttgtcggatgtgtatattgcaaacatttcctcctattctgtaagttgtctgtttattctgttgattgatagtttattttgctgtgcagaagctctatagtttaattagatcccatttgtcaatttttgctttcgttgcactgtttttggcatcttcatcatgaaatctttgcctgtgcctatgtcctgaatggtattgtgtaagttttcttcttcayagttttgagttttacattttaatccatctttagttgatttttgtatatggtataaagaaaggctccagtttcaattttccgcttatgactagccaggtatcccaataccatttattaaaaagggaatcctttccccattgcttgtttttgtcaggtttgttgaagataagataattgtaggtgtgtagtcttatttctgggttctctattccgttccactggtctatgtgtctgttcttgtaccacaccacgttgttttggttactgtagccctgtaatatagtttgaagtaggctgggc

SEQ ID NO: 92580 - DNA, 601 bp, Human
ttgagcttttttatcttgtgattgttggccacatgtatgtcttcctttgagtactgtctgttcatgtcctttgtctactttttagtgtgtgttttttttttcttgtaaatttgtttaagctccttacagatgctgcacataagacctttgtcgggggccgggcatggtggcttacgcctgtaatcccagtatttgggatgcggatcacctgaggttaggagtttgagatcaacctggccaacgtggcgaaaccccgtctctactaaaaatacaaaaaattagctgggtgtagtggcgggcrcctgtaatcccagctactcgggaggctgaggcaggagaatcacttgaacccgggaggcagaggttgcagtgagccaagattgcgccactgcactccagcctgggcgacaagagcaacactccatctcaaaaaacaaacaaaaaaaagacaacaacaaaaaaaacctttgtcggatgtgtatattgcaaacatttcctcctattctgtaagttgtctgtttattctgttgattgatagtttattttgctgtgcagaagctctatagtttaattagatcccatttgtcaatttttgctttcg

SEQ ID NO: 92581 - DNA, 601 bp, Human
ggtgtctatgtaccgcattttctttatccactctatcgttgatgggcatttaggttgattgcatgtttttgctattgtgaatagtgctacaatgaacatacgtgtgcatgtgtctttataagagaacaatttatattcctttgggtatatacacagtaatgggattgctgggtgaaatggtatttctgtctctaggtctctcaggaatcgccacacttccacaatggttgaactaatttaccctccaacagtgtaaaagtgttcctttttctccacaacctcgccaacacctattattttytgactttttaataatagtcattctgactggtattagatggtatctcattgtggttttgatttgtatttctctaataatcagtgatattgagcttttttatcttgtgattgttggccacatgtatgtcttcctttgagtactgtctgttcatgtcctttgtctactttttagtgtgtgttttttttttcttgtaaatttgtttaagctccttacagatgctgcacataagacctttgtcgggggccgggcatggtggcttacgcctgtaatcccagtatttgggatgcggatcacctgagg

SEQ ID NO: 92582 - DNA, 601 bp, Human
ccgtgtgtagtggcacacgcctgtaatctcagccactcgggaggctgagacaggaaaatcgcttgaacccgggaggcggaggttgcagtgagctgtaatcaccccactgcactccagcctgggcgacacggcgagactctgtctccaaaaaataaataaataaataaataaaaatcattcctcagtatttaaatggaagtgattaaatgtcttctaatgggaattcattcactgtgtttgcataaagggtcaattagctatatcatgatatatattttttaaacttttaagatcaggggtrcatgtgcaggatgtgcagctttgctacataggtaaatgtgtgtcatgggggtttgctgtacggattatttcatcacccagatactaagcctagtatccattagttatttttcctgatcctgtctctctccttccaccttctgtcctccagtaggccccagtgtgcatttttctcctctacgtgtccatgtgttctcatcatttagtttccacttataagtgagaacatgaagtatttgcttttctgttcctgcattagtttgctaaggataatggcctccagctctatccatgtccctgc

SEQ ID NO: 92583 - DNA, 601 bp, Human
cttgtaaatgaatgcaaatattcaatcctcaggctggaagcggtggctcacacctgtaatcccagcacgttgggaggccaaggcgggcagatcatttgaggttcagcagtatgagaccagcctggccaagaaggtaaaaccccgtgtctaccaaaaatacaaaaattagccgtgtgtagtggcacacgcctgtaatctcagccactcgggaggctgagacaggaaaatcgcttgaacccgggaggcggaggttgcagtgagctgtaatcaccccactgcactccagcctgggcgacacggygagactctgtctccaaaaaataaataaataaataaataaaaatcattcctcagtatttaaatggaagtgattaaatgtcttctaatgggaattcattcactgtgtttgcataaagggtcaattagctatatcatgatatatattttttaaacttttaagatcaggggtacatgtgcaggatgtgcagctttgctacataggtaaatgtgtgtcatgggggtttgctgtacggattatttcatcacccagatactaagcctagtatccattagttatttttcctgatcctgtctctctcct

SEQ ID NO: 92584 - DNA, 601 bp, Human
cacaataaccatggtttattgaaagaatatggtttttaaatttaagacaatttttcagaattgttctcacaaagaaaagcttttttcctcaaagaacatttggggatcacatgtaaatgggctgctaaaggcctcagagtttccctgaggctaaggggtctctgttaccttacttacaacatgatagagatctaacaataatattcagaaaaccaaaagataacctttatgccctagcacaatctataaaatgccatcacatcaaccaacatatcaatatattaattgcatcatatcaacrtattacagtggatacaattttcatctatggaaaaaactaaatacttaaagaggtaagtactttgaaaattaactggtacccaagagcctagtaactgaataccactcttgaagaggatactgaccctttgaaaaagtcctgtttgctgagtttttctgactgtaccagctgatagagtagttggcccatgtgatccctggtgatctggctcctttccagggtggactccactcccactctcacaaaaacatgtagtaggccctgggcattcagctcttccacacactgcatggcttcctg

SEQ ID NO: 92585 - DNA, 601 bp, Human
atcaaaccatccattgacaagaatcataatgaaaccaacctgaaatagactaaatcattaagaacaccaagttacataaccttctccatgaggctagagtgggcacacaagtgcttcctagccacaataaccatggtttattgaaagaatatggtttttaaatttaagacaatttttcagaattgttctcacaaagaaaagcttttttcctcaaagaacatttggggatcacatgtaaatgggctgctaaaggcctcagagtttccctgaggctaaggggtctctgttaccttacttacawcatgatagagatctaacaataatattcagaaaaccaaaagataacctttatgccctagcacaatctataaaatgccatcacatcaaccaacatatcaatatattaattgcatcatatcaacatattacagtggatacaattttcatctatggaaaaaactaaatacttaaagaggtaagtactttgaaaattaactggtacccaagagcctagtaactgaataccactcttgaagaggatactgaccctttgaaaaagtcctgtttgctgagtttttctgactgtaccagctgatagagt

SEQ ID NO: 92586 - DNA, 601 bp, Human
ctggtttcagactcctgatctcaagtgatccacccgcctcagcctcccaaagtgctgggattacaggtgtgagccactgcacctggccaacaatgacatttaatggttaccttattctaaaaggattgccatatgtgaaatgactacggaaaaatatacagtggcatttaatcatatgtgcatttaatttatgagaacatgagcttggcaaaaaaaaaaaaaaaaagaggaaaattacaagtagtacagaattcttactgccatttgattcaataagcatatgtccaggtgaggatgagayggcagatgttaatccaatgtccagaccttaggagatcctagttgctattcccttagagagtgggcatctgtcagtgctgggtgtgactctgtgtttatatttgatacaacatggctcctaaaacaaaattttttaccaatgcaattttcactttaaacattggttatacaccctatgcctgggtaagattttgtggctgaaccacaaggaacctgatccatgtacttgtgatgatggtatatcacaaatataccagaacctgatcaaatgaggattcaccaccagtgacaggcagatagg

SEQ ID NO: 92587 - DNA, 601 bp, Human
tctgcccacctcggcctcccaaaatactgggattacaggcgtgagtcaccacgcctggcaagaaaactttttaatggtcctaggggcaagtataaattttctaggacctagaagacaacgctgtcattgcttgcaaagtcaaacgaataaattcaacaatgacttttttgttttttagagactgagacaggcggagtgcagtggtgcaaccttggctcactgcaacctctgcctcccgggttcaagcgattcttatgcctcagcctcgcaagtagctgggattgcaggctcacgccaccaygttgggctaatttttgtatttttagtagatgttggcatgttggccgtggctggtttcagactcctgatctcaagtgatccacccgcctcagcctcccaaagtgctgggattacaggtgtgagccactgcacctggccaacaatgacatttaatggttaccttattctaaaaggattgccatatgtgaaatgactacggaaaaatatacagtggcatttaatcatatgtgcatttaatttatgagaacatgagcttggcaaaaaaaaaaaaaaaaagaggaaaattacaagtagtacagaa

SEQ ID NO: 92588 - DNA, 601 bp, Human
gccaccatgcccagcctgaaagaaaacttcttttttgagagggagtcttgctctgtcgcccagaatggagtgcagtggcgcaatttcagctcactgcaacctccacctccctggttcaagagattctcttgccttggtctccgggtagctgggattacaggtgcgtgccaccacgcccggctaattttttgtatttttagtagaggcggggtttcaccatgttagccaggatggtctcgatctcctgaccttgtgatccacccgcctcggcctcccaaagtgctgggattacaggtgtgarctacggtgcccagcctaattttcatatttttagtagagacggggtttcaccacgttgttcaggctggtctcgaactcctgacctcgtgatctgcccacctcggcctcccaaaatactgggattacaggcgtgagtcaccacgcctggcaagaaaactttttaatggtcctaggggcaagtataaattttctaggacctagaagacaacgctgtcattgcttgcaaagtcaaacgaataaattcaacaatgacttttttgttttttagagactgagacaggcggagtgcagtggtgcaacc

SEQ ID NO: 92589 - DNA, 601 bp, Human
aataagtaactatttataaatggatatcctcgtcactccaacagtattatttctaggaaattatagtttcaagtctgctgggaggaccatattcaatctgattgtgagggtgtacatacctttatttgctcttaccatttgcactggctagttactggactgaattggaggcttctcttttaaaactgggaaaccatcctggccttaaaaaccaataaccacagcaacttttgccaaagtgtcttactaactggttcaaatggccttaattcagagcaatctagcttattgctgaaagaaracttttttttttccccagacgtggtctcattctgtcacctaggctggagtgcagtggtgtgatcatggcttactgcagtctggacctcccaggtgcaatccttctgcctcaacctcccaagtagctgggactatagctgcacaccaccatgcctagctaatttttatatttttagtatagatggagtttcaccatgctgcccaggctggtcttaaactcctgggctcaagcaatcttcctgcctcagccttccaaagtgctagcattacaggtgtgagccaccatgcccagcctgaaaga

SEQ ID NO: 92590 - DNA, 601 bp, Human
tcagagaatcccacaaagggagaaatgcaaatgtctgagatatccgagagactaagctagtatctcacaagttcaattatagccaataaaggtagactatgcttctgggcatctttatagatatgaatcaacttccgagtatagtttgaagagacagaaaatggtaaatgataatttaccattatcatttccagaattttctgaggaatgtagcataatatctgggtaataagtaactatttataaatggatatcctcgtcactccaacagtattatttctaggaaattatagtttcaagyctgctgggaggaccatattcaatctgattgtgagggtgtacatacctttatttgctcttaccatttgcactggctagttactggactgaattggaggcttctcttttaaaactgggaaaccatcctggccttaaaaaccaataaccacagcaacttttgccaaagtgtcttactaactggttcaaatggccttaattcagagcaatctagcttattgctgaaagaaaacttttttttttccccagacgtggtctcattctgtcacctaggctggagtgcagtggtgtgatcatggcttac

SEQ ID NO: 92591 - DNA, 601 bp, Human
cagtgcatactctaaagagctatagggagaaatggcagattagtagctacctcaccagggaccagtatacctggaggctttctgcttttctttttttttttgagaaggagtctctgttgccaggctggagtgccatggcacaatctcagctcactgcaacctctgactccctggttcaagcaattctcctgtctcagcctcccgagcagctgggattacaggcatgcgccaccatgcccagctaatttttgtatttttagcagagacggggtttcaccatgttagccaggatggtctcgayctcctgacctcgtgatccacctgcctcggcctcccaaagtgctgggattacaggcgtgagccaccgcgcctggctggctttctgctttctaaccttcccagagttatcattggcttggcgagctaggcagaaactgcttccccaactgttcagaagttgacatctaagcagtagcagcacccaaaacagctgatctcagaggctcttccacaatactatggaaggacaatactatctttgtaggttaagaataaagaagcaaaagacagggtatcttcatggctccaatgaaatggcctc

SEQ ID NO: 92592 - DNA, 601 bp, Human
acaataaatggataatctagaaaaaaacagataaactcatagatatatacaacaaatcaagactgaatcatggccaggtgcactgccttaaacctgtaatcccagcactttgagaggccaaggtggaaggatcatttgtctaggagtgcaagaccagcctgggcaacatagtgagacaccatctctacaaaaaataaaaaatcagctgagcacagtggcatgcacctactgtcccagctacttgagaggttgagatgggaggatcacttgagcccaggaggttgaggttgcagtgagccaygatgaagccactgcactccaacctgggtgacagagcaagaccctatctcagagagaaaaaaaaaaaagcccaggactagatggcttcactgctgaattctaccaaacacttgaagaagaacaaattcttctcaaattcttccaaaaaattgaagtggagaaaatacttcccaagtcattttacaagatcagtatggcaatcctcctacctcagcttcctgagtagctgcagctataggcacccaccaccatgcccagagagtttttgtattttttggtagagatagggtttcaccatgtt

SEQ ID NO: 92593 - DNA, 601 bp, Human
cacaatcagtggtcaaatctatactgctaacaaaaaacttttttggctgaacataggatttccatagaacaagcctgtaagaagcttatttttttttcaggtttacagttcttaaatcctgttgcatgattctaaaagaaaaatcttgagtgtgctgaagcacctaggtaataactgtctttatgtctttgcactactacatagcctatattaatgctttgcaccacacgttattttctaaaagctgaaaaaatgaaacagagctacatcatacccttgcctcttggcatgtagtgaccaccacagtcattggactgtcaggcttttctttgggtggaaggaaaaaaccacagccactggactgaactttggtaaggtctacatagatgagactgcagatatccctccgcccatttcaactacaaaagctccacttcattttatttactgggtttttgtgtaaaattttaattgaagaaagggatacatgattaaaagaaaaatattaaattttttttttttttttttttgagaaagccttcaatctttaaaatgttcctgggcaatgtgggatggaggtagaggaaatattttttcctgt

SEQ ID NO: 92594 - DNA, 601 bp, Human
ctacaggagacatacacataattgcaagtcataaggaaagggaggaatgaattgaagagctaagagcaggtggtaattgtatgcatgccctttcagatctctacaattgtaaaacgtgtgcttttccactgcagttccaggttctagccaaagtatgccacccttttttcagaggcctacatctcactaaaacttttcacttaaaaagagctaccaccataggcagggtcaccattctgaagctgccacttcaaaacagtttgcagctcagccatattatctaactctgggcttcatgaawccttaattccaactttctgacctcacagcttgcaattatttgatgccgaggacggtgtctgtgctatggcaaatagatgtcaaataattgcaggttctctcattatgtgcatactttgggttcagttaatgtaccactgatgaaatataatctagctggactccaggatttctaggttaaccacctgatcctgccaactcatgctctgtgggctagcagcataaattaagctgtttaatgggcccaagagacaactgtagccatgctggtctttcagcagtgtacctgctgctattttta

SEQ ID NO: 92595 - DNA, 601 bp, Human
aattttgtaacagtctaaatcagcatttaccaaactgtgttccataggatatctatactctaagtgaggcaatgctgaattaaacaaagctaactagtttttatttattgctttactataggactgtcataaactttaatatgctaagtatgttttgttaatctcaaagaaaagggacatgaccatgtgcaaagtttgactatataaacaacttttgtggaaacactagtgtttcgaagaacagagtttgggaaccaccggtctatataacgtagcatccattccccactcacatccaaaygtaggaatacttgagatctcagtttgttttattataatcatccttttattataatcatgagcatgtactatggggtaatgcagtctgacaagttacaatgggaaaatataactacttacagcactactgcaatgatagacacaaaagccagatgaacattaagcttctagaagcagtcatcttccagttacacgattctggagccaatctatcatcgccactaccctcaacagaccacagggctatcatatccccagaatatctcaggtgtagacctagcataaggtaacatttttacac

SEQ ID NO: 92596 - DNA, 601 bp, Human
ggtttttacctttttctttaaccacttcagtgacagaagcaacacaaagatcagatgtggtaatctgtttgtttatgtaagttctgcttcaagctaaaatgagaagcaccttaggtaacagggagttgtgatgcttttataaagttttttttttttttttttttttgagacagagtctcactctgtcgccaggctggagtgcagtggcgcaatcttggctcactgcaatctccaattccctggttcaagcgattctcctgcctcagcttcccaagtagctgggattacaggcacgtaacaycatgcccagataatttttgcattttagtagagacagggtttcaccatgttggccaggatggttttgatttcctgaccttgtgatccgcctgcctcggcctcccaaagtgctgggattacaggtgtaagctattgcgtctggccatatataaagtatttttaagaaaggaagcttttctttatagatgaaattatggatgaaacagcaaaggggccaattttgtaacagtctaaatcagcatttaccaaactgtgttccataggatatctatactctaagtgaggcaatgctgaattaaac

SEQ ID NO: 92597 - DNA, 601 bp, Human
gaggtgactaatctggggagctacagctggttatttgggatttataaacatcaaaaaaagtccaatacacagagtttataaattccacactgtgtcttttcctagatagctctgtatgtatctgctattaaagccattcaagaagcctcactagaatccctcttcataatagatcacagccatgctgcctgatacaaggaggcttaaagcagttgttgctcctgaaccaggaatgagaagtgtttcaagggcaagaagcacaaggttgagcccaagagagagaataaagaagagctgttgwcaggtagaaaaaagtgaagaggtacaagtcctctacctgaagaaagttacagtgacaacggaaaatgccaggtttgaggctgttgctgtcatctgagaggtatgtattaattacttcatagagtaacttgtccaaggcatagctgaaaatatagttgaaccagaatttgaactcggccatctggctccaaagcttatactatatgagaatttagttttatttggaagtagggttgtgctgtttctacacatcaaagttagtaagaatgtgagtttttagttattattattaatttttgag

SEQ ID NO: 92598 - DNA, 601 bp, Human
ttgaagtcaaacagtgcaaaccccaaaaagctgaaaaatcaaaacgtttccagcagggcatggtggtgcacacctgtatagtcctagctactagggaggctgaggtgggaagacagctttcacccaggagtatgagtctggcccaggcaacacacacagcaagaccagtctcgaaaacaaacttttcctcactgataaaaagttaatctcttaagacttgtgactttcaaactaagatgtctgaatgcacataaatacaatggtgaataattgaagtacagctgcttaagattaaataatygatttatgaggtgactaatctggggagctacagctggttatttgggatttataaacatcaaaaaaagtccaatacacagagtttataaattccacactgtgtcttttcctagatagctctgtatgtatctgctattaaagccattcaagaagcctcactagaatccctcttcataatagatcacagccatgctgcctgatacaaggaggcttaaagcagttgttgctcctgaaccaggaatgagaagtgtttcaagggcaagaagcacaaggttgagcccaagagagagaataaagaaga

SEQ ID NO: 92599 - DNA, 601 bp, Human
ttaaaagcatgaacttaaaaggacatctttaccaagattcctattttgatgcaattttaacgactggaatacgaaggaaattaccttcacttcctctatgaaatagatcaactactatcaaacagcaaaacataagccttgttcttacctgctccaaaagaaaattatgtacatcttctccttctggtaaaaagtccttccagctgaggtcagcctccctccataaggctcccactttcttatggctctaaaatagagataaatccaatccatttactttcacagtggaagaagaaacagaaaaaaaaaaaaaaaaaaagatttgcttgaagtcaaacagtgcaaaccccaaaaagctgaaaaatcaaaacgtttccagcagggcatggtggtgcacacctgtatagtcctagctactagggaggctgaggtgggaagacagctttcacccaggagtatgagtctggcccaggcaacacacacagcaagaccagtctcgaaaacaaacttttcctcactgataaaaagttaatctcttaagacttgtgactttcaaactaagatgtctgaatgcacataaatacaatggtgaataattgaa

SEQ ID NO: 92600 - DNA, 601 bp, Human
aatggtgacaatacatggacacatagaggggaacaacacacacgaacctatcagagggcagaggttgggagaagggagaagatcaggaaaaataactaataggtactaggcttaatacctgggtgacaaaataatctgtaaagcaaacccccatgacacaagtttacctatagaacaaacctgcacatgtacccctgaccttaaaataaaagttaaattaacaaaaaaagaggactcagggagagggagtggagaaggaggaaagaggagagaggggagaggagaggagacagagagactrgagacagaaagaaagagagagagacagagagagagatactattggctgcagcagggaggtgcagctggggccgtacactgcatggagccggtgggagccctgccccttctgagttgggatggaagctgcctgtgctactgcagccacccaaaccatagctgcggacccaagcctcctgctctttggagcaggcaggagccctgccctcccacccaaactgcagctgtggattcgagcctttcttgagggagcaggcaggatctcccctcctgggtgctgtcgcagctgcctgacctgcgg

SEQ ID NO: 92601 - DNA, 601 bp, Human
ccctagaaaagggtacaatttcactctctttctgcaacctatggtttaatattagtattggtactcagcagctatcaaaactagatagttttggctttgttaagttgtggccatttcgaatataggtgtgagaaatgatgctataattgtttagcacttagatacatagttttaaaaaatctataatcaggctgggcgcagtggctcacaccagtaatcccagcactttgggaggccaaggcaggaggagtgtatgagttcaggagtttgagaccagcctgggcaacatggcaaaaccccrtctctaccaacacaaataccaaaattagccaggtgttgtggcatgcgcctgtggtcccagctactcaggaggctgagatgggaggattgcttgagcatgggaggttgaggctgcagtgaattgtcattgtgccactgctctgcagcctggcaatagggcgagatcctgtctcaaaaagaaaaaaaaaatctataatcaaaattattcataattttcaaaggactaaagaaatgaagtacataggtatgccttgctttatgtggcttcattatacaaaaaccataaagatgaaaatattaa

SEQ ID NO: 92602 - DNA, 601 bp, Human
atggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaataaataaataaaaaaataaataaataaaaaaaaataaataataaaaattcatgaagtgaactgataggtaagcgaattaaggggatcccacaagaatctttcctgtagaggtatcagggaaggtgacatagtctttatacctctacccagtcaaagatctgttcatcattcgctttgtcctcaataatgagtttctcgagtcgcttatacagctcttcggcagacagttctttctttgaaagtgcttcagaggaacagggactgtcagactctatgaagtccaacttctgaaacataaaaggtggaacatattaatatattaatataattctatgttatt

SEQ ID NO: 92603 - DNA, 601 bp, Human
ttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaataaataaataaaaaaataaataaataaaaaaaaataaataataaaaattcatgaagtgaactgataggtaagcgaattaaggggatcccacaagaatctttcctgtagaggtatcagggaaggtgacatagtctttatacctctacccagtcaaagatctgttcatcattcgctttgtcctcaataatgagtttctcgagtcgcttatacagctcttcggcagacagttctttctttgaaagtgcttcagaggaacagggactgtcagactctatgaagtccaacttctgaaacataaaaggtggaacatattaatatattaatataattctatgt

SEQ ID NO: 92604 - DNA, 601 bp, Human
gggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaataaataaataaaaaaataaataaataaaaaaatataaataataaaaattcatgaagtgaactgataggtaagcgaattaaggggatcccacaagaatctttcctgtagaggtatcagggaaggtgacatagtctttatacctctacccagtcaaagatctgttcatcattcgctttgtcctcaataatgagtttctcgagtcgcttatacagctcttcggcagacagttctttctttgaaagtgcttcagaggaacagggactgtcagactctatgaagtccaacttctgaaacataaaaggtggaacatattaatatattaatataattcta

SEQ ID NO: 92605 - DNA, 601 bp, Human
ccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaataaataaataaaaaaataaataaataaaaaaaaataaataataaaaattcatgaagtgaactgataggtaagcgaattaaggggatcccacaagaatctttcctgtagaggtatcagggaaggtgacatagtctttatacctctacccagtcaaagatctgttcatcattcgctttgtcctcaataatgagtttctcgagtcgcttatacagctcttcggcagacagttctttctttgaaagtgcttcagaggaacagggactgtcagactctatgaagtccaacttctgaaacataaaaggtggaacatattaatatattaatat

SEQ ID NO: 92606 - DNA, 601 bp, Human
gtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaataaataaataaaaaaawaaataaataaaaaaaaataaataataaaaattcatgaagtgaactgataggtaagcgaattaaggggatcccacaagaatctttcctgtagaggtatcagggaaggtgacatagtctttatacctctacccagtcaaagatctgttcatcattcgctttgtcctcaataatgagtttctcgagtcgcttatacagctcttcggcagacagttctttctttgaaagtgcttcagaggaacagggactgtcagactctatgaagtccaacttctgaaacataaaaggtggaacatattaata

SEQ ID NO: 92607 - DNA, 601 bp, Human
acacgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaataaataaataaawaaataaataaataaaaaaaaataaataataaaaattcatgaagtgaactgataggtaagcgaattaaggggatcccacaagaatctttcctgtagaggtatcagggaaggtgacatagtctttatacctctacccagtcaaagatctgttcatcattcgctttgtcctcaataatgagtttctcgagtcgcttatacagctcttcggcagacagttctttctttgaaagtgcttcagaggaacagggactgtcagactctatgaagtccaacttctgaaacataaaaggtggaacatatt

SEQ ID NO: 92608 - DNA, 601 bp, Human
tattaagtggcagaaagccatcttcaaaatagagacagacttgaaattctgagacacctttgcactgatgaatttttttttctcgcttcagtgacagaagtatgaatttctatctgaaactaaagagatgtcttcattgaataatgttaaacattgtatacagcttggaatatttgggatttctactgaccctaatcctatcaatattaacaattcataagccaataaaattgtcttatcatatcaaataaagtcaacaaagaacaggacaaactgttgatatttttttcttcatgtatgyacttatataacatgacttttttgatgagaataaccctatactgataattagattaagaatattcaacctgttcattataattcattattggaaggaggaggcggccctgaatgttagaagtgaaaagataaagaaaaagctacacgcaacgtagtgaaaaacaacccaaggagcatgcaaggcatgtggtagctggttagatctgggttctctgtaggcggagcagctatttgtctccacgcttgagacaaccaggcatcacagacagaaaggacagtgcacagaaaagtgagctacata

SEQ ID NO: 92609 - DNA, 601 bp, Human
agcctcactctattgcccaggctggagtgcagtggcacaatctaagctcactgcaacctccgtctcccaggttcaagctattctcctgtctcagcctcccaagttgttgggactacaggcgcctgctcccaggcctgactaatttttttgtgtatttttagcagagacagggtttcaccatgttggtcagacttgtctcgaactcctgacctcaggcgatccacccgcctcagcctcccaaactgctgggattacaggcatgagccactgctcctggcctttcttcttcttcttcttcttmtattttagattttaaataatagagacagggtctcgctatattgcccaagctggtcttgaactcttgggctcaagcaatccttctgccttggcctcccaaaatgctgggattacaggcatgagccactgcaacctggctcattttcaattttctgagtacaaaggacccatatggctctacaagagaagaggaggcaagaaggtctaaggcaaatattttgaaatccaaaatgctctgaaattattaatgagacattctctcacaaataataaaaactatggaggggatgcattttgaatg

SEQ ID NO: 92610 - DNA, 601 bp, Human
tagctgggattacaggtgcccgccaccacacccagctaattttttgtatttttagtagagacagggtttcactgtgttagccaggatggtctcgatctcctgacctcatgatccatctgcctcggcctcccaaagtgctgggattacaggtgtgagccaccgtgctcagccatttctgtatttttagtagggatagggtttcaccatgttggccaggctggtcttgaactcttgacctcaagtgatctgcctgccgtggcctcccaaagtgctgggattataggcgcaagccactgcaccyggccaaattcaaatttattaaagttagttatatgagtttgtgttattagtgattcttttattgtcctttgttcgaaccctaaatcatctctaagtcctggcttggataaatctcactcattggttagattaactgtaacatgagataaacttactggcaggttgatcaagttttactatcgatgcttgtagtgcataaagtgcttgcagttccttctctgtatctgagtctaggtacttgagtaagatcggcactctctgcttgataacagcagtgtccactctgaaggtagaagagtcg

SEQ ID NO: 92611 - DNA, 601 bp, Human
atatactaccatcactgtggaaagttttattaggcctgccctggaatggggatgaaataacctaatctaaatagttttcttgttgtgatattttcatacaaacatataacaaattcatttttttttttttggacagagtcttgctctgttgtccaggccggagtgcagtggcgccatcttggcttagtgcaaactccgcctcccaggttcaagtgattctcgtgcttcagctttctgagtagctgtagctgggactacaggcacatgccaccacacctagccaatttttgtatttttgtattttttttttttttgagatagagtctcgctctgtcgccaggctggagtgcagtggcatgctcttggatcactgtaacctccgcctcctgggttcaagcgattctcctgcctcagcctcccaagtagctgggattacaggtgcccgccaccacacccagctaattttttgtatttttagtagagacagggtttcactgtgttagccaggatggtctcgatctcctgacctcatgatccatctgcctcggcctcccaaagtgctgggattacaggtgtgagccaccgtgctcagccatttctg

SEQ ID NO: 92612 - DNA, 601 bp, Human
ttgccacatgtggctcatgattaccatactcaatggtatggatatatactaccatcactgtggaaagttttattaggcctgccctggaatggggatgaaataacctaatctaaatagttttcttgttgtgatattttcatacaaacatataacaaattcatttttttttttttggacagagtcttgctctgttgtccaggccggagtgcagtggcgccatcttggcttagtgcaaactccgcctcccaggttcaagtgattctcgtgcttcagctttctgagtagctgtagctgggactayaggcacatgccaccacacctagccaatttttgtatttttgtattttttttttttttgagatagagtctcgctctgtcgccaggctggagtgcagtggcatgctcttggatcactgtaacctccgcctcctgggttcaagcgattctcctgcctcagcctcccaagtagctgggattacaggtgcccgccaccacacccagctaattttttgtatttttagtagagacagggtttcactgtgttagccaggatggtctcgatctcctgacctcatgatccatctgcctcggcctcccaaag

SEQ ID NO: 92613 - DNA, 601 bp, Human
atcatcctcaacatcattaaccattttcatgccctagacctgtgttgtccaatatggaagctattagtcaaacatggttatttaaatttaaagtcaataattcagttcctaagtcacaacagacatatttaagtatagaattgccacatgtggctcatgattaccatactcaatggtatggatatatactaccatcactgtggaaagttttattaggcctgccctggaatggggatgaaataacctaatctaaatagttttcttgttgtgatattttcatacaaacatataacaaattcatttttttttttttggacagagtcttgctctgttgtccaggccggagtgcagtggcgccatcttggcttagtgcaaactccgcctcccaggttcaagtgattctcgtgcttcagctttctgagtagctgtagctgggactacaggcacatgccaccacacctagccaatttttgtatttttgtattttttttttttttgagatagagtctcgctctgtcgccaggctggagtgcagtggcatgctcttggatcactgtaacctccgcctcctgggttcaagcgattctcctgcctcagcctc

SEQ ID NO: 92614 - DNA, 601 bp, Human
ccaggctggagtgcagtggtgcgatcttggctcactgcaacctctacctcctgggtttaagcaattttcctgcctcagcctcctaagtacctgggattataggcgcctgcctgggtttaagcaatttttcctgcctcagcctctcaagtacctgggattacaggcgcctgcctgggttgaagcaattttcctgcctcagcctcccaagtacctgggattacaggcgccggccaccacagtcagctaatttttgtattttaagtagagaagggatttcaccatgttggccaggctggtctcraactcctgacctcaggtgatccgctcatcttggcctcccaaagtgctgggattacaggcgtgagccaccgtgcccggcccaatctgaactatcttctgataccagtgaagctgtttcatatcatgtttatctcaatctaaaccctataaaatttaaatacgagtagttttttactttctttttactattttctgcgctgcaagtttactgtattatttttacaaaatttgggggaagggagaaaggcaggatatgctttttattccttgtaatgttgttttaaaaatgaagaggtggccg

SEQ ID NO: 92615 - DNA, 601 bp, Human
gcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccscgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagag

SEQ ID NO: 92616 - DNA, 601 bp, Human
tttcagatgttcatgaaaagctgccactagtacctctgtgggcacaaagctgtgctaggcatttcacttataggagagagatatttaatcctcacagaaccttgtaagagattactattcccttgttgcaagatgaagctgacggtcagagtagtgtaataatttgttcaaaggcacacagctagaagtggcaagccatgattcagattgacatctatatgactctgaaattttgttttccattgatgtgaatatgtatggacataagaatcttctaggtcccaggaggtagtctttggcstggtgtgactgtgactgtgtcctccagctctggtgtttgtctgcccagtgaggatgggcaggaccatacttgccttgtggcacgacatgtgccctggccaatagagcatcttctgggtcaattagtggggtgtgagttcctgctttcattccatagcttgggcacctgacccagagtaattgcaggaaaacagtgaaatattagtcagctgattaccaaaacaacaaatctaagcttttggggaggtgatttcacaaaatatttatctccaaagacttcccaggtacacgggggaagaca

SEQ ID NO: 92617 - DNA, 601 bp, Human
ggaaagactccttctgtcagctgggctcagctgtggcagctccagactccttgagatgactccatccctgcccagctgtccctggatccctgccctgtcctctttgggctcctccactaacctcacctgcatgccttggcctcagcagtagctaccatccttgccgcccactctttctctgtcttggagtgccttttcttctccccacacattcccccattttctaggccagcatctttccgcttaacctcctaagccttccttggtgaggattaggaacataacctcacccctggaaagkttgctccctgggcctatcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaagg

SEQ ID NO: 92618 - DNA, 601 bp, Human
atcttagctcccaggtcaaacttagagttgcagcaggccacagggaactctggaagggtatagaacccttggaggcactctaccatactccccttcccctgtacccctcctcctacagctggaggatgctgtcgttggacagggctctggagggcgggcttagtacctttgcaccctcccctctctgcccacttcccaccagtgtggatgcttttagcacaggctgtccccctttagccctttacagtggccttaccacaggtctcttgcttgctaacagcaaggacccagctgaccagcrtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcggtgagtggtagccagagtgtgctggctggggcttaaaggcctcatctcttcctagccttctc

SEQ ID NO: 92619 - DNA, 601 bp, Human
cagggagccagttgccaccctgccataggctctctagttggtttggcacttcagctacaaagtgcttgtgtcctcattggagccacatgccacccatatgtggccctctcgctatttcagagatgaataaacatgctcagggtttgcctgcatcatactccagttaacagcagagctggccaccactgcgctgtagtgctcctacattaaatggggtgttcaggtcattcagacccaggcgtccagcctttcctgtggccacgagatagactgagaggaagtgtccatttgctccaagttyctatgtaaatgcctgtacgactcagcgtggcccaagaggttagggttgggaccagtgggtggagggacatgcacaaccacaccgtggccaggtggagacatggcagactcaacagccgggatgcatgtaggcattctgggctgctcctctctcaggagctggagggaaaatgagcctctggagtcactagggggcaggtggagggtccagggaaactttacgggactcaaagggagccagggccagtgggggttgtcatgcagaggcagaattcagctcagcgaaaggcagggtcttatt

SEQ ID NO: 92620 - DNA, 601 bp, Human
aacttgaacaggggacctgcattttcattttgcaaagggccctgcaaattatgtagctggtgcagggaagagggaaccacctcgaggctgttgctgtagctctgctgagagacaggtgaggaggcctggtctctgcagaggagaggtggagggaggtttttcgaatggcaaatttctttcctacccccctgctaaagtatcagaaccctccaaggcctcaagtacagagaacccttgagagggaggccagcacagaggcaggctgtagtccagctccctgctgaggtgggggtgtgaggasctctggcagttgctggcattggaagaggggtctggcctagagctggcaggagagccagcttctcagtgcctacttccccttctttccctgctaccttagttctgcatgagaatcagctgacccatacagacttgaaaccagagaacatcctgtttgtgaattctgagtttgaaaccctctacaatgagcacaaggtattggtgggggtaagggtgaggccctgtttcaggggtgggttacccgctggtgcagactcctgacctggcaggcctgccttgcctttcagagctgtgaggagaa

SEQ ID NO: 92621 - DNA, 601 bp, Human
ggtgtggtggctgccttgtgacttccaggctggaagcataaggccggatctcacagcctctccccatcttggcttgcagagctgggctgggcacagccctgtgacgtctggagcattggctgcattctctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagacyctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtagg

SEQ ID NO: 92622 - DNA, 601 bp, Human
tctttgagtactaccggggcttcacactcttccaggtacagccaccctgcattggtcccctaccctgagtactgctactgtgataggctgcaggccactggggtgggaagccccacatggatgagaagacaggtgtcttcctcctcccactaatcatcatgtgagattcagaccctttaaggatgtagatgctaaagggaaggcagaggtcagggtagctggaacactcagaggagtcttatgctaggccatcgaggatggaggatggggtaggaggtgacctgaccttctagataaggggcacagatgactaaaggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgaaaaccga

SEQ ID NO: 92623 - DNA, 601 bp, Human; identical to SEQ ID NO: 92615

SEQ ID NO: 92624 - DNA, 601 bp, Human; identical to SEQ ID NO: 92616

SEQ ID NO: 92625 - DNA, 601 bp, Human; identical to SEQ ID NO: 92617

SEQ ID NO: 92626 - DNA, 601 bp, Human; identical to SEQ ID NO: 92618

SEQ ID NO: 92627 - DNA, 601 bp, Human; identical to SEQ ID NO: 92619

SEQ ID NO: 92628 - DNA, 601 bp, Human; identical to SEQ ID NO: 92620

SEQ ID NO: 92629 - DNA, 601 bp, Human; identical to SEQ ID NO: 92621

SEQ ID NO: 92630 - DNA, 601 bp, Human; identical to SEQ ID NO: 92622

SEQ ID NO: 92631 - DNA, 601 bp, Human
gctgctaaaagtgagtgagagagagagaaaaaacacaacccaaaaaaatttggcatctcttcccccctcaagtttctggtgtcacttatgaaacacaggtccttgttgctgcagagaagcagttgttttgctggaaggagggagtgcgcgggctgccccgggctcctccctgccgcctcctctcagtggatggttccaggcaccctgtctggggcagggagggcacaggcctgcacatcgaaggtggggtgggaccaggctgcccctcgccccagcatccaagtcctcccttgggcgcccktggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcgtgggacaatccctagcttggagccgtccagggggcatctgcttcttccacaacccacaactgaggccccagaaatcccagctgcgtttgggctgagcctctggcc

SEQ ID NO: 92632 - DNA, 601 bp, Human
ccaggcaccctgtctggggcagggagggcacaggcctgcacatcgaaggtggggtgggaccaggctgcccctcgccccagcatccaagtcctcccttgggcgcccgtggccctgcagactctcagggctaaggtcctctgttgctttttggttccaccttagaagaggctccgcttgactaagagtagcttgaaggtaagccagtggggaggagggctccagggccagcggcgggagcgggaggcctgttggacataggggctggttccctcttggtccatccctgctggtctgaggtgcrtgggacaatccctagcttggagccgtccagggggcatctgcttcttccacaacccacaactgaggccccagaaatcccagctgcgtttgggctgagcctctggcctcacccaagtcagctgagaggtcctggcgggggtttatttaggcagctgcctggctaagtttgaacagaacaggccacgggtgtgattccacagaaaaggcctggtgtctgctgcggtcatggccggaggagcgggagagggcgggtggagtggatgggggtggtgtgcactgcacaaggggcctcgtctgggcc

SEQ ID NO: 92633 - DNA, 601 bp, Human; identical to SEQ ID NO: 32437

SEQ ID NO: 92634 - DNA, 601 bp, Human; identical to SEQ ID NO: 32438

SEQ ID NO: 92635 - DNA, 601 bp, Human; identical to SEQ ID NO: 32439

SEQ ID NO: 92636 - DNA, 601 bp, Human; identical to SEQ ID NO: 32440

SEQ ID NO: 92637 - DNA, 601 bp, Human; identical to SEQ ID NO: 32441

SEQ ID NO: 92638 - DNA, 601 bp, Human; identical to SEQ ID NO: 32442

SEQ ID NO: 92639 - DNA, 601 bp, Human; identical to SEQ ID NO: 40318

SEQ ID NO: 92640 - DNA, 601 bp, Human; identical to SEQ ID NO: 40319

SEQ ID NO: 92641 - DNA, 601 bp, Human; identical to SEQ ID NO: 40320

SEQ ID NO: 92642 - DNA, 601 bp, Human; identical to SEQ ID NO: 40321

SEQ ID NO: 92643 - DNA, 601 bp, Human; identical to SEQ ID NO: 40322

SEQ ID NO: 92644 - DNA, 601 bp, Human; identical to SEQ ID NO: 40323

SEQ ID NO: 92645 - DNA, 601 bp, Human; identical to SEQ ID NO: 40324

SEQ ID NO: 92646 - DNA, 601 bp, Human; identical to SEQ ID NO: 40325

SEQ ID NO: 92647 - DNA, 601 bp, Human; identical to SEQ ID NO: 40326

SEQ ID NO: 92648 - DNA, 601 bp, Human; identical to SEQ ID NO: 40327

SEQ ID NO: 92649 - DNA, 601 bp, Human; identical to SEQ ID NO: 40328

SEQ ID NO: 92650 - DNA, 601 bp, Human; identical to SEQ ID NO: 40329

SEQ ID NO: 92651 - DNA, 601 bp, Human; identical to SEQ ID NO: 40330

SEQ ID NO: 92652 - DNA, 601 bp, Human; identical to SEQ ID NO: 40331

SEQ ID NO: 92653 - DNA, 601 bp, Human; identical to SEQ ID NO: 40332

SEQ ID NO: 92654 - DNA, 601 bp, Human; identical to SEQ ID NO: 40333

SEQ ID NO: 92655 - DNA, 601 bp, Human
aattaaacgaccaattgacctctcacctaaatcaggaaagacatagaagatctgaataacacaattaatcacctttacctaattgatatttatagcgcactccaccaaccaactgcaaaatatacattcttttcaggtgcacaaggaacgttcaccaggacaggccataggctgggctataacacaagcctcgataaatttaaaaggactgaaatcatacagcgtgtgttctctgaccacaaattgaattaaattagaaatcaacaataaaatatttaataagaccctaaatatttaccawaaaatagttgtgataaggactctccctgcttagtaatctctagtggctcccccaactaccgaaagaaacaaaaattcgtcccctccaccaccctatcccttctacagcatagtcccatccagtcttctgaggtttatctcccggggtccctccacgtcagaggttctcaagctttgcgttggggaagaagcgcctgggttgctcactaaaattcagatcccagggatgcaagtgcaataacttgatgaagttgactggaaggggacccaagaatctgcattttaaacaagtgctgcagga

SEQ ID NO: 92656 - DNA, 601 bp, Human
cattggagagaaaataaaagcaggcatatattggagagaggagaaatgtcgatgggtacatttcccatttttactgtcttgtagcctgaaggcagacctcagtctacaccctgtggaatggctaaacctagacagaaaccctttattctcagtggcttgaatacccaaaaggcagggcttggaataatcacagcagctggaaaatgaggggagaaagcacagacaggggagagtgtagagaaggaggcccaaactctgtatataaactctgctcaaatccctgaccggcccctaaagtagkcatgaatggggtagactccaagcagcccaggtaaagttaaccaacaaaaaaagaagagagatttcagagtttggagttcagccaaattaattgcctaccaaaaccggatgaaaccaaaccaacactctttggaggaatataacagaatctacagtaatttcaacacaatgtccaggatacatttcaaaattgttagacatacaaagaaagaatatgcgacccatattcaagagaaaagataatagtgactgaccctgatgaccaaaatgttgaattagcagacaatgattttattttatt

SEQ ID NO: 92657 - DNA, 601 bp, Human
cctgccaattggtgcactgggattcaggtggagaaatcagtctcttgtgggctgtttggaaaagtgatgagtttccgaacaaacctgaggaccagagtgtcattttctagggcccagctctggcagctgcctggcctctgattatcacctcagcccaggcatcagcatccctatttgtcagatgagggatcaggctcccagaggctgagtgactcccccaggcacgtggttggctgacatctgactaataccgtgccttctcattcctcacacggtacttctctttccactatgccacacrcaatgtccagcttgcaaactcaactctattctgaatgttggcatggttggaactgaaatcacttactgacatcatgaatctgaacatgaggataaagtggagactgttttaccaaatctatcacatccactgccgtcaccttcatcctctaaacctgcagctctgagcaatacaacgtttccctccgtctatgaaaagaaacactaataaaaacatcatgatgcttgtgatgagaatcaagtttcagtgtgctagaggaagggaccatctcactgagcagatgattcaaaactatatcta

SEQ ID NO: 92658 - DNA, 601 bp, Human
ggtatctcattataagcaagacaaagtaaggcaacagaagggtgttgtgggtaagggtggagtggtcttcacattgtcaaaaagctggtgggccaggtcccatgggccaggagcagctgagatttatctaggacagtccagggaagggggtcatgaatcatacaaacactcccagcttagccccagaacgtcagtttcctttttctagttctcctcttgccaagttctattctgagctccctagcagcctttgccccaggaagggcatgccccatgcaagtggccagtgttggctgttccrtgaggcatagctcccctgccaattggtgcactgggattcaggtggagaaatcagtctcttgtgggctgtttggaaaagtgatgagtttccgaacaaacctgaggaccagagtgtcattttctagggcccagctctggcagctgcctggcctctgattatcacctcagcccaggcatcagcatccctatttgtcagatgagggatcaggctcccagaggctgagtgactcccccaggcacgtggttggctgacatctgactaataccgtgccttctcattcctcacacggtacttctcttt

SEQ ID NO: 92659 - DNA, 601 bp, Human
ggtgggtagagcccagccttcagaaccagatgaatcaatcaggttccccaagcagctgtgcggtcacagggaagttgcttaacctctctgagccagagttcctcctctgtaaaacgaggatgatgctacccagcttacaggattgttgtaaagattaaataatatatgttacatgtaataataaagattaaataatatatgtaaagcatttggcacaactatttgcttggcaatatagtagaacctaataaatgtaggaattgttttaaatatatttttaaggataaggtgccttctataygtcagcaagaagtagccaccaggaagtgtgatttatataaaagctatagtcttaggaaaaaatggtatctcattataagcaagacaaagtaaggcaacagaagggtgttgtgggtaagggtggagtggtcttcacattgtcaaaaagctggtgggccaggtcccatgggccaggagcagctgagatttatctaggacagtccagggaagggggtcatgaatcatacaaacactcccagcttagccccagaacgtcagtttcctttttctagttctcctcttgccaagttctattctgagc

SEQ ID NO: 92660 - DNA, 601 bp, Human
tggaggaagaggttgttggagtttttggtaaaactgacagtttgcaacagagggaaggtgactcagagagtcaagacccctgcagtccaggggccagctaatcaccctccctctcttcctggcccctgtgcagcctcagcttggagagtttatcaatagctccaatgacctcggcgatcactgtgaactccgggtactgctggaacctctacttctagcccactcctcgatcctcccctagcccacgagcttgggcctctctgggtcagcttcccacttcagtgaaaccctgtctcctgtsacatgttacccccatccctactccaggaaaaagaccccacccgaatgtctataacattcctggaaaaccactgctgtttgttccaggacagaatagggacatggaatggtctctggcttgacatatttccatttcacactgtgtgtattggatacattgccatttcacccatagggaggctggatggaatataaaaacaccaccagcctgagagtaaggaatacagggtgttagaggcctggctctgccacagatatgctgagcatccttcctgctgcacgaccctctctggtctaccct

SEQ ID NO: 92661 - DNA, 601 bp, Human; identical to SEQ ID NO: 40334

SEQ ID NO: 92662 - DNA, 601 bp, Human; identical to SEQ ID NO: 40335

SEQ ID NO: 92663 - DNA, 601 bp, Human; identical to SEQ ID NO: 40336

SEQ ID NO: 92664 - DNA, 601 bp, Human; identical to SEQ ID NO: 40337

SEQ ID NO: 92665 - DNA, 601 bp, Human; identical to SEQ ID NO: 85389

SEQ ID NO: 92666 - DNA, 601 bp, Human; identical to SEQ ID NO: 85390

SEQ ID NO: 92667 - DNA, 601 bp, Human; identical to SEQ ID NO: 85391

SEQ ID NO: 92668 - DNA, 601 bp, Human; identical to SEQ ID NO: 85392

SEQ ID NO: 92669 - DNA, 601 bp, Human; identical to SEQ ID NO: 85393

SEQ ID NO: 92670 - DNA, 601 bp, Human; identical to SEQ ID NO: 85394

SEQ ID NO: 92671 - DNA, 601 bp, Human; identical to SEQ ID NO: 85395

SEQ ID NO: 92672 - DNA, 601 bp, Human; identical to SEQ ID NO: 85396

SEQ ID NO: 92673 - DNA, 601 bp, Human; identical to SEQ ID NO: 85397

SEQ ID NO: 92674 - DNA, 601 bp, Human; identical to SEQ ID NO: 85398

SEQ ID NO: 92675 - DNA, 601 bp, Human; identical to SEQ ID NO: 23293

SEQ ID NO: 92676 - DNA, 601 bp, Human; identical to SEQ ID NO: 23294

SEQ ID NO: 92677 - DNA, 601 bp, Human; identical to SEQ ID NO: 23295

SEQ ID NO: 92678 - DNA, 601 bp, Human; identical to SEQ ID NO: 23296

SEQ ID NO: 92679 - DNA, 601 bp, Human; identical to SEQ ID NO: 24966

SEQ ID NO: 92680 - DNA, 601 bp, Human; identical to SEQ ID NO: 24967

SEQ ID NO: 92681 - DNA, 601 bp, Human; identical to SEQ ID NO: 24968

SEQ ID NO: 92682 - DNA, 601 bp, Human; identical to SEQ ID NO: 24969

SEQ ID NO: 92683 - DNA, 601 bp, Human; identical to SEQ ID NO: 24970

SEQ ID NO: 92684 - DNA, 601 bp, Human; identical to SEQ ID NO: 24971

SEQ ID NO: 92685 - DNA, 601 bp, Human; identical to SEQ ID NO: 24966

SEQ ID NO: 92686 - DNA, 601 bp, Human; identical to SEQ ID NO: 24967

SEQ ID NO: 92687 - DNA, 601 bp, Human; identical to SEQ ID NO: 24968

SEQ ID NO: 92688 - DNA, 601 bp, Human; identical to SEQ ID NO: 24969

SEQ ID NO: 92689 - DNA, 601 bp, Human; identical to SEQ ID NO: 24970

SEQ ID NO: 92690 - DNA, 601 bp, Human; identical to SEQ ID NO: 24971

SEQ ID NO: 92691 - DNA, 601 bp, Human; identical to SEQ ID NO: 24197

SEQ ID NO: 92692 - DNA, 601 bp, Human; identical to SEQ ID NO: 24198

SEQ ID NO: 92693 - DNA, 601 bp, Human; identical to SEQ ID NO: 24199

SEQ ID NO: 92694 - DNA, 601 bp, Human
gcagctttgtcagacacagatcatgggtcttgctccagaatccattgggctgccaagtgactctttgaagatctgtctgtaatgtgtgagtcttgtccatctgctcttgactctgagctggctaggtgactgttggttattcctgggacaggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgrtgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaaggggaggaatatggcttttaacaggagccccctttctcagatgatagtgcagttcagcacagtgtaaaaaccagccagcttcctatttagtccagaaaaggatgggattcagagcccaagttc

SEQ ID NO: 92695 - DNA, 601 bp, Human
tgttgagacctgacccctagtcattggttaccagtgtgtcaggcaatctggactttcccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccaytgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtt

SEQ ID NO: 92696 - DNA, 601 bp, Human
ttccctaccaggaggcagtccagcgggacttccgccccgcgcaggtcggcgacagcttcggacccacgtaggtaacgcccagcgggtgggcggggccacaggcctaggggaagtcccaacccagctcccagccacaccttcgttgtctgccctctgccgtagacaactacgtgggatcgagcagcaccctctgctgggagcagcaccctctgctgggaacagctctctggtccctgggtcttcaggggatggttttcattcccacgtggccgcctctggacatcccttaggaagggcaccytagggatcacgaacctttgacgcctctgcctgtttccctcatcttgcttctcaccttgttgctcctttcttgtgactcaaagctgagtaccttgtgacactgcagatgcttggagagtttcaagcccctgccgacactttatccaaggaaggatatcaggataggacttctacctctaggcctatcacaacagctctcttgcagatggtggacctgctggttccgggtggagctgaccatcccagaggcatgggtgggccaggaagttcacctttgctgggaaagtgatggagaaggtct

SEQ ID NO: 92697 - DNA, 601 bp, Human
gatcttgggtctaaaagtttgagcctgggagatccgaacatgattttaatatgcaaagagggttccaagaccaaggcagtgctttgcaaagacaactttggaaatataagactaaacagcagcgtactttacatggttccaaactttgctacttattctctctgacagcaagacatgggatccatctggtgtttgtaccacaaccctcccacatgcactcttgtcacactgtgggatcctctgggtagtggatcctggaagcagacaggttgggctcagctggatgcctcctgggtgcccyttccccaagtccccggagtactgtgccagtcccttagcctgaggctgtctccccatctttgtagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaaggtacttgacaccccctgtaccccctgctaccctctagagccctgctccaagaaggttg

SEQ ID NO: 92698 - DNA, 601 bp, Human
caggcgattctcttgcctcagcctccttagtagctgggattacaggcacccaccacaatgcctggttaatttttgtatttttagtagagacggggtttcaccacgttggccaggctggtctcaaactcctgacctcaggtgatccgcctgccttggcctcccaaagtgctgggattacaggcatgacccaccgtgcccagcctcatttattctttcaacaaaatctgatgcctcatggggcccatgctagatattgagggtaggattacagagacagattcagcaggcagagttggtgtcacaatggtggggagtctgaggcactggagagcacaggagaggtacttactccagctgggttgggggattccagagaggcttcctggacaagtttgcagtgtctgagttttacgggaaatccacatttttaacaagctcctgaaggtattgattctgatgcagccgaagttttgggatcacagaacaagggctttctctgctgtgccaagatgtagggtaaggtgtgagaggttctgggctggtaagggaggaactgcagcctgggagtcaggagaggctgtagcacctctggtaggacagc

SEQ ID NO: 92699 - DNA, 601 bp, Human
cttcaacctgcccacaggcgcagcagctggaatgggtgaagagccgctaccctggcctgtactcccgcatccaggagtttgcgtgccgtgggcagtttgtgcctgtggggggcacctgggtggagatggtaagtgcactgggcactcctcagccttgaactgtatgacaacagccttccctcaggtagccccgccctcccggctttgctggtgagtttccacgggccactcatccccgctgtgtggcagggctggctcattagtccctgggatctcaaggcctgggacttcaagggggagragagcctccagcgctgtgacaagttgcatggcctagtcctgggcaccccctcaggcagatggacagtcaggcctgaaggacaggggcccttcctgagttctggctgtaactcccatgtttgagcagccctggcttctcctgcagggattgggttggcctgagcgcctgcctgctccccgtccagcgctgacctgggctgcctcccacttccttcactgccaggatgggaacctgcccagtggagaggccatggtgaggcagtttttgcagggccagaacttctttctgcaggagtttggg

SEQ ID NO: 92700 - DNA, 601 bp, Human
tgcactccagcctggcaacagagtgagactccatctcaaaaaaaaaaaaaaagccgggcgtggtggcacatgtcctgttatcccagctacttgggaggctgaggcaggagaatcacttgaatcctggagggcggaggttgcagtgagccgagatcaagccactgcactccagcctgggtgacagactgagatcctgtgtgaaaaaaacaaagttttacatttaatttgatactcatgatcattcgatggggtgagtactattatttattcccgtttcacagataaggaaactgaggcttakgcaggttgggtggcatgcccagggccccgtacagtgggagctggagttcagttgtgtggttctagagcttgtgctcggcctagtgacaggagctctggagtctgggagcacaaagaggggcacagggccaccaagtgggtcttggatctgccctccaggtgtgggcccatcgctggatggatctgtcagaacacggctttgggctggccctgctcaacgactgcaagtatggcgcgtcagtgcgaggcagcatcctcagcctctcgctgtaagtggggtacccaccaggcctgggagctg

SEQ ID NO: 92701 - DNA, 601 bp, Human
gcagccctagacacctctctgcccttccctgagcccaaaccccagcaacctggcttcctgccccttctagggacaggggagggtagcccccattctccaccagcattgtttcctggtcgtaccccaggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcaaggggtgggacgtgctggggayggggttccgaactgggcctgccctcggcccctcccaccagacgtgttcctctgcaggcggagagcagcccccagcgccgctcgctggtcctgaggctgtatgaggcccacggcagccacgtggactgctggctgcacttgtcgctgccggttcaggaggccatcctgtgagtggcggtgtgggattggggcgggggtcgagtctcgccctcgcagagccttcatggcccctcctgttctccagctgcgatctcttggagcgaccagaccctgctggccacttgacccttcgggacaaccg

SEQ ID NO: 92702 - DNA, 601 bp, Human
tcctccgccttcttgggatccggttggccggaggggccgtactgatccgtgatgccactccccttggccgtccccccctgcaccccgcccaggccccgggtttccgcctccttggcaatgaggaggtgctagggaaagcccgctgtcgggtctggctgggagtctcggcgcctagatctgccccgccctatgtctccgtggggagggaggggcacccgccgactgggagctgtggaggtgtcaggacttactcttgtggctgggtcatgccttctgcctgggggcacaagggccctgtgcyggagctgctttctccgctttgctccatgcagcgtgtctggcaccgtgcagccaggagagtgggagcatggtcacccccactcccctcttggttgtaactattggggcgaagtgcccaaggtcctcttgtaggagcgtgcgtggctggtgctggaaccctagatccgcggtggtgatggtaggggaggggcagggagtcatcagagactagaaatgtggcggagggaaaaccttccctggggttcccttgatgttcagttaccgtggctgtacggggcggggcttcctttgagccaatggg

SEQ ID NO: 92703 - DNA, 601 bp, Human
tgacagtggacccttcatgagtcttcttggtgtcctccagggctaggcttgctgacatatgggctattggaggatatgcaggtccacatcctttatttgcagttctgaaatgcaagagtttttgttttttggtaagtctagttccacaactagttttggggtacagcctgacctgggctatcctgcatgatgcagaaatgtgactgcttgattatggggagctactcagccctagctgggagagagagatgatacagtatatgtaccatattacctttctaaaatccaaacaatgctgatractctaacggggatctctccctctaccatagactaatatgtttagtggcccactcaaggtctccactcgatgtctcctcttggataactaagagacattgttgactcttctgtgtctttttcatatgtggtccatcagtaaattttactgctttatattcaaaatactatccagaattagaccacttaggatctgcatctccactgccctagtcagtgcctgtgcatctctagcttggattctattctccttgttttgttactgcggctcttaaatgtgttctcaacatagcaacccaag

SEQ ID NO: 92704 - DNA, 601 bp, Human
tatctcggctcattgcacacacacacatacacacacccagcttcaagtgattctcctgcctcagcctcccgagcagctgggattacaggcatgcgccactacacccagctatttatttatttatttatttattttgagacggagttttgctctgtctcccaggctggagtgcagtggtgcaatctcggcttggcacaatctcagctcactgcaacctccacctcctgggttcaagtgattcttctgccttagcctcccgagtagctgggattacaggcacccaccaccatgcctggctaatttttttttttttttttttttttgagacagtgtctcgctctgtcgcccaggctggagtacagtagcgcgatctcagctcactgcaatctccccttcccaggttcaagcagttctcctgtctcagcctcctgagtagctgggatcacaggcgccaccaccatgcctggctaattttttgtatttttagtagagacagggttttaccacgttgaccagccttgtcttgaactcctggcctcaggcaatccacctgccttggcctcccgaagtgctgggattacaggcatgagccactgcacct

SEQ ID NO: 92705 - DNA, 601 bp, Human
tggagtgcagtagcgcgatcttggctcactgcaacctccgcctcctgggttcaactggttctcctgcctcaacctcccgagtagctgggattacaggtgtgtaccaccatacccagctaatttttgtatttttagtagaaatggggtttcaccatattggccaggctggcctcaaacttcttatctctcgaagtgctgcgattacaggcatgagtcaccatgcccagcctgaaaatttattttttttccaaaggaataaactcattttagctattaccacttgtacatcgaaacaatgttrtggagttttactgatcttatttttcctgtatattgaaatgttttggtatttcatcatcctaggaattatttcatcattactcatcaattctcaaatatgctaaagaggactaaaataatatgacaaagggagaattatagaattgcttaaaaggatatgcagtagtgaaataaatcattagttttacacttcagtttttagagatggggcctcgctttgttgcccaggccgaagggcagtggtatgatcatagctctctgcagcctcaaacttctgggctcaagtgatcatccctcctaa

SEQ ID NO: 92706 - DNA, 601 bp, Human
ttttgagacagggtcttattccatcacccatgctggagtgcagtggcataatcacagctcactgtagcctcaacctcccaggctcaaatgatcctcccacctcagcctcctaagcagcaaggactacaggtgctcactaccatgcccagctaatttttaataaaatttttttgtagagacggtgtctcactttgttgcccaggctcatctcaaactcctggcctcaagcaatcctcccaccacggcctcccaaagtgctaggattacaaatgtgagctgctacacccagcatcccacccgtttttttttgtttgttttgttttttgagacggagagccttgttctgtcaaccaggctggaatgcggtggcgcgatctcagctcactgcaccctccgcaccctgggttcaagcgattcttgtgtctcagcttcctgagtagctgggattacaggcacccacaaccacacccggctaatttgtttttcgtgctttagtaaagacagagtttcgccatgttggccaggctggttttgaactcctgacctcaagtgatccgcctgcctcagcctcccacagtgctaggattacaggtgtgaacca

SEQ ID NO: 92707 - DNA, 601 bp, Human
tggcgcgatctcagctcactgcaccctccgcaccctgggttcaagcgattcttgtgtctcagcttcctgagtagctgggattacaggcacccacaaccacacccggctaatttgtttttcgtgctttagtaaagacagagtttcgccatgttggccaggctggttttgaactcctgacctcaagtgatccgcctgcctcagcctcccacagtgctaggattacaggtgtgaaccaccgcgcccagttttattataacacatggccaggtgacttttaggacctgtaggtgttttttttgtrtgtgtgtatttgggatcttcctctgtcgctcaggctggagtgcagtggtgcaatcttgcttaatctaacctccacctcctggcctcaaatgatccttcctcctcagtcacccagagtgctggaattacaggtgcaagccactgtgcccaccaggtgacctttaaatgttctgctgccattatttagtcttctctccatagtttctatacgtcaaagtgctttttttttctttttataatgtcttcctagactagagttctgatagtactataaactccaaatttgaaacagatggagatc

SEQ ID NO: 92708 - DNA, 601 bp, Human
tgcagtggtgcgaatttgctcactgcaacctccgcctcccaggttcaagcgattctcccgtctcagcgtcccaagtagctgggattacagatgcgtgccatcatgcccagctaattttgtatttttagtagagactgggtttcaccatgttggcctggctggtctcgaactcctgacttcaggtgatccacccacctcggccttccaaagtgctgggattacgggtgtgagccactgtgaccagcctatgaagtttttgttttttaaacccagtgctgccctatcataacatttctataattttttttttttttttttttttgagacagagtctcagtctgttgcccaggctggagtgcagtggtgggacctcccctcatgcaacctctgcctcctggattctagcgattctcatgcctcagcctcccaagtagcaggttttacaggtgtgcgccatcacacctggctaatttttgtatttttactggagacagggtttcaccatgttggccaggctggtcccaaactcccgaccttaggtgatctgcctgcctcagcctcccaaagtgctgggattacaggtgtgagccactgcatccgg

SEQ ID NO: 92709 - DNA, 601 bp, Human
ccaggctggagtgcagtggtgggacctcccctcatgcaacctctgcctcctggattctagcgattctcatgcctcagcctcccaagtagcaggttttacaggtgtgcgccatcacacctggctaatttttgtatttttactggagacagggtttcaccatgttggccaggctggtcccaaactcccgaccttaggtgatctgcctgcctcagcctcccaaagtgctgggattacaggtgtgagccactgcatccggccaataaagtattgacttcatttttggttacagaggttaatctcmgatgagttaagcatcagttttaaaccaacagaacccaagaccaaaccactgaaagtcatgaacgtatataagaaatagctaaaaagacattttactctacctgtgattagactcagttcctcatcccaaaacacgctgaggtttagtgttcgtagttgattagtggcaaataacatgcataaatctatatactcaacctcttaatatgtctaaaaggtttttgaatactaagctaaacatgctatttcatgctagaaaaacataggaaagcataactagctaagacattttaaattattt

SEQ ID NO: 92710 - DNA, 601 bp, Human
aagggtctaccatcgttggtttacattgtggtgcaaactccttaacctgttggaaaccagtcagcaggtttgaggacatacaagagtttgtcaagtacctatgaaagggattgctgtgtcacagggtatatgcatctttagcaagttcccccaagcattgtatattcctgttctatgtcctgaccaacactgatcattcatctgttactctgttttgtagaagtgaagaaatttggtttttgcccttttttattatgaaagtaatgtatcactttggtttttttattttttattttattcttttatttatttatttatttatttattttgagatggagtttcgctcttatcacccaggctggagtgcagtggtgcgatctcggcccactgcaacctctgcctcccgggctcaagtgattctcctgcctcagcctcccgagtagctgggattacgtgcacctgctgccatgcctggctaattttttgtgtttttagtagagatggggtttcgccatgtgggccagactggtctcgaactcctgacctcaggtgatctgcccctcttggccttccaaagtaccgggattacaggtgtgagcca

SEQ ID NO: 92711 - DNA, 601 bp, Human
aagagtttgtcaagtacctatgaaagggattgctgtgtcacagggtatatgcatctttagcaagttcccccaagcattgtatattcctgttctatgtcctgaccaacactgatcattcatctgttactctgttttgtagaagtgaagaaatttggtttttgcccttttttattatgaaagtaatgtatcactttggtttttttattttttattttattcatttatttatttatttatttatttattttgagatggagtttcgctcttatcacccaggctggagtgcagtggtgcgatctcrgcccactgcaacctctgcctcccgggctcaagtgattctcctgcctcagcctcccgagtagctgggattacgtgcacctgctgccatgcctggctaattttttgtgtttttagtagagatggggtttcgccatgtgggccagactggtctcgaactcctgacctcaggtgatctgcccctcttggccttccaaagtaccgggattacaggtgtgagccaccacgcctagcctattttatttatttatttatttatttttgagacagactctctgtctgttgcccaggctggagtgcaatg

SEQ ID NO: 92712 - DNA, 601 bp, Human
acaatgtggatcatacattacatactattgtgctgtttgctcttttcatttaatatatagtggatatctttctacttcagcatataactggtctggggaggccttcaacctcatttgttagtgaccttaaaaatgtacggctggtaatgggaatataaactgacgtaatcttttttgagagcaatttggcagtttgtgtcagatggttttgttagtttttgacctggcaattccatttctaggaatttagtataaaaatataaagaagaggaaatgcagctgaagtaggaaatggtgattmcttaggtgtcactcttcctcaggagtccccttgaggctgtctaatcccttcctgtggggctggggcagcagtcagaagactgccaacagatggcatcttttaggacttggaagaaaaaaaagttgcttgtttaccttgggtgattactttcattatctaaacaggttaatgactgttttctacatttgggatagttaaatttcttccgaatggaaactataatgtgtttgtataagtcagtctagtgaaagcctgtaaaccctgtaaaaaacatgcatgttggaatacagaagctcagaa

SEQ ID NO: 92713 - DNA, 601 bp, Human
gtccagctattttttttggtattttcagtagagacagggtcttaccatgttggccaggctggtctcaagctcctgaactcaagtgatctgtctgcctgggcctcccaaagtgctggttacaggtgtgagacactgttcccagctaaactatatatatatttttttgtttgtttgtttttgagatggagtcttgctttgtcgtgcaggctggattgcagtggcacgatcttggctcactgcaagctccgcctcctgggttcacgctattctcctgcctcagcctcccgagtagctgggactrtaggtgcccgccaacacgcctggttaattttttgtatttttagtagagacggggtttcaccatgctagccaggatggtctcgatctcctgacctcgtgatccgcctgcattggcctctcaaagtgctgggattacaggcatgagccaccgtgcccggctatataatttttaatagctacaaataattttgttataactttggtgggctgtaatttatttaaccagttccttttgtggaaaatttgggtttctttctttttcttttctttctttttttttagagacggtctcattctgtca

SEQ ID NO: 92714 - DNA, 601 bp, Human
ttttagtcacaagctcttgactatattcctgcataaaataacttgttgaatttcctttctgatgaggagaggtaaaatgcttcttgtacctccatgtaatttaactcagtattcccacattgcctgtcatttttggatcagtcttaaaatgcattacaagcatttgaatcaacttcaataaatcatttatattctataataatgtaggccgggcatggtggcttacacctgtaatcccagcactttgggaggccgaggtgggtggatcacctgaggtcaggagttcaagaccagcctgacmaatgtgatgaaaccatgcctctactaaaaatacaaaatgagccaggcatggtggcgcatgcctgtaataatcccagctactcaggaggctgaggcaggagaatcgttggaacccaggaggcagagattgcagtaagccaagatcataccactgcactcgagtctgggcgacaagagtgaaactccgtctcagaaaaaacaaacaaaaaaaaagaaatgttcagtgagaatgcttacacattatttcaagcctcaacattgtcttttttttttgttttttgtctttggtagattggtggtg

SEQ ID NO: 92715 - DNA, 601 bp, Human
tgcactcgagtctgggcgacaagagtgaaactccgtctcagaaaaaacaaacaaaaaaaaagaaatgttcagtgagaatgcttacacattatttcaagcctcaacattgtcttttttttttgttttttgtctttggtagattggtggtgacaagaagggatttgaacgatttgaggcatgtttggtgttatttagttattgaatgtcagcagcagtgatatttggtacatatttagcaggttatctttacagttgcttgtgtttttctctcccaacaagattgtagacttcaggagattcrgggccttaatagtaaatccctgttgaagtgagctaagaaactttatcagcagagtctaagggtctccccaagtgcttccttaaatctgtagcttctaaataactacatccaagttttttttttaagttgtgctacctagaactgtatacatgcatttatagagagtttatataagagttggactatgctttaggtgatgagagaatttcctcactatttttacatgtaggtgtcttatttattatgtgagtgtcatgcagagtttttaaagcataggattattctataacttttatttta

SEQ ID NO: 92716 - DNA, 601 bp, Human
gataacaacactgctttagaaaaagcaaaacaaaattctgcatttttataaagcttgatttaaacaatggtatttcaaaatttacaaacttcataactttatagttcaaactttacagtcaccagaagtacacagttaccaaaaatgcacatgtttcacttggcatctctagcaccttcagctttctgtgcctggtctgttttggcatctccatttcctgcaaggttattcccctccctgccagtgtcagcattttcctttttccctttgggtacctcctctctctcctttgcaggggactttttttttttttttttttttcctgagaccgagtttcactcttgttgcccaggctggtgtgcaatggcatgatctcgactcaccgcaacctccgcctcctgggttcaagtgattcccctgcctcagcctcccgagtagctggcattacagacatgcgccaccatgcctggctaatttttgtatttttagtaaagatgggtttctccgtgttggtcaggctggtctcgaactcctgacctcagatgatcctcccacctctgcctctgaaagtgctgggattgcaggtgtcagccactgcgcc

SEQ ID NO: 92717 - DNA, 601 bp, Human
tgggctctggctttggaggagcaggtttagcatacaaccttgcggatcttctctgggttgttcttcaccttggctctatctcctttagcatccccttcaggctttctcttgggtgtggtggtgatgtggaaggatgtaagcgctgagtgcgggatgcagtggcatgtgggctttgatcggtccgagagtcactcttgactgttcttcctcagtgctccgtggcggatcacttttgaatgctggctctcccttagctcctctattcagtcagttccccaatcctgtcacttctactacccaraaagcttttttatctatgcagttctctctgttgttctgggccagtactataattcaagccactgttttcacatgagttgtccagttattcctgtagcatacctggtcttcctacctcctttcaatcttttctgctcttgtgccaattttttctcaacactgcagtcaaattgcgtacacgaaaatgcagatgataaaaatctaaattgctttttcacaagatttacaaatcctttcagaatctagatcctgcttttttttctgtctcattttgttacttttccttcctcttcactacaga

SEQ ID NO: 92718 - DNA, 601 bp, Human
tcaggtctacaatgatttccttgacatcatgaaggaatttaaatctcagaggtaaaagatgtgtgattgtactcaagctttgtatctggcatattgattttggaaggaagaggatatagtttatttactggaagataaaggatgctcctttttgcagctgaattttcaaaatcatgcctttattttatgcatacctttattgatggaaattatggccactagacttttttatccctattggtaaattttccttaactaaattttttccagtgttttgtctcaatcagggaagtagcactgstagtgatttaggctacttggtttctgaattggtttagatacccttatattctggcatggttcactgttgtaagagtgtaactcatctgaacaatgtagatgtgtgctgaaatgatgtatactggtatatcaaagagtgaatcttgtttgggatatgtagctttatatatatcatctgagtatctgcttggtagaattattacaatgaacatatattctgttaaaaattttgaccattccaaaaattagccgggcatggtggcgggtgcctgtaatcccagctacttgggaggctgaggca

SEQ ID NO: 92719 - DNA, 601 bp, Human
acatatcaggtaaggagtgcccattcagcctgtcttaaccaggtcaccctcttagggcatctagtccaataacaagtaaccattattgtgtccattaattcatactggaaattaaccagttagaaactatcatgcatgtttttaaagccagtttgtttgtttgtttgtttttcgagacggagtcttgcactgtcacccaggctggagtgtagtggcacgatctcagctcactgcagtctccgcctcccgggctcaagtgatactcctgccttagcctccctagtagctgggattacaggckccgcccaccacgcccagctaattttttgtattgttagtagaaatgggatttcactatgttggctaggctggtctcgaactcctgaccttgtgatctgcccacctcggcctcccaaagtgctgggattgcaggcgtgagccaccgcccccatgctataaagccagttttatttgcctgacttgattgccctgcaacattcagtcaggatttttttttttttttttgagacagagttttgctcctttttgcctaggctggagtgcaatagtgcagtgtcggctcactgcagcctctacctcc

SEQ ID NO: 92720 - DNA, 554 bp, Human
tggaaattaaccagttagaaactatcatgcatgtttttaaagccagtttgtttgtttgtttgtttttcgagacggagtcttgcactgtcacccaggctggagtgtagtggcacgatctcagctcactgcagtctccgcctcccgggctcaagtgatactcctgccttagcctccctagtagctgggattacaggcgccgcccaccacgcccagctaattttttgtattgttagtagaaatgggatttcactatgttggctaggctggtctcgaactcctgaccttgtgatctgcccacctyggcctcccaaagtgctgggattgcaggcgtgagccaccgcccccatgctataaagccagttttatttgcctgacttgattgccctgcaacattcagtcaggatttttttttttttttttgagacagagttttgctcctttttgcctaggctggagtgcaatagtgcagtgtcggctcactgcagcctctacctcccgggttcaagtgatttcttgtatttttagtagagacggggtttcaacatgttggccag

SEQ ID NO: 92721 - DNA, 601 bp, Human
aagccccaactgaacaacaagccgcagaggcccagccagaatggctgccagatccgcagacatcctacaggaaccacccctccagttaaggtgagaatgggcagcagctgctcattttgacactcacaagtatttctaatggagaggtactctagaggtggtcatgtgttttgttgttgttgtttttttttgtttttttgagaccgagtctcgctctgtcgcccaagctggagtgcagtggcacgatctcggctcactgcaacctctgcctcccgggttcaagcgattctcctgtctcgcyctcccgagtagctgggactacaggcgcatgccaccataccgggctgatttttttttttttttagtggagacggggtttcaccgtgttagccaggatggtctcgatctcctgacctcatgatctgcccgcctcggcctcccaaagtgctgggattacctgtgcccggcagtcatgtgttcttaagtgtgttaacggttgggtcctagatatttggaggaagttagtattgtgtcacagaaactcagtgcagagtttatctggctttgcaaaagagtattagaataacattgattgcttgga

SEQ ID NO: 92722 - DNA, 601 bp, Human
acctcatgatctgcccgcctcggcctcccaaagtgctgggattacctgtgcccggcagtcatgtgttcttaagtgtgttaacggttgggtcctagatatttggaggaagttagtattgtgtcacagaaactcagtgcagagtttatctggctttgcaaaagagtattagaataacattgattgcttggattactgtacttttctgagttctttattatctctcctttgcaatgagctgtcatttctttaatgttttggttgctactaagaatttccaatacttgaaatttttttcccttcwtttttttttgagatggagtcttgctctgtcgcccaggctggagtgcagtggtgtgatctcagctcactacaacctctgcctcccgggttcaagcaattatcctgccgcagcctcctgagtaactgggactacaggcgtgtgccaccacgcccagctaatttttgcatttttagtagagatggggtttcgccatgttggccaggctggtcttgaactcctgacctcaggtgatccacccacctcggcctcccaaagtgctggaattacaggcgtgagccaccgcgcctggccccttcttct

SEQ ID NO: 92723 - DNA, 601 bp, Human
cattagattctacatgaagttactttgggcccctagaaaaagtaaggatattctaaaagtttgtcacagtaatgtcatgatcatttctggagaaaatattttgggggtagaatgatctttgaacctctgttgtagaaagaaacttaataggcaaactgaaatagaaaatatgagttgaaatcttagagggtatggagtgagttggttagagttctctcatttgtttcaaattattaatcagcagtggtttcagtgatgaaaccattgaatacagacaaaaataaaattcagagaaaaccaytcgttgaatctcacatgtttgtatctttcttttgcagaagaaacccaaactgctcaatctgaaggattcttctatggcagatgccagcaaacatggtggtggaacagaatcgttattttttgataaggtgagtaatggatgagttagatttgatagtgcctgttaatgccaaaagaaaatcatcttatccccctggaaggtttcgttttaaaggtgtcaggctaattaggactttctgttttttaacatagtttcccagttgtgagtcctttgagtctgctagtactattagcatagcta

SEQ ID NO: 92724 - DNA, 601 bp, Human
ccaggctggagtacagtggcattatcccagctcactgcaacgtctgcctccagggttcaagtgataatcttatgtttcactcagccacccaagtagctggaattacaggcgtgtgccaccatgcctggctaatttttgtatttttagtagagacggggtttcagcatgttggccagtctgggctcgaagtcctggcctccagtgatccacccaccttggcctcccaaagtgctgggattataggcatgagccaccacgcccagccacaaatttccccagtttttaaaaactaatggcaggrcagctgggcaatatatgacctcgtctctgcaaaaaatttagaaattagccaggcatggtggctcacacctgtagtcccagctacttgggaggctgaggatgggaggctgcagtgagctgagattacacaactgcgcctcctacctgggcgacagagcgaggcccttttcagttccccactttaagaaaaacaaaaactgtttttcttcccgttgtctccataaggtccgaaaggctcttcggagtgcagaagcctacgaaaatttcctacgctgtcttgttatttttaaccaggaggtga

SEQ ID NO: 92725 - DNA, 601 bp, Human
gaaaaatctctcccagagttctggaatttttttaaaaattattattattattttttttttgagatgaagtctcactcttgttccccaggctggagtgtgatggcatgatcttggctcactgcaacctccgcctcctgggttcaggtgattctcctgcctcggccccccaagtagctgggattacaggtgcctgtcaccacacgcccggctaatttttgttatgttttttagtagagacggtgttttaccatgttggccaggctggtccagaactcctgacctcaggtaatccacctgcctsggcctcccaaagtgctgggattacaggcatgagccactacaccgagtctggaatctttactatatttgacaacctaagaattatgtgaacattaaagcaatattcttgatcaaaagaatggcttgttattttgcctggtttcggtacaactctttgatcaccactttaactgatctgagagtattttattagaaaaaggggaaaccaaatgctcagaagcagttcttcttaggcaggaaataattcatccctggtagcagatttctgatccaaaaccagatggtagtagtcatacctcag

SEQ ID NO: 92726 - DNA, 601 bp, Human
ttgctgcacagttcacaaatacccagatttgatttgtcctccctcatcttcccctcaagagctggcacagattgatggtttcttctccctcatcttcccctcaagagctggcacagattgatggtttcttcttcttgcctgtagcatttaacttctggcttttgagatacaggttattcttcagttttagtgcttttttttgtcttagtctgttctcttctgggttattagaatcagttctgatcagaactttcctgactgtatccagaggaacataactgtgcaagttctcttgtcttgracttctgtgtttctattagcattgtgaacgttttgcaaagtcctatagcaaagaaacaagaactctttttttcaaggaatacttatacctgaaagatattccctggaatgctgtttttaagtaaccattctaggtaaattatttgactttgagataaatcatttcctcaaagtaagtcttggatgagtaattccctcatgaaacagagttcaagactggtttgatagcatcccaagttgccagtaattttgagagacctaatatagctttgcacctttctttaactaaagtaagcctggc

SEQ ID NO: 92727 - DNA, 601 bp, Human
atgagaatagttttgatctcacagatctcctgaaagggtcctgggaccctttggacaaagaactgctgtctacagaaatacttgtatacaaagattctcactgaagcaatattttgggctggttggttttttttttttttttttaagacagtgtctggctctgtgtcccaggctatagtacagtggtgggatcttggctttctgcaacctccgccttctgggctcaaacgatcttcccacctcagcctcccaagtagctgagactctaggcacacgtcaccacacctgcctaatttttttwttttttttgtagagaaggggtttttgccatgttgcccaggctagtctcaaactcctgagctcaagcaatccacctgcctcccaaagtgctgggattataggcatgagccacagtggccaacctgaagcagtgtttttaatagcaagttatgagaaacaatataattgtctagctgataacttttttcactggatgttgagatttagcaagcctaccacccctcagggcatccattcatgtgaattatcttctttcttgtgtatgtagaatggcactagtttatatcatctgggggaattt

SEQ ID NO: 92728 - DNA, 601 bp, Human
agttttgatctcacagatctcctgaaagggtcctgggaccctttggacaaagaactgctgtctacagaaatacttgtatacaaagattctcactgaagcaatattttgggctggttggttttttttttttttttttaagacagtgtctggctctgtgtcccaggctatagtacagtggtgggatcttggctttctgcaacctccgccttctgggctcaaacgatcttcccacctcagcctcccaagtagctgagactctaggcacacgtcaccacacctgcctaattttttttttttttttgtagagaaggggtttttgccatgttgcccaggctagtctcaaactcctgagctcaagcaatccacctgcctcccaaagtgctgggattataggcatgagccacagtggccaacctgaagcagtgtttttaatagcaagttatgagaaacaatataattgtctagctgataacttttttcactggatgttgagatttagcaagcctaccacccctcagggcatccattcatgtgaattatcttctttcttgtgtatgtagaatggcactagtttatatcatctgggggaatttttaaaaat

SEQ ID NO: 92729 - DNA, 601 bp, Human
aatgataggccatggtttgtaatttgtttgagatgcactgggacatttgacaaagatagcttggagttctgtgaggacagtggagatgggtatatataaagttggaagagcagagaccactcaaaagggtgcccttgtccaaatgagatgtgggggccacccgtactactagggtggcagtggaattgcaagaattacattgtagactttatgcatttatttttgagacagagtttcgctgtgtctcaaaccatgcctggctgattttttgtatttttagtagagatgggatttcaccatkttggccaggctggtctcgaacctgacctcaagtgatccaccctcctcagcctcccaaagtactgggattacaggcgtgagccaccacgcccagatgtagatattatttagatatttaattgacaagagatggtgttggatcaaatgtgggggtaagcaaaagaaggacatcaaggatggtgcctgattagttttggggttttttggtttgttttgttttgcttaagtggagattttaggggctcacctgttaataggaaagggttatgaggtttgggagacagatgaagtgctgttttaa

SEQ ID NO: 92730 - DNA, 601 bp, Human
gaagagcagagaccactcaaaagggtgcccttgtccaaatgagatgtgggggccacccgtactactagggtggcagtggaattgcaagaattacattgtagactttatgcatttatttttgagacagagtttcgctgtgtctcaaaccatgcctggctgattttttgtatttttagtagagatgggatttcaccatgttggccaggctggtctcgaacctgacctcaagtgatccaccctcctcagcctcccaaagtactgggattacaggcgtgagccaccacgcccagatgtagatatwatttagatatttaattgacaagagatggtgttggatcaaatgtgggggtaagcaaaagaaggacatcaaggatggtgcctgattagttttggggttttttggtttgttttgttttgcttaagtggagattttaggggctcacctgttaataggaaagggttatgaggtttgggagacagatgaagtgctgttttaagtttgaaaggactacaaaactttcaaatgggagatgttgagcagacagtttaatgtataattaaccctttaacgacaaggggtttggggcactggcccctgcac

SEQ ID NO: 92731 - DNA, 601 bp, Human
aggtttgggagacagatgaagtgctgttttaagtttgaaaggactacaaaactttcaaatgggagatgttgagcagacagtttaatgtataattaaccctttaacgacaaggggtttggggcactggcccctgcacagtcaaatctgtgtataatttttgactcccccaaaatggaactactgatagtctactactgactggaaggcttactgataaacaacatattttgtatgttgtatgtattatatatactgcattctttttttctttcttttttttttttttaatgaaaatagacayggggtctccttacgttgcccagggctggtctcaaactcaagggttcaaacaacccacccatttcagcctcctaaagtgctgggattacaggcgtgagccactgtgcccagcctatactgtatattcttacaataaagtaagttagagaaaagaaaatgttaagtcataagcaagagaagatacatttactcttcattaagtggttgtggctcatcataaagggtccttattctcatcttgttgagtaggctgaagagggaggaggaagggaggggttgtttttgctgtctcagggttggc

SEQ ID NO: 92732 - DNA, 601 bp, Human
gacaccaataaatttttattgaatgtgttggtgggaacagaaccccctgcagaacatctgccaagcctggactctgcttcccagggtggggtaacacagtggagggagagtggttttaagccctttgctttgcactgtctggcttagaggtggatctccatgctgatagaagtgatcaatggctcactgggtcctacccaggatacattagaatcagctggattgctggtttaaaatgcacattggtaaaccaaggaaatgtgggttttgggggttttgggttttttttttttttttttttggagacagggtttggctctgtcatctaggctggggtgcggtggtgcgatcttggctcactgcagcctccacctcctggctcaagcgatcctcccacttcagcctaccaagtagctgggactacaggtgtgtgccaccacgcccagttattatttgtatttttgtagagatggggttttgccatgttgcccaggctggtctcaaactcctgagctcaagcgaactgcctgcctcagcctcccagagtactaggattacaggcatgagtcactgcacctggtcagaaatgtgtattttttaa

SEQ ID NO: 92733 - DNA, 601 bp, Human
tattttttaacacattccctcggttatactaacgcatgctaaaattgagaacagcgagctttttcagcccagagcctgtgttcgcatttctttggaggctttatggattttcatgccctcacatgttctatgttcttacctctttaacttctctttaaacagagaatccttttttttttcttttaagaaaaaaacagtggtatctaagacttgagcccacatctttcctttgctcctttagaagaaaattaggctttgtatttgaagggctcttttttggttctgcttcatttaataaaawattttttttctgttttgcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgt

SEQ ID NO: 92734 - DNA, 601 bp, Human
attttttaacacattccctcggttatactaacgcatgctaaaattgagaacagcgagctttttcagcccagagcctgtgttcgcatttctttggaggctttatggattttcatgccctcacatgttctatgttcttacctctttaacttctctttaaacagagaatccttttttttttcttttaagaaaaaaacagtggtatctaagacttgagcccacatctttcctttgctcctttagaagaaaattaggctttgtatttgaagggctcttttttggttctgcttcatttaataaaaawttttttttctgttttgcagtcccatgagcgtgtaagcaagcgtctacatcagagattccaggcctgggtagataaatggaccaaggagcatgtgccccgtgaaatggcagcagagaccagcaagtggctcatgggtgaggggctggagggcctggtgccctgtaccaccacctgtgatacagagaccctgcattttgtgagcattaacaagtatcgtgtcaaatacggcacagtattcaaagccccttaactgcaaagccagagcagataacttggggtgtgtgtggggatgtgtgtgtg

SEQ ID NO: 92735 - DNA, 601 bp, Human
aggatttcaaggccagttcaggagaaagtcccaacccaccagtgcaaccaacaaaagagtaagttttacctacagcctgggttttcacaagtagcatttttattcctcctgctgtctgacatctgagctccaagctctaaacccaacctgtattatatgcagcagcaggttatctttgttttaaatcacatttgttattctgtacttagtcacctttccgtgtgatctgcatttgaaatgttgtaaacttggtcagtatttccattaaaatatcagggctaatcttgtgtattttttttttgttcctaatgattttatagacaaagactcttggcaaccccaggagaaaaaaaataaagctgtcagtggagtactagggatgagaatgaaactggaggtctgtttctggtattatggcttcccgggactctacagtcctgtatggtgaaatacatttttccattgggatcgtcaatgccatgactgttctgccacctcaaactccagagtttctggtgatgtgcaagagttagcaatatacattcagtaaagcgtgtaatcgagtaagtcgtagtaacttgggcgtaaagctctaccaccc

SEQ ID NO: 92736 - DNA, 601 bp, Human; identical to SEQ ID NO: 92696

SEQ ID NO: 92737 - DNA, 601 bp, Human; identical to SEQ ID NO: 22340

SEQ ID NO: 92738 - DNA, 601 bp, Human; identical to SEQ ID NO: 22339

SEQ ID NO: 92739 - DNA, 601 bp, Human; identical to SEQ ID NO: 22338

SEQ ID NO: 92740 - DNA, 601 bp, Human; identical to SEQ ID NO: 22337

SEQ ID NO: 92741 - DNA, 601 bp, Human; identical to SEQ ID NO: 22336

SEQ ID NO: 92742 - DNA, 601 bp, Human; identical to SEQ ID NO: 22335

SEQ ID NO: 92743 - DNA, 601 bp, Human; identical to SEQ ID NO: 22334

SEQ ID NO: 92744 - DNA, 601 bp, Human; identical to SEQ ID NO: 22333

SEQ ID NO: 92745 - DNA, 601 bp, Human; identical to SEQ ID NO: 22332

SEQ ID NO: 92746 - DNA, 601 bp, Human; identical to SEQ ID NO: 22331

SEQ ID NO: 92747 - DNA, 601 bp, Human; identical to SEQ ID NO: 22330

SEQ ID NO: 92748 - DNA, 601 bp, Human; identical to SEQ ID NO: 22329

SEQ ID NO: 92749 - DNA, 601 bp, Human; identical to SEQ ID NO: 22328

SEQ ID NO: 92750 - DNA, 601 bp, Human; identical to SEQ ID NO: 22327

SEQ ID NO: 92751 - DNA, 601 bp, Human; identical to SEQ ID NO: 22340

SEQ ID NO: 92752 - DNA, 601 bp, Human; identical to SEQ ID NO: 22339

SEQ ID NO: 92753 - DNA, 601 bp, Human; identical to SEQ ID NO: 22338

SEQ ID NO: 92754 - DNA, 601 bp, Human; identical to SEQ ID NO: 22337

SEQ ID NO: 92755 - DNA, 601 bp, Human; identical to SEQ ID NO: 22336

SEQ ID NO: 92756 - DNA, 601 bp, Human; identical to SEQ ID NO: 22335

SEQ ID NO: 92757 - DNA, 601 bp, Human; identical to SEQ ID NO: 22334

SEQ ID NO: 92758 - DNA, 601 bp, Human; identical to SEQ ID NO: 22333

SEQ ID NO: 92759 - DNA, 601 bp, Human; identical to SEQ ID NO: 22332

SEQ ID NO: 92760 - DNA, 601 bp, Human; identical to SEQ ID NO: 22331

SEQ ID NO: 92761 - DNA, 601 bp, Human; identical to SEQ ID NO: 22330

SEQ ID NO: 92762 - DNA, 601 bp, Human; identical to SEQ ID NO: 22329

SEQ ID NO: 92763 - DNA, 601 bp, Human; identical to SEQ ID NO: 22328

SEQ ID NO: 92764 - DNA, 601 bp, Human; identical to SEQ ID NO: 22327

SEQ ID NO: 92765 - DNA, 601 bp, Human; identical to SEQ ID NO: 22340

SEQ ID NO: 92766 - DNA, 601 bp, Human; identical to SEQ ID NO: 22339

SEQ ID NO: 92767 - DNA, 601 bp, Human; identical to SEQ ID NO: 22338

SEQ ID NO: 92768 - DNA, 601 bp, Human; identical to SEQ ID NO: 22337

SEQ ID NO: 92769 - DNA, 601 bp, Human; identical to SEQ ID NO: 22336

SEQ ID NO: 92770 - DNA, 601 bp, Human; identical to SEQ ID NO: 22335

SEQ ID NO: 92771 - DNA, 601 bp, Human; identical to SEQ ID NO: 22334

SEQ ID NO: 92772 - DNA, 601 bp, Human; identical to SEQ ID NO: 22333

SEQ ID NO: 92773 - DNA, 601 bp, Human; identical to SEQ ID NO: 22332

SEQ ID NO: 92774 - DNA, 601 bp, Human; identical to SEQ ID NO: 22331

SEQ ID NO: 92775 - DNA, 601 bp, Human; identical to SEQ ID NO: 22330

SEQ ID NO: 92776 - DNA, 601 bp, Human; identical to SEQ ID NO: 22329

SEQ ID NO: 92777 - DNA, 601 bp, Human; identical to SEQ ID NO: 22328

SEQ ID NO: 92778 - DNA, 601 bp, Human; identical to SEQ ID NO: 22327

SEQ ID NO: 92779 - DNA, 601 bp, Human; identical to SEQ ID NO: 22340

SEQ ID NO: 92780 - DNA, 601 bp, Human; identical to SEQ ID NO: 22339

SEQ ID NO: 92781 - DNA, 601 bp, Human; identical to SEQ ID NO: 22338

SEQ ID NO: 92782 - DNA, 601 bp, Human; identical to SEQ ID NO: 22337

SEQ ID NO: 92783 - DNA, 601 bp, Human; identical to SEQ ID NO: 22336

SEQ ID NO: 92784 - DNA, 601 bp, Human; identical to SEQ ID NO: 22335

SEQ ID NO: 92785 - DNA, 601 bp, Human; identical to SEQ ID NO: 22334

SEQ ID NO: 92786 - DNA, 601 bp, Human; identical to SEQ ID NO: 22333

SEQ ID NO: 92787 - DNA, 601 bp, Human; identical to SEQ ID NO: 22332

SEQ ID NO: 92788 - DNA, 601 bp, Human; identical to SEQ ID NO: 22331

SEQ ID NO: 92789 - DNA, 601 bp, Human; identical to SEQ ID NO: 22330

SEQ ID NO: 92790 - DNA, 601 bp, Human; identical to SEQ ID NO: 22329

SEQ ID NO: 92791 - DNA, 601 bp, Human; identical to SEQ ID NO: 22328

SEQ ID NO: 92792 - DNA, 601 bp, Human; identical to SEQ ID NO: 22327

SEQ ID NO: 92793 - DNA, 601 bp, Human
cagttcaaagacattcatgtgctcaaaggcattgggtcctagagcaacgttttccagatcttcgtgaccatgatgtactaaaagaaaaacattttatgttgccaggtgcagtggctcatgcctgtaatcccaacactttgggagactgagggggtggatcacaaggtcaggagtttgagaccagcctggccagcatggtgaaaccccatctctaataaaaatacaaaaattagccgggcatggtggtgggcgcctgtaatcccagctactcgggaggctgagacaggaggattgcttgaamctgggaggcagaggttgcagtgagctgagatcgtgccactgcactcctgcctgggtgacagagagtccatccccccccccccaaaaaaaaaagacagaaagaaagaaaaacattttatgtcatgatctagtgcagtcgcttctgcatgtatgtgcacacacacataaaattttataagacaattgatatccttactacattaagtgatttaattcttaccacaaccctatgagataagtattatcctagtttgcagatgagaaaacagggggacaaagaggctaactgcttgcctcaaat

SEQ ID NO: 92794 - DNA, 601 bp, Human
ccttagagatgttctagccccttgcttttcaatgtgtactccagggaccccagtatgagcatcgcctggaagcttgttaaaaattcagcatctcaggtcctactgcagatctgctgaaccagaatatgcactttagcaaaatttctaagtcagtcctgtgcatattgagtctaagaaatggacttagaatgaagacaatgcaagtctcaagtgcgataggaggattgagatcacctctgacaggtgctacattgcttcccccacacattcacacatacacgtgcatacacacatatacaaygcacacacacttttcacttacttgcttctgaggtgtcagtggctgcagttgtgatgaaccaagaggccaccaccaccatcagcatccaagtcagagatggctgccccatcctttctgctcttcccgctacttcaggtctagatagcacctgcccaaaggaaagacgggttggccctttgaatttttctctctgtctctgatgtctggtgtcctgtgaacagagatggatgggacaaatgcatgatctaactctcctccccacagctgggaaggagtgctttgattgtatagtatacaact

SEQ ID NO: 92795 - DNA, 601 bp, Human
cctccgtaataaaaataaccattaaaaaaaaaaagaagctgttgtttattaagcaattactatatgccaggcaataggatgtgcacttttcactcactatcttgttgaatacttcccaagggcctcgtgaggtcagttttttatgtatccttattttaaagatgaggagactgaggttcagagggattaagccccttactcctttggtaagaagtagaaccaggataaaaacgcagatggcaggaccacaaaatatgtgcttttaaccaggacaccgcaatagtattcatcgtgccccaaygtactccagggagaaaatgaaagtggggtgacagcaaatctcaacccaatggaatgacctcttaaagttgaaagggaaggtgtttggatcctcctgcatgggttcaaatctcctatgtgatagagtatgtttctgacttccaataaagggcctgcaggccttagagatgttctagccccttgcttttcaatgtgtactccagggaccccagtatgagcatcgcctggaagcttgttaaaaattcagcatctcaggtcctactgcagatctgctgaaccagaatatgcactttagcaaaat

SEQ ID NO: 92796 - DNA, 601 bp, Human
ctctctgcggagtcctccaactccacctggctgggcagttgtactttgttcctccgtaataaaaataaccattaaaaaaaaaaagaagctgttgtttattaagcaattactatatgccaggcaataggatgtgcacttttcactcactatcttgttgaatacttcccaagggcctcgtgaggtcagttttttatgtatccttattttaaagatgaggagactgaggttcagagggattaagccccttactcctttggtaagaagtagaaccaggataaaaacgcagatggcaggaccacaraatatgtgcttttaaccaggacaccgcaatagtattcatcgtgccccaacgtactccagggagaaaatgaaagtggggtgacagcaaatctcaacccaatggaatgacctcttaaagttgaaagggaaggtgtttggatcctcctgcatgggttcaaatctcctatgtgatagagtatgtttctgacttccaataaagggcctgcaggccttagagatgttctagccccttgcttttcaatgtgtactccagggaccccagtatgagcatcgcctggaagcttgttaaaaattcagcatc

SEQ ID NO: 92797 - DNA, 601 bp, Human
cccactggcctcaccagtgatgttgaagtcctgtttgcactggcagtgccatctgccattattcgatttgcagtcctcgtctatactgcactcctcacacgtcccctccacggagctggggtctgcagggtcacagggacagacagacaatcaataaggacgcacccccgtcctctgcagtgcctttccaggcctgggatgaggactgtggggagactccggctgacctgtgcagtacgccaggtgacactcggggggcgctgtcaggttgtagacgtagtagccgccggcacaggccttyacctggacggacgcatcccacaggcagcagtggccgctccagtgcgcgcaggccttgcggctcacgatgccctcgtcgctggacggatgcgtgccattgagccacatgggggcggccgtgttgcagcgcaggactggcacgcaggtctcggccatgcgcgcaccgccctggcccacgaagcggtaccagccgcgcaggtccgtgtcgcaggcgtagccctccccgtactcggtgctgcgccagtactcgtccagggtgcggtgcgcctggcacggatccgcgcacacgagcgcgtcgccc

SEQ ID NO: 92798 - DNA, 601 bp, Human
gctttgaagtcaactaaagggagactcagggagcctcagagagcctcttgccggctttaatgggtattagtggatcttctgttttcactcaggttggatatatatcccctgcgtcatacccatatggccccaatctcacaggggaggaatgtgtccctcccccaggcagtgacaggtttctcaacaacccgcttcctccccactggcctcaccagtgatgttgaagtcctgtttgcactggcagtgccatctgccattattcgatttgcagtcctcgtctatactgcactcctcacacgtyccctccacggagctggggtctgcagggtcacagggacagacagacaatcaataaggacgcacccccgtcctctgcagtgcctttccaggcctgggatgaggactgtggggagactccggctgacctgtgcagtacgccaggtgacactcggggggcgctgtcaggttgtagacgtagtagccgccggcacaggccttcacctggacggacgcatcccacaggcagcagtggccgctccagtgcgcgcaggccttgcggctcacgatgccctcgtcgctggacggatgcgtgccattgagc

SEQ ID NO: 92799 - DNA, 601 bp, Human
tgcaatgagccaagatcgtgccactgcactttagcctcggcgacagggagattccatctcaaaaaaaaaaaaaaaatcccacaacagttaaaaactccctgtgcagcctgaacaacgagccaattaatcatcttttctttataaattagaaaaaaaagttacaacagcaatgaccattcatgcgcatatgtcatgtgccagaccccgagtggaatacccctcctgagtcatagcattagttccttcagtgaccctaacaagtggcgctgccacatccctgcttcccagacaagaagacagrgattcatagtaacagagtcactgagggattgcccacaatatgtgacatctcacaagactagactgttttcagcaccccgtgcttcctctcttgaaaactgaaaaccatatgccaagtcaccatcaatggaatttcaaatgccatccttggaaaatgacatgaattatttctttttgtttgtttgttttgggacagagtctcactctgtcacccaggctggagtgcagtggtgcaatctcggctcactgcaacctctgcttcctgggttcaagtgattctcctgcctcagcctcccgagta

SEQ ID NO: 92800 - DNA, 601 bp, Human
gggtggagggggggtggggatgagagaaaggggcatgagaatctgagtaggacttcaaagctaaatctgctggtctcatgtctggctacttgtgagccgctctcctagtctccttgataaaaagctgcctgtggccgggcgcattagctcacgcttgtaatcccagcactttgggaggccgaggcaggcggatcacctgaggtcaggagttcgagaccagcctgtccaatatggtgaaaccctgtctctactaaaaatacaaaaagtagccgggcgtggtggtgggtgcctgtaatcccarctactcgggaggctgagacaggagaatcgcttgaacccgggaggcagagcttgcaatgagccaagatcgtgccactgcactttagcctcggcgacagggagattccatctcaaaaaaaaaaaaaaaatcccacaacagttaaaaactccctgtgcagcctgaacaacgagccaattaatcatcttttctttataaattagaaaaaaaagttacaacagcaatgaccattcatgcgcatatgtcatgtgccagaccccgagtggaatacccctcctgagtcatagcattagttccttcagt

SEQ ID NO: 92801 - DNA, 601 bp, Human
cattggctgtagggcggtcttcaggctgactttcatgtccagggggtaggagcatgcaaagttgattttgatgttgaggtcacggatgatgatctcatctgccaggtagagggtgttgctgtaagtggcatgggtttcattcctctgttgcagggaatgggggtggagggggggtggggatgagagaaaggggcatgagaatctgagtaggacttcaaagctaaatctgctggtctcatgtctggctacttgtgagccgctctcctagtctccttgataaaaagctgcctgtggccgggcrcattagctcacgcttgtaatcccagcactttgggaggccgaggcaggcggatcacctgaggtcaggagttcgagaccagcctgtccaatatggtgaaaccctgtctctactaaaaatacaaaaagtagccgggcgtggtggtgggtgcctgtaatcccaactactcgggaggctgagacaggagaatcgcttgaacccgggaggcagagcttgcaatgagccaagatcgtgccactgcactttagcctcggcgacagggagattccatctcaaaaaaaaaaaaaaaatcccacaacagtt

SEQ ID NO: 92802 - DNA, 601 bp, Human
ctctactaaaaatacaaaacttagctgggtgtggtggtgggcacctataatcctagctgcttgggaggctgaggcaggagaatcactggaacctgggaggcggaggttgaagtgagccaagatcatgccattgaactccagcctgggcgacagtacgagactccgtctcaataaataaataaataaataaataaataatcaataaatcttatttcttattacaactataattttccatcattggcctgtgattcatcctatttgaagattttcaattttatttagcaacagattccttttaaaaaaaataaaataaaatactacgtggcacccagtatgaatagtttacccctgtaggcactctgccagggcacctcccttggcccctaccaagacacttgcaaggagcgtaatttttaaaatcctctttaatcaaattcctttcattcacagagaaggaaagaagttgaggtccaaatatgaaatatgatttgcccagcattccatagcagtctggactgagaccattcctgctctctggcacaaccaccctgcctctttgaaaagtagagactttaatatttgattcacatctgaatca

SEQ ID NO: 92803 - DNA, 601 bp, Human
ctttacagctttgggtaagtcactcaaacttctgtgagcctcaatttccacatcagtataatgggaatagtaataataatgatacctttatctcctagggctgctgtaagagtttgatgagatgttccaggcagaacactggctataatgcctgagatatagtaagctctcaataaatcttagttcttggcagggcacggtggctcacacctataatcccagcactttgggaggccgaggtgggtggattgcctgaggtcaggagtttgagaccagcctggccaacatggtgaaaccccgyctctactaaaaatacaaaacttagctgggtgtggtggtgggcacctataatcctagctgcttgggaggctgaggcaggagaatcactggaacctgggaggcggaggttgaagtgagccaagatcatgccattgaactccagcctgggcgacagtacgagactccgtctcaataaataaataaataaataaataaataatcaataaatcttatttcttattacaactataattttccatcattggcctgtgattcatcctatttgaagattttcaattttatttagcaacagattcctttt

SEQ ID NO: 92804 - DNA, 601 bp, Human
gactttacagctttgggtaagtcactcaaacttctgtgagcctcaatttccacatcagtataatgggaatagtaataataatgatacctttatctcctagggctgctgtaagagtttgatgagatgttccaggcagaacactggctataatgcctgagatatagtaagctctcaataaatcttagttcttggcagggcacggtggctcacacctataatcccagcactttgggaggccgaggtgggtggattgcctgaggtcaggagtttgagaccagcctggccaacatggtgaaacccygcctctactaaaaatacaaaacttagctgggtgtggtggtgggcacctataatcctagctgcttgggaggctgaggcaggagaatcactggaacctgggaggcggaggttgaagtgagccaagatcatgccattgaactccagcctgggcgacagtacgagactccgtctcaataaataaataaataaataaataaataatcaataaatcttatttcttattacaactataattttccatcattggcctgtgattcatcctatttgaagattttcaattttatttagcaacagattcctt

SEQ ID NO: 92805 - DNA, 601 bp, Human
caggtcaacttgggatctagataaaatgcaggctctgatttggtgagtattggggtggggctcaaggtcctgcatttctgacaagtgcctggatgctgctgatgctgctggtctatggatcaatcacatctcaagtaacacatccagtccctcacttgctactgctataggctttgctacccctgtagctttcaagatggcaaaaaaacaaattattgacaggaacacctggattccttctttggtctcaatctagaacaggttaaaaggtattgagctatgatgaggcctacaacttgcrtcctggcctccatcgtgatgtactaacatctatatcagaagattgaggtttataaatgagttatttttaaccacactgaaaacagccacactgatgtgaacttcactggatgatccaacaaaggacattgtaaggctgatgcctcatgaaataaggcacatgagaaatactccgaaatgtggaagtccattttacagatgagaactgagttatcagtgaagactggggtgagatgtctaactcgagacagagagagggaccaggtgctgtggctcacgcctgtaatcccaatactttagg

SEQ ID NO: 92806 - DNA, 601 bp, Human
tgcagttatttgcatttttatccagcaataagagtggaacccaccaactgttgctttgcaaaccgcaataagtacacgcaggtcaacttgggatctagataaaatgcaggctctgatttggtgagtattggggtggggctcaaggtcctgcatttctgacaagtgcctggatgctgctgatgctgctggtctatggatcaatcacatctcaagtaacacatccagtccctcacttgctactgctataggctttgctacccctgtagctttcaagatggcaaaaaaacaaattattgacagraacacctggattccttctttggtctcaatctagaacaggttaaaaggtattgagctatgatgaggcctacaacttgcgtcctggcctccatcgtgatgtactaacatctatatcagaagattgaggtttataaatgagttatttttaaccacactgaaaacagccacactgatgtgaacttcactggatgatccaacaaaggacattgtaaggctgatgcctcatgaaataaggcacatgagaaatactccgaaatgtggaagtccattttacagatgagaactgagttatcagtgaaga

SEQ ID NO: 92807 - DNA, 601 bp, Human
ttgcattcctaggcagtcccttgcagttatttgcatttttatccagcaataagagtggaacccaccaactgttgctttgcaaaccgcaataagtacacgcaggtcaacttgggatctagataaaatgcaggctctgatttggtgagtattggggtggggctcaaggtcctgcatttctgacaagtgcctggatgctgctgatgctgctggtctatggatcaatcacatctcaagtaacacatccagtccctcacttgctactgctataggctttgctacccctgtagctttcaagatggcaaaaaaacaaattattgacaggaacacctggattccttctttggtctcaatctagaacaggttaaaaggtattgagctatgatgaggcctacaacttgcgtcctggcctccatcgtgatgtactaacatctatatcagaagattgaggtttataaatgagttatttttaaccacactgaaaacagccacactgatgtgaacttcactggatgatccaacaaaggacattgtaaggctgatgcctcatgaaataaggcacatgagaaatactccgaaatgtggaagtccattttacagatga

SEQ ID NO: 92808 - DNA, 601 bp, Human
tactgggtgtggcatagcagttggtcatgagcagtgcaaatcgggacaggtcgcccccatccaacatggtgcccacgtagagaaaagcctcagtggacagtgtcacggaggagccttggtagggctgcgtgtaggaaggggtctggaagagcgccatccgcacggtgaacatgccggtcccgcccactctgatgtttagagcactgccaggggagaagggttggtgagaggaccgggctgagaacatctgcagataggccaccttctctgatttgcattcctaggcagtcccttgcagttrtttgcatttttatccagcaataagagtggaacccaccaactgttgctttgcaaaccgcaataagtacacgcaggtcaacttgggatctagataaaatgcaggctctgatttggtgagtattggggtggggctcaaggtcctgcatttctgacaagtgcctggatgctgctgatgctgctggtctatggatcaatcacatctcaagtaacacatccagtccctcacttgctactgctataggctttgctacccctgtagctttcaagatggcaaaaaaacaaattattgacaggaacacct

SEQ ID NO: 92809 - DNA, 515 bp, Human
tggcccttggctaaccatgcccatgtcttactcctcccccaggtgctgggctgcctgctgccctgggcaagcctttccatcaagtttcttaccattttttgaattataaaccctactcagctctctggtgaagcttgtacatccctcctcagaaataatacttttaaatgcctaaaataaaatatttaaaagattataaaggaaatcaattaaattgaagcaccattctcaaaatattaaaaacatttgctagctgtgtatggtggtgtgtgcctgtagtcccagctactcatgaggctaragctggaggatcgcttgagcctgggtggttgaggctgccgtgagctatgatcaagtcactgtattccggcctgggtgacagaatgagaccctgtctcaaaaaaaccaaaccaaatcaaacgaccaaaaaaaaagacatttgaaatacaaaaatgcattatatctttgtgtgtgtgtgtgtatatatatgtgtgtgtgtgtatatatatatatat

SEQ ID NO: 92810 - DNA, 601 bp, Human
ttggtgtaaccaggcagaaacagaccactgtctctcaggaatgctttttctgacaatgcaattaaaattgcaaatgtctttcttctcctgctttgtttcttctacaacctctttgtcattaacatactatatatttcactttcatttaatagttggccctccccctttagaatataagctgtgtgagggcagaggtttttgttccttctatttactgtgaaatccacagagcccgacacacagcaagcttccaaaatatcttttcaacttatgaacgagaaagtgaatcaccgtctcatgrtaaggttcatagtcatctagtgcctcttgagtaaaaggtagcacacttgtgtcctagtttcaattggcccttggctaaccatgcccatgtcttactcctcccccaggtgctgggctgcctgctgccctgggcaagcctttccatcaagtttcttaccattttttgaattataaaccctactcagctctctggtgaagcttgtacatccctcctcagaaataatacttttaaatgcctaaaataaaatatttaaaagattataaaggaaatcaattaaattgaagcaccattctcaaaata

SEQ ID NO: 92811 - DNA, 601 bp, Human
tgccttgggggctagactgcctttgtagaactaagaaattagctacaagattagaaattaaggtttaggagtcatgcagctggaagccacaagattctgacccttcctaaaccactcctaagatcagtgcttgagatattttgtagaccctgcacttaatggatcacccagatcctacacatctacaggggattattcaaatggcaccttcttcactgattcacaagctccatgggagcagggccatctacttctgctcatcacaagacctccagacacagagtaggcacacatctactayaaatatgaatgtatgtttgtggcctcatgtgtgtgcaaacttgtctggatgatctacattcctacctgcctgtctggcctcccccgtgtcctgtgttacattcatctacaaatcatatttgtccaatgaatgggtgtatgaatgggaatagtgaaaggaaggcagtctgtattccaccttgccccagaggatccacttgctcccagttcttcagagctcagtaaggtgccaaggtgccaggctctgttatccctcttcctctccagaaatctttcccagccaggaatgttgaggagcgag

SEQ ID NO: 92812 - DNA, 601 bp, Human
atgacctttgcaaaattatgactgagacagtgaaagagagccaacctagccaaccccatcttggttctaacttttaagctgtgcttgttccttcctgggtgtaggctgaactaatttggaaggaacttagtttatagtttaaaacaaagacgataacagccctttccaaaaacaaacctccttcttgccttgggggctagactgcctttgtagaactaagaaattagctacaagattagaaattaaggtttaggagtcatgcagctggaagccacaagattctgacccttcctaaaccackcctaagatcagtgcttgagatattttgtagaccctgcacttaatggatcacccagatcctacacatctacaggggattattcaaatggcaccttcttcactgattcacaagctccatgggagcagggccatctacttctgctcatcacaagacctccagacacagagtaggcacacatctactacaaatatgaatgtatgtttgtggcctcatgtgtgtgcaaacttgtctggatgatctacattcctacctgcctgtctggcctcccccgtgtcctgtgttacattcatctacaaatca

SEQ ID NO: 92813 - DNA, 601 bp, Human
cagaaggatcagtgaataaagaatgcatgagatttggcaagcatcctgacagaaaccccttcaatctacttttcacttcgcagccagactgatctcttcaaaacccaaatctgatcatgttactcccctacttcagacccatcaggggctctcactgctttcaggagaaaggtcccaacccttagcaagaactgcaaggctccacaaggtctgcagcagctcatcccacacaactcccctggccttctctgggttcctttaacaggccaggctccctcctgccacaggccctttgcccaarctgtactcttgaaatgacctttgcaaaattatgactgagacagtgaaagagagccaacctagccaaccccatcttggttctaacttttaagctgtgcttgttccttcctgggtgtaggctgaactaatttggaaggaacttagtttatagtttaaaacaaagacgataacagccctttccaaaaacaaacctccttcttgccttgggggctagactgcctttgtagaactaagaaattagctacaagattagaaattaaggtttaggagtcatgcagctggaagccacaagattctgacc

SEQ ID NO: 92814 - DNA, 601 bp, Human
actgcactccagcctgggtgacagagcagattccatctcaaaaaaaaaaaaaaaaaaaaaaagccaagttagtgtaagaacctccttggatccaggtaccagtagctgttgcatagatttgcttttcacctagatttttagacaattcagtgccatgaaaaccatgggccataaaaatgccacctgtccctggcctttgtggtcagaaaaagcaaagaagcagagaagtgggggttcttgtttggccgttgtgtttgccccagcactaagcatggttcttggcatatagtattactcaacraatattcatcacctattgaatgaatctagaaaaaggtgttagagaggagccttggagcttcaggaagtgcccaatatacagatctggggtatgttcatatcctttgggtacaggtttccaataagtgtgtgtacatctgcacacacaaatatgcatgcagacaattgcagctttctgtgcatctgtacatgcaaatataaatgcatgtacgtgaccttgtgtgtgtgggtaaacatgtctggatgacctacattctcatgtgattatctgggcatgcctgtgtctgtgtgcacatatgta

SEQ ID NO: 92815 - DNA, 601 bp, Human
tccaggaggcagcccgagtccctggggagagggtcatcgtggctctcgtcggtgccttccacctctggacaggcaaccggtgggagaggacgccggtgggcggggggaggaggcggccctagcgccattttgtgggagcgaagcggtggctgggctgcgcttgggtccgtcgctgcttcggtgtccctgtcgggcttcccagcagcggcctagcgggtgagtcgcggagccttctcactgaggacgccgtaggtgcctcggcttctgcattggggcggcccgaggcagacgcagcggcttyggaccctgccccgggaagtcagccgtgagaccgggcctagtcctgcccgagcgggctcgcgcgggagcgtcgttaggtcctggcacggggaggccggtggcgccgaaacggggggccgggcccgcggtgccgcgtagcctgaggcggaggttggccccggacccggacagtgccggagccttcggtactttgtacttcgagggacgctgccagcttgggcctggtgctcctgcgccccaccccgggccgcgccgagaaactcctccctcggctggcacgcgcgggcttctgggaggcgac

SEQ ID NO: 92816 - DNA, 601 bp, Human; identical to SEQ ID NO: 74209

SEQ ID NO: 92817 - DNA, 601 bp, Human; identical to SEQ ID NO: 74210

SEQ ID NO: 92818 - DNA, 601 bp, Human; identical to SEQ ID NO: 74211

SEQ ID NO: 92819 - DNA, 601 bp, Human; identical to SEQ ID NO: 74212

SEQ ID NO: 92820 - DNA, 601 bp, Human; identical to SEQ ID NO: 74213

SEQ ID NO: 92821 - DNA, 601 bp, Human; identical to SEQ ID NO: 74214

SEQ ID NO: 92822 - DNA, 601 bp, Human; identical to SEQ ID NO: 74215

SEQ ID NO: 92823 - DNA, 601 bp, Human; identical to SEQ ID NO: 74216

SEQ ID NO: 92824 - DNA, 601 bp, Human; identical to SEQ ID NO: 74217

SEQ ID NO: 92825 - DNA, 601 bp, Human; identical to SEQ ID NO: 74218

SEQ ID NO: 92826 - DNA, 601 bp, Human; identical to SEQ ID NO: 74219

SEQ ID NO: 92827 - DNA, 601 bp, Human; identical to SEQ ID NO: 74220

SEQ ID NO: 92828 - DNA, 601 bp, Human; identical to SEQ ID NO: 74221

SEQ ID NO: 92829 - DNA, 601 bp, Human; identical to SEQ ID NO: 74222

SEQ ID NO: 92830 - DNA, 601 bp, Human; identical to SEQ ID NO: 74223

SEQ ID NO: 92831 - DNA, 601 bp, Human; identical to SEQ ID NO: 74224

SEQ ID NO: 92832 - DNA, 601 bp, Human; identical to SEQ ID NO: 74225

SEQ ID NO: 92833 - DNA, 601 bp, Human; identical to SEQ ID NO: 74226

SEQ ID NO: 92834 - DNA, 601 bp, Human; identical to SEQ ID NO: 74227

SEQ ID NO: 92835 - DNA, 601 bp, Human; identical to SEQ ID NO: 74228

SEQ ID NO: 92836 - DNA, 601 bp, Human; identical to SEQ ID NO: 74209

SEQ ID NO: 92837 - DNA, 601 bp, Human; identical to SEQ ID NO: 74210

SEQ ID NO: 92838 - DNA, 601 bp, Human; identical to SEQ ID NO: 74211

SEQ ID NO: 92839 - DNA, 601 bp, Human; identical to SEQ ID NO: 74212

SEQ ID NO: 92840 - DNA, 601 bp, Human; identical to SEQ ID NO: 74213

SEQ ID NO: 92841 - DNA, 601 bp, Human; identical to SEQ ID NO: 74214

SEQ ID NO: 92842 - DNA, 601 bp, Human; identical to SEQ ID NO: 74215

SEQ ID NO: 92843 - DNA, 601 bp, Human; identical to SEQ ID NO: 74216

SEQ ID NO: 92844 - DNA, 601 bp, Human; identical to SEQ ID NO: 74217

SEQ ID NO: 92845 - DNA, 601 bp, Human; identical to SEQ ID NO: 74218

SEQ ID NO: 92846 - DNA, 601 bp, Human; identical to SEQ ID NO: 74219

SEQ ID NO: 92847 - DNA, 601 bp, Human; identical to SEQ ID NO: 74220

SEQ ID NO: 92848 - DNA, 601 bp, Human; identical to SEQ ID NO: 74221

SEQ ID NO: 92849 - DNA, 601 bp, Human; identical to SEQ ID NO: 74222

SEQ ID NO: 92850 - DNA, 601 bp, Human; identical to SEQ ID NO: 74223

SEQ ID NO: 92851 - DNA, 601 bp, Human; identical to SEQ ID NO: 74224

SEQ ID NO: 92852 - DNA, 601 bp, Human; identical to SEQ ID NO: 74225

SEQ ID NO: 92853 - DNA, 601 bp, Human; identical to SEQ ID NO: 74226

SEQ ID NO: 92854 - DNA, 601 bp, Human; identical to SEQ ID NO: 74227

SEQ ID NO: 92855 - DNA, 601 bp, Human; identical to SEQ ID NO: 74228

SEQ ID NO: 92856 - DNA, 601 bp, Human; identical to SEQ ID NO: 74209

SEQ ID NO: 92857 - DNA, 601 bp, Human; identical to SEQ ID NO: 74210

SEQ ID NO: 92858 - DNA, 601 bp, Human; identical to SEQ ID NO: 74211

SEQ ID NO: 92859 - DNA, 601 bp, Human; identical to SEQ ID NO: 74212

SEQ ID NO: 92860 - DNA, 601 bp, Human; identical to SEQ ID NO: 74213

SEQ ID NO: 92861 - DNA, 601 bp, Human; identical to SEQ ID NO: 74214

SEQ ID NO: 92862 - DNA, 601 bp, Human; identical to SEQ ID NO: 74215

SEQ ID NO: 92863 - DNA, 601 bp, Human; identical to SEQ ID NO: 74216

SEQ ID NO: 92864 - DNA, 601 bp, Human; identical to SEQ ID NO: 74217

SEQ ID NO: 92865 - DNA, 601 bp, Human; identical to SEQ ID NO: 74218

SEQ ID NO: 92866 - DNA, 601 bp, Human; identical to SEQ ID NO: 74219

SEQ ID NO: 92867 - DNA, 601 bp, Human; identical to SEQ ID NO: 74220

SEQ ID NO: 92868 - DNA, 601 bp, Human; identical to SEQ ID NO: 74221

SEQ ID NO: 92869 - DNA, 601 bp, Human; identical to SEQ ID NO: 74222

SEQ ID NO: 92870 - DNA, 601 bp, Human; identical to SEQ ID NO: 74223

SEQ ID NO: 92871 - DNA, 601 bp, Human; identical to SEQ ID NO: 74224

SEQ ID NO: 92872 - DNA, 601 bp, Human; identical to SEQ ID NO: 74225

SEQ ID NO: 92873 - DNA, 601 bp, Human; identical to SEQ ID NO: 74226

SEQ ID NO: 92874 - DNA, 601 bp, Human; identical to SEQ ID NO: 74227

SEQ ID NO: 92875 - DNA, 601 bp, Human; identical to SEQ ID NO: 74228

SEQ ID NO: 92876 - DNA, 601 bp, Human; identical to SEQ ID NO: 74209

SEQ ID NO: 92877 - DNA, 601 bp, Human; identical to SEQ ID NO: 74210

SEQ ID NO: 92878 - DNA, 601 bp, Human; identical to SEQ ID NO: 74211

SEQ ID NO: 92879 - DNA, 601 bp, Human; identical to SEQ ID NO: 74212

SEQ ID NO: 92880 - DNA, 601 bp, Human; identical to SEQ ID NO: 74213

SEQ ID NO: 92881 - DNA, 601 bp, Human; identical to SEQ ID NO: 74214

SEQ ID NO: 92882 - DNA, 601 bp, Human; identical to SEQ ID NO: 74215

SEQ ID NO: 92883 - DNA, 601 bp, Human; identical to SEQ ID NO: 74216

SEQ ID NO: 92884 - DNA, 601 bp, Human; identical to SEQ ID NO: 74217

SEQ ID NO: 92885 - DNA, 601 bp, Human; identical to SEQ ID NO: 74218

SEQ ID NO: 92886 - DNA, 601 bp, Human; identical to SEQ ID NO: 74219

SEQ ID NO: 92887 - DNA, 601 bp, Human; identical to SEQ ID NO: 74220

SEQ ID NO: 92888 - DNA, 601 bp, Human; identical to SEQ ID NO: 74221

SEQ ID NO: 92889 - DNA, 601 bp, Human; identical to SEQ ID NO: 74222

SEQ ID NO: 92890 - DNA, 601 bp, Human; identical to SEQ ID NO: 74223

SEQ ID NO: 92891 - DNA, 601 bp, Human; identical to SEQ ID NO: 74224

SEQ ID NO: 92892 - DNA, 601 bp, Human; identical to SEQ ID NO: 74225

SEQ ID NO: 92893 - DNA, 601 bp, Human; identical to SEQ ID NO: 74226

SEQ ID NO: 92894 - DNA, 601 bp, Human; identical to SEQ ID NO: 74227

SEQ ID NO: 92895 - DNA, 601 bp, Human; identical to SEQ ID NO: 74228

SEQ ID NO: 92896 - DNA, 601 bp, Human
aataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaaactaaatgctagctgtagagtgtttactgtgtgccaagaactttacaaataagaactcctgaggtgggcatatcacttgaggtcaggagtttgagaccagcctggctaacatggtgaaaccccatctctamtaaaaaaaaaaaaaaaaaaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaaaaacaacaacaaacaaacaaacaaacaaaataagaactcagcgaattctcctgactaccctttgagatggttattattatcctactttagagatgagcaattgaaggcataactcacccag

SEQ ID NO: 92897 - DNA, 601 bp, Human
ataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaaactaaatgctagctgtagagtgtttactgtgtgccaagaactttacaaataagaactcctgaggtgggcatatcacttgaggtcaggagtttgagaccagcctggctaacatggtgaaaccccatctctacwaaaaaaaaaaaaaaaaaaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaaaaacaacaacaaacaaacaaacaaacaaaataagaactcagcgaattctcctgactaccctttgagatggttattattatcctactttagagatgagcaattgaaggcataactcacccaga

SEQ ID NO: 92898 - DNA, 601 bp, Human
agctgtagagtgtttactgtgtgccaagaactttacaaataagaactcctgaggtgggcatatcacttgaggtcaggagtttgagaccagcctggctaacatggtgaaaccccatctctactaaaaaaaaaaaaaaaaaaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaamaacaacaacaaacaaacaaacaaacaaaataagaactcagcgaattctcctgactaccctttgagatggttattattatcctactttagagatgagcaattgaaggcataactcacccagagtcacaagctagtaaattgtagaaccagaattccaacccaggtagtctcactttagcctagcctcttgactactgtgctgtactaactcccaatggtatatactatcaagttctgtctagtaatatttatgtatgcatgttttacatcagtagtctagattttcatctataaatagtat

SEQ ID NO: 92899 - DNA, 601 bp, Human
aaaaaaaaaaaagccaggcatggtggcatacacctgtaataccaactactcgcgatgctgaggcaggagaatcccttgaatctgggagacagaggttgtggtgagccaagatcactctactgaactccagcctgggtgacagagtgagactctgtctcaaaaaaacaacaacaaacaaacaaacaaacaaaataagaactcagcgaattctcctgactaccctttgagatggttattattatcctactttagagatgagcaattgaaggcataactcacccagagtcacaagctagtaaaytgtagaaccagaattccaacccaggtagtctcactttagcctagcctcttgactactgtgctgtactaactcccaatggtatatactatcaagttctgtctagtaatatttatgtatgcatgttttacatcagtagtctagattttcatctataaatagtatttaaaaacttggcccagagtgaggggaatttaagtaattggtgtgatataatttaatttttttatagaacgtacgttttccaaatttaaatttttttttttgggggaaacaaggttggaaaacctgcacttgggtatt

SEQ ID NO: 92900 - DNA, 601 bp, Human
gaaggcataactcacccagagtcacaagctagtaaattgtagaaccagaattccaacccaggtagtctcactttagcctagcctcttgactactgtgctgtactaactcccaatggtatatactatcaagttctgtctagtaatatttatgtatgcatgttttacatcagtagtctagattttcatctataaatagtatttaaaaacttggcccagagtgaggggaatttaagtaattggtgtgatataatttaatttttttatagaacgtacgttttccaaatttaaatttttttttttkggggaaacaaggttggaaaacctgcacttgggtattattattattatttattattattatttttttgagatggagtctttgctctgtcgcccaggttggagtgcagtggcacgatctcggctcactgcaagctccacctcctgggttcacgccattctcctgcctcagcctcctgagtagctgggactacaggcgactgccaccacgcccggctaattttttttggattttttagtagaaacagggtttcaccatattagccaggatggtctcgatctcctgatctcgtgatccgcctgc

SEQ ID NO: 92901 - DNA, 601 bp, Human
acagtgctagtctttcttgcaacctctttttaaatttaatacgatgattgcctgacaatgggaaaagggtcctggctaattaattaatgttataatacatggccattaaatgatgtttctggtaaccccataattaacatgtgacactcttaataaaataagtaaataaaaattatgctgttacaattatattcaaagtaacttgtgttacaaaaatcctgaacaaaagtatacatcactgattttctatttttcaattctatttttgtattttccatctttaaagaacatggtttatatattttttttaaataaaattgtttgccattagtaagttcaaattcgaaggctaggattcctttttgaagtgcctgggaaaaaaattcagctgcagagaaaaggcaccatttgttgtacattctataatgaaaactattcattttggcaaatgaaaaactaagatagaaatgaaactgaatgaatcattctagaaatagagaaatataagattatagaaaaatcatagataaaacaggaaaaataagagtataaacaaattggaaaaatagataaatataaacaatagatttaacaattttaa

SEQ ID NO: 92902 - DNA, 601 bp, Human
ctgtcttaacagtcagtaagaacatttgaggccgggctcggtggctcacgcctgtaatcccagcactttgggaggccgaggtgggcggatcacgaggtcaggagatcgagatcatcctggccaacatggtgaaaccccgtctctactaaaaaaatacaaaaaaattagctgggcgtggtgggcgggcacctgtagtcccctgaggcaggagaatggcttgaacccggaaggtggagctttcagggagcggagatggcgcctctgcactccagcctgggcgacagagtgagactcggtctcaaaaaaaaaaaaaaaaaaaagaacgtttgaaattggcatttatactttgggccctaataagattacaccattgttcagatggtataaaaagaatagtttgtgtaggattctttactaagcagcttccataaagtaatgagacaaattttataaactacatacaaaaattcataaagaatatgattatgactcttttggggaagattttaatactcaaaattagcaaatcattgcctggctttggtgagtgtctttaacatttagaggaagtgatggctgatcaaaacacctatgttggcct

SEQ ID NO: 92903 - DNA, 601 bp, Human
aacctatacttgcacatatacatgaaaaatatatggttggctatattatggaataatataggaatctataaaagaacaaaaaatttattacctttatacccagttttaaaaatactgtgttcccttttagaaggttgtggtgcttgaacgacaacaaaaaggtaaagagtacgcactgtatagacccatttatgtgaagttctttaaaagacaaacctatggtaagaaaaagcagatcagtagttgcctggggctggagtgggcaggattaactacaaaggaccaaaagtagctttacggratgattgaaatgttctctgtcttgaccatgtgattacacaaacatacatactttttaaaaaaactcatagaacatttaaaatgggtgcatttctatacttctataaaggacacgggttatatatattctgccactgcactccagcctgggcaacagaagaaacagtattaatgtaagctatatgaatagtgatattttgctattttgggaagctgaggtgggaggatcacttgaacccaggaggtagaggatgcagtgagcagagatcgtgccactgccctccagcctgggtgacagtga

SEQ ID NO: 92904 - DNA, 601 bp, Human
gaataatataggaatctataaaagaacaaaaaatttattacctttatacccagttttaaaaatactgtgttcccttttagaaggttgtggtgcttgaacgacaacaaaaaggtaaagagtacgcactgtatagacccatttatgtgaagttctttaaaagacaaacctatggtaagaaaaagcagatcagtagttgcctggggctggagtgggcaggattaactacaaaggaccaaaagtagctttacggaatgattgaaatgttctctgtcttgaccatgtgattacacaaacatacatrctttttaaaaaaactcatagaacatttaaaatgggtgcatttctatacttctataaaggacacgggttatatatattctgccactgcactccagcctgggcaacagaagaaacagtattaatgtaagctatatgaatagtgatattttgctattttgggaagctgaggtgggaggatcacttgaacccaggaggtagaggatgcagtgagcagagatcgtgccactgccctccagcctgggtgacagtgagaccctgtgtcaaaaaaaaatttttttttttacctgtactgaacatgtac

SEQ ID NO: 92905 - DNA, 601 bp, Human
aagtaaataaataaaataaaataaaattgggttgtcgtcttattcttgaattgtaagggggtagtgtcatttgatgcacaaatattttaattttggtaaaagccaatttattttttctttgttgctcatgctttggtgtcatattttaaaaactattgcctagcccagggtcacagaggtatacctatgtttttttctaagaactttataatcttagctcttacatttaggtatttgatccattttgagctaaatttgtatattgtgtgaggtaagagcctaacagcttcattgttttgcrtgtgcatatctagttgcctgagcactatttgttgaaaagacttgtttcccccattgaatggtcttggcactcttgtcaaaaattaattgggcatagatgtatggctttttttttttttcttctggactctcagttctattccatttatctgtatgtctatcctgtgtcaataccatattgtgttattactgtagctttgtagaagttttgaaattaggaagcgtgagccttccaactttttttcttcttttgtaggattgtttcggctatttaatgtctcttgaatttttatataaattt

SEQ ID NO: 92906 - DNA, 601 bp, Human
tgagctatgattgtaccactgcactccagtctgggtgacagagtaagaccctgtctcaaaaataaaatttattttggtggtggatgcacagctgtgactctgctgaaagccactgaattgtgtgctttaagtaggtaaattgtatgatatgtgaattatatctcaataaaatatgtatatatatacatgtatatatattcacaaatataaatgtattggaagggtttaaacagatggcaagtgctgtcaaaacagagtagaatttatgtttttattttttattttttgaggtggagtctcrctctgtcgccatgctggagtgcagtggcatgatctcagttcactgcaacctctgcctcccgggttgaagcgattctcctgcctcagcctccctagtagctgggactacaggcagatgccaccacgcccagctaattattattatttttttttgtatttttagtagagatggggtttcaccatgttggccaggatggtcttgatcccctgacctcatgatccacctgcctcggcctcccaaagtgctgggattactggtgtgagccacggcgcccagcccaatttttttttttttaattgt

SEQ ID NO: 92907 - DNA, 601 bp, Human
tgaattatatctcaataaaatatgtatatatatacatgtatatatattcacaaatataaatgtattggaagggtttaaacagatggcaagtgctgtcaaaacagagtagaatttatgtttttattttttattttttgaggtggagtctcgctctgtcgccatgctggagtgcagtggcatgatctcagttcactgcaacctctgcctcccgggttgaagcgattctcctgcctcagcctccctagtagctgggactacaggcagatgccaccacgcccagctaattattattatttttttktgtatttttagtagagatggggtttcaccatgttggccaggatggtcttgatcccctgacctcatgatccacctgcctcggcctcccaaagtgctgggattactggtgtgagccacggcgcccagcccaatttttttttttttaattgtgtggggctgtctctcataaaagtagttttcttcatgcattgctggtggtaatgtaaaatggtgcagctgttgtgaaaaacaggtggttcccccaaaaaagttaaacatagaattatatgatccagcaatttcacttataggtatatacccc

SEQ ID NO: 92908 - DNA, 601 bp, Human
attttaggtataaattaggcactttggtaatttatagtgctttcttttttttttttttttttttttttttgggacagagtctcactctattgcccaggctggagtgcagtggtatgattccggcttactgcaacctctgcctcccaggttcaagcgattctcctgcctcagccccctgggtagctggaattacaggtgcacaccactatgcctggcccgtttttgtgtttttagtagacacaggtttcaccatgttggccaggctggtctccagttgctgacctcgtgatccacctgcctyggcctcccaaagtgctggaattacaggcctgagcctctgcacctggccgcatgattagtgctttcaccaagtaataatttcctgatagataacctgactagcatattagcttaatatcttttctaattataaaaaccaactaactcctgagaatacttaagacaaggtctgtaatcagggttgcctgtatttggtgaaattaatgggctgtttggggtgccaagcttcaaaagagagatgattgctaatcctaaaatataaaggtaacctagagccagaaagatagctactgagtaattg

SEQ ID NO: 92909 - DNA, 601 bp, Human
taatatcttttctaattataaaaaccaactaactcctgagaatacttaagacaaggtctgtaatcagggttgcctgtatttggtgaaattaatgggctgtttggggtgccaagcttcaaaagagagatgattgctaatcctaaaatataaaggtaacctagagccagaaagatagctactgagtaattgtgttctcaccacacttatttgtgtgtaaatttaaaagtgcatttcctctcaaatttagatatgtcttgttctgctatttttctgtactagaaagtacttcttcagattgctrggctacttaccagaatcatcaactactaactagtaaagaaacaaactgtgttttgggatctcccatatcaaatatatttagaagtgaaatttagcaatcatttattttatgagtaaaatgaaacagaaaaagtgaactatgaggggtagactcctttggaaaaatcattttaggttggaacctataatattgcctagaagagagaacccatccatgttgaaatgccagattagagggaagtttataaagaaaagaccatgtagaatgatttgaatgtttaccactgtctagttttggaaa

SEQ ID NO: 92910 - DNA, 601 bp, Human
gatatgtcttgttctgctatttttctgtactagaaagtacttcttcagattgctaggctacttaccagaatcatcaactactaactagtaaagaaacaaactgtgttttgggatctcccatatcaaatatatttagaagtgaaatttagcaatcatttattttatgagtaaaatgaaacagaaaaagtgaactatgaggggtagactcctttggaaaaatcattttaggttggaacctataatattgcctagaagagagaacccatccatgttgaaatgccagattagagggaagtttatraagaaaagaccatgtagaatgatttgaatgtttaccactgtctagttttggaaagaaagaccagggcattacatgcagggtccttcttggtgttggaccctccctcctcttttcctacttctttttttttttttttttttttttttttttttgagatggagttttgcttttgttgcccaggctggagtgcaatggcacaatcttggctcaccacaacctccacgtcctgggtacaagtgattctcctgcctcagcctcccgagtagctgggattacaggcatgtgccaccacgcccggct

SEQ ID NO: 92911 - DNA, 601 bp, Human
tagttgcgttagtgtcaaaaatgaataaactagttttaggtttcctacgtgttttgaatattttatgtatatacatactcttactaactatgaatacataaattagccaacaaatgttagtcagaattttattttgattggtcaacttttaaaactgtgacttttactgagtttctgtctttatctttctagatgttatagtgaaatgtctaaggagggaaactgaaatgaagtggtgtctgccaaatgaataactttacttgtggtattgcagcacagttacttcttttttaaaaaaaawtttttttaattttaagacagggtctcactctgtcacccaggctgtagcctccacctcctgggctcaagcagtgctcccacctcagccttccaagttgctgggaccacaggtgtgcaccaccaggcccagctaattttttttttttttttaactagagacagtgtctccctaggttgcccaggcgtgtctcaaacttctgggctcaagtgatcctcctgcctcagcctcccaaaatgctgggattataggcaggagccaccatgcccggcctagttacatttctaacaaagtaattttgag

SEQ ID NO: 92912 - DNA, 601 bp, Human
ggaacttttctgcagtccttccttgtctgtggggaatatgtcctaagaccctctagtggatgcccaaaactgagcatagtaccaaacactatatatacagtcgtgtgtaactttatgatggggtatgttctgagaaatgcgtcattaggtagttcgatcatgcatacatcatagggtgtacttacacaaacctatgtggtatagcctgctacatatctaggctgtatgatttagcctgttgctcctaggctacaaatctgtacgacatgttactgaactaaatactgtagacaattgtaayacaatagtaagtatttgtgtatctgaacagacgaggtaacacgtggcatgacatcactaggagataggaatttttagtctgcattataattttatgggaccagtgttgtatattaattataatttataagtctttatgtatcttttatatggaaacccaaatgtcccagcaccattgctgaatattatccattttccctacttgatctacaatgtcagtattaagtggcatatagcaggtttctgtatattctgtattatgatcttatggcaccactgtcatatatgtgatccatccttg

SEQ ID NO: 92913 - DNA, 601 bp, Human
agaggttgcagtgagccgagatcgcgccattgcactctagcctgggcgacagagcaagactctatcttaaaaaaaaaaaaaaaaaaaagtattctgacttcaatccattttttttctctaactgcaaccaagataatttatttactgagtattttcagctattatgataaaagacataaatgtgatttcttccctaattgagcttacttcatagtttgagagtcagactagtaaataattaattaaaaagagtatgttaggtgctctgaaagggaaagtatagtttgatgaggtgggaaayaaagaggagtccctgtgtgccaggggatcaggaagggcttttgatgggaggtgaacttgctatcaaaatcagtcctgaagtcataaaaattagtcatgtaaagattaaagggctatgttggaggaagaatgttccaggcagaggggagaataccatgttagaagttttggaggtaaatgagagcttggtgtattgaagaattgaaagaaattcagtatggctggattatagagctagagaagagggaaggagagggaaaggaggtagctatgaaagattcggtaaaccaaaagctggata

SEQ ID NO: 92914 - DNA, 601 bp, Human
aaaagtaaagaaaataaagtccttttcctcaccagttcatattctggtggttggaaacagacattaaagaaatgattataaaaatgtcagcgtaggccgggcacgatggctcacgcctgtaatcccagcactttgggaggctgaggtgggtgggtcacctgaagtcaggatttcgagatcagcctggccaacatgatgaaactaaaaatacaaaaattagccgggcgcgatggtgcgtgcctgtaattccagctactcaggagggtgaggcaggaaaatcacttgaacctgggaggtggargttgcagtgagctgaaatggcgccactgtactccagtctgggctctgggcgacagagtgagactctgtctcaaaaaaaaaaaaaaaaaaaagtcagggtatgggattgacaagtccatagaaacagaaagtaaattagtggttgccagggattcaaggaatggaggttggagaatgactgctaatggggatggcttttcttttttgaggtgatgaaaatgttctggaattaggtagtagtaatgactacataactttgggcctatactaaaaacactgaatcatgcactttaaaagggtg

SEQ ID NO: 92915 - DNA, 601 bp, Human
ctcacgcctgtaatcccagcactttgggaggctgaggtgggtgggtcacctgaagtcaggatttcgagatcagcctggccaacatgatgaaactaaaaatacaaaaattagccgggcgcgatggtgcgtgcctgtaattccagctactcaggagggtgaggcaggaaaatcacttgaacctgggaggtggaggttgcagtgagctgaaatggcgccactgtactccagtctgggctctgggcgacagagtgagactctgtctcaaaaaaaaaaaaaaaaaaaagtcagggtatgggattgrcaagtccatagaaacagaaagtaaattagtggttgccagggattcaaggaatggaggttggagaatgactgctaatggggatggcttttcttttttgaggtgatgaaaatgttctggaattaggtagtagtaatgactacataactttgggcctatactaaaaacactgaatcatgcactttaaaagggtggaactttatgttgtgtgaattatatctcaaaaaatgttgggagttggccaggctcagtggctcacacctgcaatcccagcacttcgggaggccgaggagggaggatcac

SEQ ID NO: 92916 - DNA, 601 bp, Human
aggaaaatcacttgaacctgggaggtggaggttgcagtgagctgaaatggcgccactgtactccagtctgggctctgggcgacagagtgagactctgtctcaaaaaaaaaaaaaaaaaaaagtcagggtatgggattgacaagtccatagaaacagaaagtaaattagtggttgccagggattcaaggaatggaggttggagaatgactgctaatggggatggcttttcttttttgaggtgatgaaaatgttctggaattaggtagtagtaatgactacataactttgggcctatactaamaacactgaatcatgcactttaaaagggtggaactttatgttgtgtgaattatatctcaaaaaatgttgggagttggccaggctcagtggctcacacctgcaatcccagcacttcgggaggccgaggagggaggatcacctgaggtcaggagtttgagaccagcctggccaatatggtgaaaccctgtctctcctaaaaatacaataattagctgggcatggtggcgcgtgcctgtaatcccagctgctcgggaggcaggagaattgcttgaacccaggaggcgaatgttgcagtgagcca

SEQ ID NO: 92917 - DNA, 601 bp, Human
cacacctgcaatcccagcacttcgggaggccgaggagggaggatcacctgaggtcaggagtttgagaccagcctggccaatatggtgaaaccctgtctctcctaaaaatacaataattagctgggcatggtggcgcgtgcctgtaatcccagctgctcgggaggcaggagaattgcttgaacccaggaggcgaatgttgcagtgagccaagattgtgccactgcactccagcctgggtgacagagcgagagtcagtctcaaaaagaataaaataatgttgggagtgaaaaaaataaagcarggttaggagggataagaaaatggtgggggcactattttgtagagcatgatcatagtgatttttgagcctcatttgaacagacatctaaaggaatcgaaggagtaagcaatggagataaatgtggagttttccaggtggaggaaaggcaagtacaaagacatcaaggctgtgaaagtgcttggcatgttcaagaagtagcaataaaggcagtatacctggagcagagtggaaaagcaggagaattgtaggagagaaagggagagagatattaaggtgctagatcatgtaaggactttgggt

SEQ ID NO: 92918 - DNA, 601 bp, Human
atctagtgcacatggttgcttcttttcttgagcccaaagaggtaaggataatttttacctgggaaaggaagtatgggaaatttatgtcctatacatttgctgtggagaaataaacagtcatttgccaagaatgatagatacaggatagtagccttaagagaatcatcatgaggaactggggagtaaagctgataaggaatactttgaaaaaaaaaaaaaaaaaaaaggctcctgagctactttgaggaagatcttgaattcatagtggtactggtccacaattttgatttttctctatcamaacttagaagctgtggttcaggaatgttgaagatgagtgcttaggatcattcaggattgggtatgattaacaggatgaatatgatcaaaaaataatggggatggggtaaaggaattcttcaagacacaagctcaggcttcgtcttttccttgaaatggcccccattggtcttttctcttttaattttgtacttttctctgctattgctgccttatgtttagtccattagaatttacgcacacacacatacacacacacccttaagcacttaaacatttttttttaaatatggaaaacgac

SEQ ID NO: 92919 - DNA, 601 bp, Human
ctttggtgatggactattatttcattttattttttaactgttataagtcattgtaatgaacatagtacaaatgatttccccctgtactggtatgagtactgttctaagtacttaaatttgtcttttatttctaaatttcttctgctgtcatgtttcaaggtgaatccttcagacttgcattcttttagctttctcttgagaatggatccaaatgaataaggctacctgcatattattagataagaccacccccaaaccatcttgtaatctacagtgttgaggttaagtgcataggctttgragtcagaacagatttggattcacatctttgctctgcttcttcatttagttgtatagctttaaacttcagttttccagtctattaaataaagaacgttgaaagcataaggctttttttttcattgggagaactctataactgagatgaaataatcattatttaaaaattttctagctaattaaaatcctttgtggtacagtttaatgttattttccttttctagattaagggaaagtagataaatcttggttattatcttttttttttttttttgaaatggagtttcactcttgttgccca

SEQ ID NO: 92920 - DNA, 601 bp, Human
atcttgtaatctacagtgttgaggttaagtgcataggctttgaagtcagaacagatttggattcacatctttgctctgcttcttcatttagttgtatagctttaaacttcagttttccagtctattaaataaagaacgttgaaagcataaggctttttttttcattgggagaactctataactgagatgaaataatcattatttaaaaattttctagctaattaaaatcctttgtggtacagtttaatgttattttccttttctagattaagggaaagtagataaatcttggttattatcttttttttttttttttgaaatggagtttcactcttgttgcccaggctggagtgcaagggtgcgatctcggctcactgcaactgcctcctgggttcaaatgattctcctgcctcagcctccctagtagctgcgattacaggcatgtgccaccacgcctggctaattttttgtatttttagtagaaatgaggtttctccatattgctcaggctggtcttgaactcctgacctcaggtgatccgccacctcagcctcccaaagtgctgggattacaggtatgagccaccgtgcccagacttttt

SEQ ID NO: 92921 - DNA, 601 bp, Human
acttcagttttccagtctattaaataaagaacgttgaaagcataaggctttttttttcattgggagaactctataactgagatgaaataatcattatttaaaaattttctagctaattaaaatcctttgtggtacagtttaatgttattttccttttctagattaagggaaagtagataaatcttggttattatcttttttttttttttttgaaatggagtttcactcttgttgcccaggctggagtgcaagggtgcgatctcggctcactgcaactgcctcctgggttcaaatgattctsctgcctcagcctccctagtagctgcgattacaggcatgtgccaccacgcctggctaattttttgtatttttagtagaaatgaggtttctccatattgctcaggctggtcttgaactcctgacctcaggtgatccgccacctcagcctcccaaagtgctgggattacaggtatgagccaccgtgcccagactttttctttctttctttctttttttttttttttgagacagactctcactctcaaaatctataagaaaagattttccagcctaggctggagtgcagtggcacaatcttggc

SEQ ID NO: 92922 - DNA, 601 bp, Human
agcctgggtgacaagtcagaccctatctcaaaacaaacacagaacatatttctgtattaaggtctgattctgtgatgtgtgtataattctaggattatcatttcctttgtagatatactaaatagaaaaacttgagatttgaacaatttccttgccagtattatcacatgcagcagcttttgatggtggagagacttaacagttaaaaatttccaacaacattaatttttagctatattatacttaattatataattaattttagtagctaatatttgttttaattctttctaatagcctwggtcagtggattcttggattattgcatttaatcctcagaacaaccatataaagtctagatagtatcattactcctattttacagagaggaaaacagactaaaagtaacttgtccaggggcacatagaagcaagcagcagagctgggatttaaatggaggcaatttggtaccaggacaacgtgcacacacacactccgtacttcctactgtgataaatttctctcttggttgggtgagatttgctgaaataatgtatatttaaaggatctagcactgctcttggtaccttgtaggtgctca

SEQ ID NO: 92923 - DNA, 601 bp, Human
aaagactcattttccatcctcccatcttccccttccatatcttgcaaaccctagtgtagagactgaagaactcaagtgcctatagggcacagacagcataatatcaattagagaaattggctgaacggtactttaggtaacttgagagtacactaaaggaggcagctccagttttccttgtggatttagtattgctggatcctgtgattcaagagaagccaaaggtctgagatttttatgtaaaatctgatttttaaatgttggcaattaattttaaatgtttttttaaactgtgcaggcraaacagaacacttctgcagtccaagtacttactataggaagtacaagacctgtagaaaggaaaactgtggctgggtatggtggctcacgggtgtaatcccagcactttgggaggccgaggcaggtgggtcgcctgatgctaggagttcaaaaccagcctggccaacataatgaaacgtcatctccactaaaaatacacaaaattagctgggcgtggtggtacgcctgtaattccagttactcaggaggctgaggcatgagaattgcttgaactggggaggcagaggttgcagtgagctga

SEQ ID NO: 92924 - DNA, 601 bp, Human
atttagtattgctggatcctgtgattcaagagaagccaaaggtctgagatttttatgtaaaatctgatttttaaatgttggcaattaattttaaatgtttttttaaactgtgcaggcgaaacagaacacttctgcagtccaagtacttactataggaagtacaagacctgtagaaaggaaaactgtggctgggtatggtggctcacgggtgtaatcccagcactttgggaggccgaggcaggtgggtcgcctgatgctaggagttcaaaaccagcctggccaacataatgaaacgtcatcyccactaaaaatacacaaaattagctgggcgtggtggtacgcctgtaattccagttactcaggaggctgaggcatgagaattgcttgaactggggaggcagaggttgcagtgagctgagatggcgccattgcactccagcttgggtgatagagggagactgtctcagaacaacaacaacaacaaaaggaaagctgtgtattgtgaagtgaaatcagagtcaccttgaaatgggcatgaggtattcatcagattgcctttggaataaaagaaataatgtccgtggaatatctcagtaacacc

SEQ ID NO: 92925 - DNA, 601 bp, Human
ggccaacataatgaaacgtcatctccactaaaaatacacaaaattagctgggcgtggtggtacgcctgtaattccagttactcaggaggctgaggcatgagaattgcttgaactggggaggcagaggttgcagtgagctgagatggcgccattgcactccagcttgggtgatagagggagactgtctcagaacaacaacaacaacaaaaggaaagctgtgtattgtgaagtgaaatcagagtcaccttgaaatgggcatgaggtattcatcagattgcctttggaataaaagaaataatgyccgtggaatatctcagtaacacctcctcattgctaacccttttgagggcagaaattatagtttttatttatgttagtagctccaattaatatattaataatagttctaggtgtgttctacacattattgctagtgcttacaactctacaaggtagataggtattaccactgtattataaatgagacagccaaggcttgctgtgataagtaacttgtccaaggtcacacaaaaaataagtgatacatttatgatgaaacctcagttctgactacctttgttctttcattatgacatgctgc

SEQ ID NO: 92926 - DNA, 601 bp, Human
catgtgtttgttttcctcacaccagtagtagtcaaactgctgttaactatgatttctgaaaaggtacttctgcatttgatataatttcaaaagggccatggtgcttaaaaagaaattagaaaactaaatgcttatggtagtataatcatgtaacagtgtactagaaaaactactttattggccggtcacggtggctcacgcctgtaatcccagcactttgggaggccaaagtgggcagatcacttcaggtcaggagttcgagaccaggctggccaagatggcaaaaccccggtctctaccaaaaatataaaaaattagccgggtgttgtggcgtgcctgtaatctcaactcctcgagagaggctgaggcaggagaatcccttgagtagttccccacatgcatacatacaatgatcactactcaactagatactctaaggagatcctctatagatctccagcgttctctctgagtgtgtctctcctttccagtactctgcattgagaaccccggccatctgggcttccccagactcctagctctaccacttcaacttaagaagcttaagaagactgctgggtggccaggcgcggtggctcac

SEQ ID NO: 92927 - DNA, 601 bp, Human
aagaggcagaagtaatgaatttgatcatttgttcattgccactcattgtagacacttatttttgatctctgtaaacatcagcttatatctcaaagtatgaggtctgaatacttgcttgtgggtgatcatctttgtgtagaatagaaaagacaaagtaggaccaggtgcagtagctcacacctgtaataccggcacttcgagaggccaaggtggtagaattgcttgagcccaggaattcaagaccagcctggacaacatggtgagaccctgtctctactgaaaaaaaaaaaaaaaaaaaaargaaaaaagaaaatattagctggacatggtggcatgagcctgtaggcccagcatacttgggacattgaagtgtgaggatcacttgagcctgggaggttgaggctgcaatgagcaatgattgtgccaccgcactccaatctggacaacagagtgagacaagaagagagagagagagagagacagatagagcgagtgtcttgttgagttcttcagtgttgggtcaaagaagggaaaaaaattgtgcgtataaatagaaaaaaagaaaactaactttttaaggctttaaaaataactgaaagtg

SEQ ID NO: 92928 - DNA, 601 bp, Human
tgtatccccagcctggtgtacatcaggcagtccataaatatttattgagtgaatgagtacatgaataaatgaatgagaatatttactgagctgtcgttcattttatagcaggtacaatgttgtttcttcaccactgatatattcatttattacctcttatttattagcagtgtttctgaaataatattaaaattagaagttttcttgaagcttgttttacaacttagaattattatccagtagctttccttaatatttttataacctcatcaacaaacagtgagtgtctcttgtaagtagygtactgccgaaccttagtcagagaagacatgacatagttttggtccatgaagggttttcaacccatttggagaagtaggaaatagatacaaagatgatttgtaacaacctgaggggtgtcaaaaagatggtacatgtaggaaattaatgttatattcaagtgaaaatttgatattgtttatgtatattattcaacttttaaaaactttgcattaaagtatggaaaggaagcataagtataccattgttttaatggttatctttgatgagatcatgggcaagttgaatttttatttcttac

SEQ ID NO: 92929 - DNA, 601 bp, Human
ctggcctcaccctgcctttagtagtttcatctcatgttactgcttgtaacttccgtgttctgagtaactgagttacctaataacctgagatgaaaatactctttttgttcaggtttgcttttatagtttctccttccttttccccagtctgtctgctaaatagccatttcaatattcaaggttgacttctggtgttacatcctctgtgctgccttctcagatcctccacagataacattaaaggttccctcttctccagttgtgtaacacttcatactttattaaagcacatactgcattrttttaaacttgactcattttattatctctagactgtgaactgcttaataagggtgactttcttttgtattgtgtccctagatcagtgcaggtgctaaataaatgttgaatgaatgtttaattactgctttgtcaggttgaaggtgatagtgaagaggagctggcatagacaaaaatacttagcccctgtgactgtggcaaataagatgtcaaacaagtaattatatgaccaagagaagactcatggtatgtgttgtaaccaagattctgttgcctttttcaactaaaatatttggttttg

SEQ ID NO: 92930 - DNA, 601 bp, Human
ttacaggcacgagccaccacgctcggccctagattggtttttgattgccagatacctaaaaatgaagacatgaaataagtttgtttactctgatagattcatttctttgcaaattgagatcttataatatgaagctacagttacatagctgaattttttgaatccgtagtaattaataaattcctaatgaaatgtatgcctgaatgcactttttggaacaatcttgaacctacaaaagagttgtgaatatagtgcaaataatttattgctttttttctgaatcatttgagaataagttgcygacatgtttcctcattgcctcccaatactttggtatttccaacaaataagaatattcccttatgtaaccacaatatagctatcaaaataaaaattaacatcaatacatttttttcaccttgtccttagatcctatttgggttttgcaaattgtcccagtaatttcctgtatagcaaaaggatccagtttagaattatatgtccatttagttgtcatatctctttagtttctttgaatctgaaatcattccttggtgtttcctggacttttatggttttctttttcctttttttttttttt

SEQ ID NO: 92931 - DNA, 601 bp, Human
gagacagaatcttgctctgttacccaggctggagtacagtggtacgatcttggctcactgcagcctcctcctcctgggttcaagcaattcttgtgcctcagcctcctgagcagctagggctataggcacccaccaccactcccagctaaatttttttttttttttttgagatggagtctcactgttgctcaggctggagtgcagtggcgcgacctcggctcactgcaacctcctcctcctgggttcaagagattcttctgcctcagcctcccaagtagctgggattacaggcacgtgccamcatgcctggctaatttttgtattttactagagacgacgttttgccatgttggccaggctgctctcgaacttgtgacctcaggtgatctgcctgccttggccttccaaagtgctggaattacaggcatgagccaccgcacccaacccatgctgtcttttgtgtccttttgatatgcccccgtaattctttgagtactttcttacctttagcaaaacaagacattccaggttcatcttgtattttgcctgtcccagccctgatactatttctctgaaaagccctggttacttttggggtgct

SEQ ID NO: 92932 - DNA, 601 bp, Human
atagcctcctatcttgctcatcctgctaggattttgaatcctacctaaaactgccctttgcttctgctccctcaaccccgatagatgtcttccctaccccatttgaactccaacaccccatgccaggctgcctatctacggaaatgccctctttagtcagtcttctactttcccaccgtaggcaacccttctacacagatgccctccttattcagctcaggctccaaggcctcacatgccctcctcaccctgcttggattgtaactccccgtgctgggctccccctctcttgcccagtgawcacactatttatacctgccgggtaacctctgataaccaaccttaggcaatccttctatgtggacatcctcattactacttaggttatgataccctctgttggttgccccttgcatggataccctcctcacccttctctggctctggcattttatcctgggctctccctgctcactccacagagatccttctcattctattcatgcttttactccttgggctaggctgtccatccatatggagatttgcgttctgtttgggttcccacctcccaccctaggcagaccccctgtgcatcagc

SEQ ID NO: 92933 - DNA, 601 bp, Human
accaaccttaggcaatccttctatgtggacatcctcattactacttaggttatgataccctctgttggttgccccttgcatggataccctcctcacccttctctggctctggcattttatcctgggctctccctgctcactccacagagatccttctcattctattcatgcttttactccttgggctaggctgtccatccatatggagatttgcgttctgtttgggttcccacctcccaccctaggcagaccccctgtgcatcagccttctttcttgcgtggatgctgtcctcatcccacytcttgggcactaacatcccaacctgagccatcctcccctgcacagatattcatatattcttcaccctgcttaggctctgacaccacacactaggctgtcctatatagatactttcttcatgttgctcagactctgcatctagaatatctcttgcccctctcatccactcatttatgtcctcctcaccctgcttaagctctgaaatcccttcccaggcctccccctattctctataggtatccttccccctcccctctaggcttctgataccctcctttgagccctcttattcctcttgga

SEQ ID NO: 92934 - DNA, 601 bp, Human
aactcctgggctaaagtgatcctcccaacttggcctcccaaatgcctggattacaggcatgagccactttgcctggctgaacataattttaaagtttttgagtgaaaaataatacctagtagaaaaaagatatgttatactatattaaattgtctgtggaaggccgggcacggtggctcatgcctataatcccagcactttgggaggccaaggtgggcggatcacctgaggtcgggagttcgagaccactctgaccaacacatggagaaaacctgtctctactaaaaatacaaaattagcygggcgtggtggcgaatgcctgtaatcccagctatttgggaggctgaggcaagagaattgcttggaccggggaggtggaggttgcggtgagctgagatcgtgccattgcactccagcctgggcaacaacagcgaaactccatctcaaaaaaaaaaaaaaaaactctgtagaactcaagttagttttcttcttccccaaattgatataatttatactgctgtatattatttaaaattactttaaaacactagattgttttaggaaaacagtaattaaatacagcctggcagaagtgctatga

SEQ ID NO: 92935 - DNA, 601 bp, Human
aaattactttaaaacactagattgttttaggaaaacagtaattaaatacagcctggcagaagtgctatgaataagtaaatatgtggcagcagactagtaaattggcttaaacttagaaattgagaaaaatttgttaagacagagcattacctaccagttattcttggactgcatactcttttagaaactgaatatccagtggacctgcagccagtacattttttccagtagagatgccaagtatgatgactgtcaagcttgaagtgtttttaacaaaatgaatgctgtctctcttcaatgyagaacgatgttggcacattgtagatgccaggcattttgttttagaatatttaatgtgaaattataaccttggaatttaccagctgattgagatagttaatggagaggtggaagagtaaggcatttcattcccaaaccattttctgaaggttttttctaactctttcagattccaagagtagcttcacatttagaggttttttttaaagtaaaatctaatatttaaaaaaagattaaaatgtttagaaatggatttttcaggattataatgtttgcatttcatatcagagagcattcattg

SEQ ID NO: 92936 - DNA, 601 bp, Human
ggatgaaaattctaagaaagaataagaacttagacttcttttcaagagatcaacttatttaagccttgtagcatctctgtgaggctgtgctctatccgtgtatagccctaattttgttgtatatattttatttgattatatacttcagtaaaaagaacacctgtgaacccattgtgtagctcagcttatttctactcctcctgtctcccatcaaaggaagccgctgtcctaaactttatcatctttctcttatcacatgtgtttttctttttttactataatacagatatcacattctttrttgataaaacctacctcataggattgattgttttgaggttaaatgagaaaaatacatatactgagcctggccctgcaaagtgctcaaaaaatagtagctgtaattatgttattaatgttgttattttgctgagtgagtacagcatgaaaagcatgtcttttcccagctgtttcctgtggcttatctccctgcactcttgaggtcttttcatctcttcctggaatgaccagtaacagtaaagcagtagagaaggggatttgggtgatcagctgtttggacatagagtgcccaactgagaag

SEQ ID NO: 92937 - DNA, 601 bp, Human
ctaaacaagccaaccagtcagtgcatttttacattgttttcctttccacccaacattgggaagcattaatttattttcaatatctgaaaatgttgatttcattcttctatttcctttttccagttgccctgggctctatgagaatgcaccagcatgggacagattcttgatcttctgaacttgcttccctttctgcctatctacttttcttatacacatattaataatttatgttaatggagttattatatcgcacttgccctaattctactacatggatacttaagcagtgcacttaccktggcattttggtcaactaaaatttttaatgaaatttaggtgagttgattacacattatcgcacaaattattagcagcattaatagaaaaaatatatcagaaaataatcaggtcaggcatggtggctcacgcctgtaattctagcactttggaaggccaaggcaggaggcttgcttgagcccaggagttcaggaccagcctggccaacatagcaagaccgcgtctctacaaaaaaattgaaaaggtaactgagcatgtctgagaaaaaataaataaaaagaaaataatcaccctagtcttg

SEQ ID NO: 92938 - DNA, 601 bp, Human
ttattagcagcattaatagaaaaaatatatcagaaaataatcaggtcaggcatggtggctcacgcctgtaattctagcactttggaaggccaaggcaggaggcttgcttgagcccaggagttcaggaccagcctggccaacatagcaagaccgcgtctctacaaaaaaattgaaaaggtaactgagcatgtctgagaaaaaataaataaaaagaaaataatcaccctagtcttggccgactgaagaaagagttccttagaacacaaaagtaaaatcacttctagattaaaaaagagagagmgagagaaatagagtgagtacatgtaagtttattgcacaagagcagattttaccagctcttacattaatccttgttaagtttcatctccttcctttgggcagatattccagtctttcatgatctgtgatgaattatgacataagatttaatcccttttaagcctatgtcatttgaaaagtcatatctttgttcaagttgtgatataaccaccttcttccagattgaacctatacattttttgggtactgttgtttagaagtcatctattttattaagtctatatttcttcttcttgtttac

SEQ ID NO: 92939 - DNA, 601 bp, Human
taactgagcatgtctgagaaaaaataaataaaaagaaaataatcaccctagtcttggccgactgaagaaagagttccttagaacacaaaagtaaaatcacttctagattaaaaaagagagagagagagaaatagagtgagtacatgtaagtttattgcacaagagcagattttaccagctcttacattaatccttgttaagtttcatctccttcctttgggcagatattccagtctttcatgatctgtgatgaattatgacataagatttaatcccttttaagcctatgtcatttgaaaaktcatatctttgttcaagttgtgatataaccaccttcttccagattgaacctatacattttttgggtactgttgtttagaagtcatctattttattaagtctatatttcttcttcttgtttacaataacttataaagatttttatcacatattttactgaatttaggataactgcctgcagcattttcctgatcctctagtagaagagccttaaaagacaaattagtttgcagcttggccttctttatatatagaagctatgtgaagagagatggttttgtccatgaagtttattagagca

SEQ ID NO: 92940 - DNA, 601 bp, Human
gcttcccttggataggcatgataaacttctggcaggctgacttcttttatttccaaacacttgagtcagttaatcagaaaacatctttggtgaaggaatccatgcttcctataccttccacttgaccttgcattttacttgtttgttttgaggggcagactttggagaggggtggaatataacaagttctgcatttaatttctttccatgtactttttagtaacattactatcatacctctagtggagaggtatgatacctcaactttatacccttctttgggaaagttagagtgtttcartccacaaagttttgctttgatttgattaatttattttaataattggagaaatggagataaaatcctgattagtaacatgctattagtgattgggctattactaggataaatttttttccatcacataaatcataaatgcatttgggtagatctttttctctttttatcgaatctgtttctttcaaatttcctttttgtttgggaaaaaaaaaaaaagaaaaaaatagactcgaggctgggtgtggtggctcacgcctgtaatcccagcactttgggaggccgaggtgggtggatcacctg

SEQ ID NO: 92941 - DNA, 601 bp, Human
tccatgtactttttagtaacattactatcatacctctagtggagaggtatgatacctcaactttatacccttctttgggaaagttagagtgtttcagtccacaaagttttgctttgatttgattaatttattttaataattggagaaatggagataaaatcctgattagtaacatgctattagtgattgggctattactaggataaatttttttccatcacataaatcataaatgcatttgggtagatctttttctctttttatcgaatctgtttctttcaaatttcctttttgtttgggaaaaaaaaaaaaagaaaaaaatagactcgaggctgggtgtggtggctcacgcctgtaatcccagcactttgggaggccgaggtgggtggatcacctgaggctgggagttcaagaccagcctgaccaacatggagaaaccccgtctctattaaaaatacaaaattagccaggcatagtggtgtatgcctataatctcagcaacttgggaggctgaggcaggagaatcacttggacctgtgaggcggaggttgtggtgagccaagattgcaccattgcactccagcctgggcaacaagagaga

SEQ ID NO: 92942 - DNA, 601 bp, Human
gcttttaacaacattttaacaaactgaaaatgtttagtcagggcatattatattctgacagatgctgaatttgccacatgatttgaagatgaacatttcaagcattaggtaacaacatttttccttctttcttttatttctttcattctttttttgtttttgagatggagtttcactattattgcccaggctggagtgcaatggcgtgatctcggctcactgcaacctccgcctcctaggctgaagtgattctcctgcctcggcctcccgagtagctgggattacaggtgaccaccaccamgcctggctaactttttgtatttttagtagagacagggtttcaccattttggccaggctggtctcgaactcctgacctcaagtgatcctcccgcctcggcctcccagtgttgggattacaggtgtgagccaccgcgcctggcccaggtaacagcatttttcaaaagaaacttttaagtttattctttactgtgaatgaagatcgtttaagagtacaacttctaattttagctttctttcatgaccttcctccttatccctatccacatcaaagttaggatatatactttagtgattaacta

SEQ ID NO: 92943 - DNA, 601 bp, Human
aggactatactaattgactggagaagccaatttaaagctgatccacagtagtatatgccatttcatatgtaaagggtaagttttacttatactattgcaaaggaagatactggaccatcttgggttatttggcatttcttccattctgtctagttttatccaattttcaatgttaataactttttctagagactatcttgaacataaggaataaagccaagaagaaaacagggacagaactaatgggaaattcatttttcagttcaataagattatataataaaataaaaaataaaaaaawtttttttttttttttgaaacagggtctcacccaggctggagtgcagtggcatgatcatggctcactgtagccttgacctcaagcagtttacccacctgagcctcccaaatagttgggactgtaggtgtgcatcaccacgcctggctgattaaaaaaaaaaaaaaaaccttttgtagagatgggggtcactgtgttgcccaaactcgtctttaattcctggcctcaagcaatcctctcaccttggcttcccaaagtcatggattacaggtgtgagccactgtgctcagctgctaatagctc

SEQ ID NO: 92944 - DNA, 601 bp, Human
caggctggagtgcagtggcgtgatcttggctcactgcaacctccacctcccgggttccagcgattctcctgcctcagcctcccgagtaactgggactacaggtgtgtgccaccacacccggctaacttcatagcagtttttaacatgtataaagataatacacagtcataaagtgtgtacagtggaaatcttggttgaatatctccacttgttggaccactgtcggtttttaagttcataacttgatgtgaagtgatccatataataaatttttcttttggaagagctttgatatatagtrctttgagttctatgccatgtcacttaataaatctcaagtatgtaacaagtattttctacaaaatttcattgagtgctatttatactataagagagggcactagagatgcaaattaatgtcctataatcaaataagtgctatattctaattcatttcatatctcctaatcacctgaattaaaatcacagaaatttctaaaccatctataataatacactgtacaaaaactgaggtgaagaaaatatgttactcctcctgtaggagacagcttttaaaaaatgaaaatatattatcactttt

SEQ ID NO: 92945 - DNA, 601 bp, Human
gccatacctcttctctacaagtgtcaggatcttcgaatgggaatttgatttctataataataatttaataaaagtgatttctagcaacaaaattttttatcccattgaatttattataacttaatttacttacgttagaaagtatttacagttatataatgaggattttcttgagttgactaaatttgaggaagaaatttgcctttgattgctttcctgggttaacatatttcagaatttttgccacctaatgtagtatactcttcatgaaattaaaccagaaacccactaacgagaaagrtaattcacctacagatgctgtgagctaaaatgttgtgagttgatcttggttattctttatggccattcccttttttccaagaaaactagaccatttctagaaggaagtcagatcctagttacaaacatgttgcaagcagatttaaaaatctctactcctccttctatcttattatactgaaattacatagtaaatttaaatacatacacttatacatatggatggtatgtatgtatggatttatgctgaagtctgcattattagagagcaaacttgggcctatagccattaattcagaaa

SEQ ID NO: 92946 - DNA, 601 bp, Human
gttttatttatttgtttatttttctcacagatgagattaacatgggctttggagtcataaagactgaatttgaatctaattgctatcatatcatatctcctatatagatggactcttgggaaagttaaataaatttctaataatattacccttgtagttagacaataataccaacttcttcttaaggttcttatgaagataaatttgtaaaatagccgaacattttctgacaagtagtaattattgaataaacattgacctccttccccatgtgtttctaacctcctttgttagtaaagtttttttttttttttttttttttgtcatccaggctggagtgcaatggtgcgatctcagctcactgaaacctccacctcctgggttcaagcgattctcctgcctcagcctcccaagtagctgggattacaggcacctgtcaccatgcctggctaattcttgtatttttagtagagacagggtttcaccacgttggccaggctggtcttgaactccggacctcaggtgatccgcccacctcagcctcccaaagtgctggtattacaggcgtgagccaccatgcctggccattagtaaggtgtta

SEQ ID NO: 92947 - DNA, 601 bp, Human
cataaagactgaatttgaatctaattgctatcatatcatatctcctatatagatggactcttgggaaagttaaataaatttctaataatattacccttgtagttagacaataataccaacttcttcttaaggttcttatgaagataaatttgtaaaatagccgaacattttctgacaagtagtaattattgaataaacattgacctccttccccatgtgtttctaacctcctttgttagtaaagtttttttttttttttttttttttgtcatccaggctggagtgcaatggtgcgatctcrgctcactgaaacctccacctcctgggttcaagcgattctcctgcctcagcctcccaagtagctgggattacaggcacctgtcaccatgcctggctaattcttgtatttttagtagagacagggtttcaccacgttggccaggctggtcttgaactccggacctcaggtgatccgcccacctcagcctcccaaagtgctggtattacaggcgtgagccaccatgcctggccattagtaaggtgttaaaaaataggttctctttgtaaaaattagttttgaactttatttttactttttttc

SEQ ID NO: 92948 - DNA, 601 bp, Human
agactgtgtctcaaaaacaaacaaacaagcaacaacaaaaacaaaaaacaaaaaaacttctggtagagcaatttatgacttctggttttttgtctaggcagtttattttgtctacgattggatctaacgtacactttactccagacccaggtctaaaacctgattgattaaatcagaagtttttaatgatgctgtaaatgattttttattattgtttaatcatatcttaaaaaaaacaaacgtagggctgggcacggtggctcacgcctgtaatcccagcactttggaaggttgtggtgcrtggatcacctgaggtcaggagttcaagaccagcctggccaacatggtgaaaccccatctctactaaaaaatacaaaaaattagccagaggtggtggtgggcgcctgtaatcccagcgactcgggaggctgaggcaggagaatcacttgaacccaggaggcagagattgcagtaagctgagattgcaccactgcactccagtttgggcaacagagagagactcggtctcaaaaaaaaaaaaaaaaaaagtaaaaacattgaagtagaattggcaggaatgcctttattttttaatctaaaa

SEQ ID NO: 92949 - DNA, 601 bp, Human
aaaaaaacaaacgtagggctgggcacggtggctcacgcctgtaatcccagcactttggaaggttgtggtgcgtggatcacctgaggtcaggagttcaagaccagcctggccaacatggtgaaaccccatctctactaaaaaatacaaaaaattagccagaggtggtggtgggcgcctgtaatcccagcgactcgggaggctgaggcaggagaatcacttgaacccaggaggcagagattgcagtaagctgagattgcaccactgcactccagtttgggcaacagagagagactcggtctcaaaaaaaaaaaaaaaaaaagtaaaaacattgaagtagaattggcaggaatgcctttattttttaatctaaaatatttaaaatgtattgtagcgtattgaagtgtccttcagataatatcccttggaactttttttttctctaattttgaagtttagtgatactctgtttttatcttaaagtgacattatctttcagtagttcagtgtttgtctctgtctctctctctttttagcctatacttcctggtatatttggcagtgtaataaatgtagctgtcagctagtataattattccctttt

SEQ ID NO: 92950 - DNA, 601 bp, Human
gcctgtaatcccagcactttggaaggttgtggtgcgtggatcacctgaggtcaggagttcaagaccagcctggccaacatggtgaaaccccatctctactaaaaaatacaaaaaattagccagaggtggtggtgggcgcctgtaatcccagcgactcgggaggctgaggcaggagaatcacttgaacccaggaggcagagattgcagtaagctgagattgcaccactgcactccagtttgggcaacagagagagactcggtctcaaaaaaaaaaaaaaaaaaagtaaaaacattgaagtasaattggcaggaatgcctttattttttaatctaaaatatttaaaatgtattgtagcgtattgaagtgtccttcagataatatcccttggaactttttttttctctaattttgaagtttagtgatactctgtttttatcttaaagtgacattatctttcagtagttcagtgtttgtctctgtctctctctctttttagcctatacttcctggtatatttggcagtgtaataaatgtagctgtcagctagtataattattcccttttgtgtttaaattattggagatagaagattacatctgg

SEQ ID NO: 92951 - DNA, 601 bp, Human
agcctaggagttcaaaaccagcctgggcaacatggtgaaaccctatctctacaaaaaaatacaaaaattagccaggtatggtggtgcatacctgtagtcctagctattcaggaggctgaggtgggatgatcgcttgagcccaggaggtcgaggctgcagtgggttgtgatcgtgcccctacactccagcctgggcaacagagcaagactgtctcaacaaagaaaacaaaaaagaaagtaaagaaagtaaataaaatcctgtttcatcttttattaaattgcagattctgggatattcataytccatgtagacattatttaatatctgccagtctttgaatctcaactatttttgagtatttatagtttccatcaattcttaaaagaagctgtatgtacaattcaagttcaccatcgttactggcatttggtctgataactggctactgttaatagtggcaaacagacttaaatacaggatactttacatatgacactttacctgcctcttttaaattttaaaattattctatttaaaataatctgacattataaatttctatgagtaaattatagaatggtctattaatttttcctttagt

SEQ ID NO: 92952 - DNA, 601 bp, Human
cagaggttccagtgagccgagatcgcgccactgcactccagcctgggcaacagagcgagagtccctctcaaaaaaaaaaaaaaaaaagaatatatagacgggtcagaactgcattcacactttggttctatagaatatcaagctgttttttgatactttatttagtgatacagtggtattcccaggaggatttgtcagcacttttctgggaatgcttggaaatgactaattagcattagaaatttaaaatgttctgatatcattattttatgtatttatattttaataggatattaaggatttttttcatggtaaatttatggatatataagtaggtaatttggcttacttataatttaaggaaataaaattactagagtactctcggtagagatagcaaatcgttacctctagactcttagtattttctctgtatcaaataatgctatcgtagtaatatatattctaagtactttgaattatatttgaattatatttgaatataaaagaataaaaattcttttattcttcaacctacatttatttgccagcttatctttaatgtaactccaaatacataccaaatttttggcttcccaga

SEQ ID NO: 92953 - DNA, 601 bp, Human; identical to SEQ ID NO: 34858

SEQ ID NO: 92954 - DNA, 601 bp, Human; identical to SEQ ID NO: 34859

SEQ ID NO: 92955 - DNA, 601 bp, Human; identical to SEQ ID NO: 34860

SEQ ID NO: 92956 - DNA, 601 bp, Human; identical to SEQ ID NO: 34861

SEQ ID NO: 92957 - DNA, 601 bp, Human; identical to SEQ ID NO: 34862

SEQ ID NO: 92958 - DNA, 601 bp, Human; identical to SEQ ID NO: 34863

SEQ ID NO: 92959 - DNA, 601 bp, Human; identical to SEQ ID NO: 34864

SEQ ID NO: 92960 - DNA, 601 bp, Human; identical to SEQ ID NO: 34865

SEQ ID NO: 92961 - DNA, 601 bp, Human
ctgaggccaggactttgagaccagcctggccaacatggcgaaaccccatctctactaaaaatatagaaattagccaggagtggtggtgcatgcctgtagtcccagctacttgagaggttgaggcaggagaatctctggaaccctggaggcagaggctgcagtgagctgagattgcaacattgtgctccagcctgggcaacaagagcgaaactctgtctcaaaaaaaaaaaaaaaagttgaaaacacagggtaaaaaaagctaaaaacatgccctttaaaaactaacttgtggcctggcacmgtggcttgtaatcccaacactgggaggctgaggtggacagatctcttgagccaggagttcgagaccaacctaggcaacatagtaagactccgactgtactaaaaatacaaaagtgagctggagtggtggtgcgtgcctgtaatcccagctactcaggaggctgaggcatgagaattacctgaacccaggagggagaggttgtagtgagctgaggtagcgccattgcgctcaggcctgggtgacagagcgagactctgtctcaaaaaaataaaataaaaatataaataaaaaacaacttcc

SEQ ID NO: 92962 - DNA, 601 bp, Human
tgttttaagttagctgggcgtggtggcatgtccctgtagacccagctacttgagagactatgatgggaggattatttgagcccaagagttcaaggatacagtgagctatggtggcaccactgcactccagcctgggcaacagagtgaggtcttattgatctgtccttaaaaaagaaaaaagaaaaaattttcatatctacccttctgtagtagtttttaataggacaaaattaatcatggctttcttacatgtaatatatattagattttatcttatggttactcaattaaatatgactcwgaatttaagaattttctacttcccctatttctacctatcccacagctatggggaaaggatggtattgttaagcaaactatccctctcttaaaattttggataggattagtaatttacatagtcagatgtaggctttatactctaaaatattctgttaactatgttgttctactagacattattacaaagctttattctcttgacaggttgaaatatttgcttacttatttttcagtattcagatattcattatttttttcaactttatttatttatttattttttgagacggagtctcac

SEQ ID NO: 92963 - DNA, 601 bp, Human
ggtaatacaatatattaatgtaattttaacaagatataccatatgtttctggaatgtttttaaaaacaagtatctatttcctgttactccaaaaagttacctttgaataaactgatttagttaattcttcatttaaaagggtatatcattgtcagtgtatgaccaataaccctttccattctgttcacacatttaccctataggttctagacaatacttattttttgtttttttgttttttgtttgtttctttttttagacaaggtttcacttttgtttaccaggctggggtgcagtggcrtgatctcgggtcactgcaacctctgcctcctgggttcaaccgattctcctgcctcagcctcccgagtagctgggattacaagcatgtgccagcacacccagctaattttttgtatttttagtaaagatggggtttcaccatgttggccaggctgaccaacttgaactcctgacctcctcgaactcctgacctcaggtgatctgcccctctcggtctcccaaagtattgggattacaggcgtgagccacctcacccggccagtgtatttgtttatacattaacaatttctattaaactccc

SEQ ID NO: 92964 - DNA, 601 bp, Human; identical to SEQ ID NO: 34866

SEQ ID NO: 92965 - DNA, 601 bp, Human; identical to SEQ ID NO: 34867

SEQ ID NO: 92966 - DNA, 601 bp, Human; identical to SEQ ID NO: 34868

SEQ ID NO: 92967 - DNA, 601 bp, Human; identical to SEQ ID NO: 34869

SEQ ID NO: 92968 - DNA, 601 bp, Human; identical to SEQ ID NO: 34870

SEQ ID NO: 92969 - DNA, 601 bp, Human; identical to SEQ ID NO: 34871

SEQ ID NO: 92970 - DNA, 601 bp, Human; identical to SEQ ID NO: 34872

SEQ ID NO: 92971 - DNA, 601 bp, Human; identical to SEQ ID NO: 34873

SEQ ID NO: 92972 - DNA, 601 bp, Human; identical to SEQ ID NO: 34874

SEQ ID NO: 92973 - DNA, 601 bp, Human; identical to SEQ ID NO: 34875

SEQ ID NO: 92974 - DNA, 601 bp, Human
acatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccraacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaa

SEQ ID NO: 92975 - DNA, 601 bp, Human
ttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctamattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaag

SEQ ID NO: 92976 - DNA, 601 bp, Human
acagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgcyttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagact

SEQ ID NO: 92977 - DNA, 601 bp, Human
gggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagkgcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatga

SEQ ID NO: 92978 - DNA, 601 bp, Human; identical to SEQ ID NO: 31584

SEQ ID NO: 92979 - DNA, 601 bp, Human
tcctccctgctctgaggtcctgcctccatcatactcatttctcccctggaatcctgagctaggaccagagcaagagaaagctaacttggagtagaaaggatatgggggatgaatcccagggtagttgagggttgtgaagggaaaaatccctagaattgagaattaaggctgggcgtggtagttcatgcctgtaatcccatcactttgggaggccaggggaggaggattgctgaaggctagcagttcaagaccagcctgggcacatagggagaccctgtttctctaaaaaaaaaaaaaaaaaggccgggcgcggtggctcacacctgtaatcccagcactttgggaggctaacacgggcagatcacctgacgtcacgagttcgagaccaatctggccaacgtggtgaaaccccatctctactgaaaatataaaaattagccagtactaggaaggctgaggcaggataatcgctggaacccgggaggtggaggttgcagtgaactgagatcacgccactgcactccagactgggcgacagagcgagactccatctcaaaaaaaaaaaaagagagaaagagaattaacctcccttctttatgca

SEQ ID NO: 92980 - DNA, 601 bp, Human
atggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggtgagcaaatgttgaccccaggtagagtccaaaggtccctctttgttctcttctggcacacacatcacagagcttctatcaggctggatagtcctagacactaccaatcactcattttccaagacctccttttgccrcctcttccctataatgctgtctgatctctaggggcaccagtgtcagatgctttcttgttcacttctgatgaaaaccgaggcttctcccaagtccttactttttaatcccgtaccactgcttatccctccagcttcttctctgtgtgataaaccagaagctgcccctttatgttcctttcccacaccccaactgactttcccagctccctgtaggagtgagggcaggggagccctgattatgccctgcccttcaccaggcccttcgtgtatctatggaagagcagcggcagcggcaggagg

SEQ ID NO: 92981 - DNA, 601 bp, Human
aattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcagggagcaggtgagccagagcctgggtggtgcctaggcagaggttggggtgaggaagtgtaactgaacagactgacctctcttcctcagagtttggccaggcggaatcagcagacattgatgccagctcagctatggacacatcygagccagccaaggtgagacccaaccctgcccccatcaggtttaaagtccttgaatttagatcctcatccctctggggctgggagtatttctaccatagctaagtcctttgaggagcagagggaaacacatggatttgcatttcttacatgtaaaccttgctaaggtagcaatgctaatggtcagagttggagaaatgtcctcttgttctgtaattttcctttcttgctggtgggagcagcctgggcagttctctaggatgtcttcccaggagggaaaaaagcgggtctgggaaaaagaaa

SEQ ID NO: 92982 - DNA, 601 bp, Human
ctttcttgctggtgggagcagcctgggcagttctctaggatgtcttcccaggagggaaaaaagcgggtctgggaaaaagaaaaaggagaactgggtgtcttgagagcaggaaacctcaatgtgatggcatctgtttttctcctcagagctcaattaacagagttctcagcaggcccctctatttggttagtaataactgcattcatgctgtataaaggattttgctgacttgtcctttccttacgtcgaccagaggtgcccagatccccacacagtcagaaggcagggggcctctggcagyggcatgctcctgtccttaacacctgcttacttcctgccgctccataccctcccttgagctcacactgcctgtttgcaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagca

SEQ ID NO: 92983 - DNA, 601 bp, Human
caggctgggtgcagtggctcacgcctgtaattccagcactttgggaggctgaggcaggcagatgacgaggtcaggagttcgagaccagcctgactaacaaggtgaaaccctgtctctactaaaaatacaaaaattagccgggcgtggtggcggatgcctgtaatcacagctactcaggaggttgaggcaggagaatcacttgaagccaggaggcggaggttgcatggaaccaagatcgtgccattacactccagcctgggtgacagagcagcgagactccatctcaaaaaaaaaaaaaaaagaaaagaaagaaagaaggaaatcagagagatgaggaaagagaaaaaggaggcagggtgttgggaacattctgaggaacgtactaagtgactgatgggaaaagaaagctaggctagaaggaaaaacaggaaagagaagaacagagaagctaaaagaaaaaggaataagaaagaaataagctgggctgggcgcggtggctcacacctgtaatcccagtattttaggaagatgaagcgggacgattactttaacccaggagtctgggcaacacagcgaaaccgtctctacaaaaaatacaaaa

SEQ ID NO: 92984 - DNA, 601 bp, Human
cctcgaaagttgcatcatcactaaaagtgatgaaggtacgtgagcagcgagcaggggggttgacgggtccagtcccagcatgaggagtcaatgcagacaccgagggagcaggatcaagtctgaggacaaaagacaaggaaaaacacaaagagctgaggagagaagacaacagatacagaaagaaggaaatcaggctgggtgcagtggctcacgcctgtaattccagcactttgggaggctgaggcaggcagatgacgaggtcaggagttcgagaccagcctgactaacaaggtgaaaccckgtctctactaaaaatacaaaaattagccgggcgtggtggcggatgcctgtaatcacagctactcaggaggttgaggcaggagaatcacttgaagccaggaggcggaggttgcatggaaccaagatcgtgccattacactccagcctgggtgacagagcagcgagactccatctcaaaaaaaaaaaaaaaagaaaagaaagaaagaaggaaatcagagagatgaggaaagagaaaaaggaggcagggtgttgggaacattctgaggaacgtactaagtgactgatgggaaaagaaagctag

SEQ ID NO: 92985 - DNA, 601 bp, Human
cttttgggggccgcccttgggggaaccattcctcgaaagttgcatcatcactaaaagtgatgaaggtacgtgagcagcgagcaggggggttgacgggtccagtcccagcatgaggagtcaatgcagacaccgagggagcaggatcaagtctgaggacaaaagacaaggaaaaacacaaagagctgaggagagaagacaacagatacagaaagaaggaaatcaggctgggtgcagtggctcacgcctgtaattccagcactttgggaggctgaggcaggcagatgacgaggtcaggagttckagaccagcctgactaacaaggtgaaaccctgtctctactaaaaatacaaaaattagccgggcgtggtggcggatgcctgtaatcacagctactcaggaggttgaggcaggagaatcacttgaagccaggaggcggaggttgcatggaaccaagatcgtgccattacactccagcctgggtgacagagcagcgagactccatctcaaaaaaaaaaaaaaaagaaaagaaagaaagaaggaaatcagagagatgaggaaagagaaaaaggaggcagggtgttgggaacattctgaggaacgt

SEQ ID NO: 92986 - DNA, 601 bp, Human
gggccctgagtgggacccaagtaactgctttggctgccctgaatccaaagcctcccccagaagaacggatgggaaagttgttcccatttctggcatctctgctgctgcaccaaggaagtaagaggggagggcagagcttcaggccaccctcctggtgccacagagggccctctgcatggcgaatggccaagaggctttttctttttctttttttttttttttttgctgtctctgaacccacaaagcaaggaggggaccaggaagctagaaactcaggccagccagccccatctccaatccrtcagctcagcagcccttcagggagcatgtcctggcagcagggctgggcccctggcctgagatacatgcggtgcaggggccagactcacatgaggtcagcagtgcagggcagagctggatgcagctttgccagcttgaactgtgggctggccacacccgtattatcaggacatgccaaagaaatgctgaagacgggctcagaggagctaaggaggacggtgtgccactgagctagggccagcttgggcccctgtcgcccccttcgaggggggccccaccctaggcttggatcctatgggag

SEQ ID NO: 92987 - DNA, 601 bp, Human
aaggtcttgaatgccacaccaaggaggttgaactgagtccaggagttgatggagaacctttcaacaatttaaagcagatgaatgaagatgtttataaaaatcttaacactcgtctctaagctcctgggaagcagggatgatggctcatttctctctgtcccccctgcagtgccggcctggctgaatggctgtttccccaactataaaatgctttcaacacaagcttgatgattttctatggtccttgccacaattgttttgttttttttttaaagtatttgagagcctgacatttttcttaaaaaaaaaaaaaaaaaaaatcagggcagatttcctattcccaagggtgtcaggaaagtccaggtgcaaaccaaggttatgatgatgctgtcaggtctacatcagccaagcagggggtgctcggccttagaggagccaacaggggcttgagcttgattttctctgaattagccccattaaagctctgtaattatcgacaagcgggtgacaactctcaaaggcccattagtgaccaaccctcattatttttccgaagatgtaaacttcagtggggtcatgtgattggagcgctccaagggca

SEQ ID NO: 92988 - DNA, 601 bp, Human
tcacgcccagcacaagcccaaggtgcttttccaactcggagggctctccagggcagcggctgagcccccactctccttcccctagagcaactctgcttttctctctttttgtttcttagttgcatcctcctaagatttcagctaaacaaagtggccaaaaaaaagctttttggaccagggcagagtggcccgtgtgtgcctgtaatcccagcactttgggaggtgaaggcgggaggattgcttgagcccgggagttcaagaccagcctgagcaacgtagtgagacctacccccccgcacctcccgcaccaacaccactgtctctttttttgtaaatatattttttaagttagccgggcatggtggtgggcgcctgtagtcccagctacttgggaggctgaggtgagaggatcgtttgagcctgggaggctgaactgtgatcgcaccactgtactccagcctgggtaacagaacaagaccctgtctcaaaaaaaaaaaacttcttgggagccagtaggctttaagggagaaactatcaggatggaagtgaagaggcctagattctgtgcctgggtctgctgggccacgctgagcagctcccc

SEQ ID NO: 92989 - DNA, 601 bp, Human
aagaggcctagattctgtgcctgggtctgctgggccacgctgagcagctcccctcccctctctgagcctcatttctctaaagggaaatgaagagtttgggccatgtgctccgtaagagagcttcaccagcctctcaaaactgtgaccgagcttctatttataaactatcatttcttacagaccttccagtggagttcaaagaaattcatcagtcccttcctggtgacacactgggtgtgctgttccttcccaggaggtggtgacgggtgtcagttttccccccaggcagttggagaagatygctgccctccttggacaggggtttctgtagagccagtgcaggggcttctcccctccaggagctgggtgtcccagggggagcaggcagccgctctgtcttctggctgtccttctctggggttgggaaacaggcagaaatcagaatgtgcatttttacacttgggtgtcacaccagatcccagctcctgggagcacctggagggcaagttggtttgaatggaccagccatgtgtgtctgcatctgctgtttgttggtctcacaggtgtggccaaggcatggtccctgtgctcagggggctaa

SEQ ID NO: 92990 - DNA, 601 bp, Human
aacggtggcacctgcccaggccaggctcatctggtctcacaggggcaggcgaagcctctccaagatgcggccagggtgggacctgtgccctcctctgtccgcagctgccctgggcacgctggacttcagcctgctgtatgaccaggagaacaacgccctccactgcaccatcaccaaggccaaggtaggccccgccagcctgcccccaaattccctgccccggggtcctcaagagggcctaggtcagggaggccagaccacaccactccccaggttcctgtccaggcttttggatgtctgygctgtgtggggtgcggggccaggaaggaattcttctttaaaccttcttgaatacccaaccccaagaaatgccttggacagtcaggcattgcggggagcaaagaaacagatgagaatgggaagatgaaggcctggaccgaggaccctcgagcctggggaggggctgctgagagggaaagagaggggcagggtgatgtctgtcctgcaggccaagggagggcgggttgggtactggtgcctccaggcctcccagacgccctgaggagtggggacgccactttgcaccctggaagccgagcca

SEQ ID NO: 92991 - DNA, 601 bp, Human
gtggaggagtagagagcagcagcaggggcctcgtcacagtcccggggtctgaaggacagagcaggcatcactcccgtcccagcatgacagcgcccctcgacccagcctagctcccacgggtgtctcggggtacggaggtgggaccaccagagccactggaaagacatacgccagaacatgtggtggcccaaaggtttgtaagtgaaacgtgtcaggaaacgtggcccaaatggaaacattttaagctacaacaaacaaatgtataaggactgtaagaataagacacagcagtcaggcacckcctggtcaggccaggccaccagattcccagaactctgcacttcaggcacttggtgggaaaggtgcaaggcagggtgagggagttgggtttggaagagcagccttgtcaccttgagcacgtgttgggccactgagccaggccctgtcccagaggcagccccacagtgcagagcacagctcagatgcacccagcagacctcaaccgcttctccggcgtctcacgggggcctggcgtgcagggaagggagcaaaccctgcctgccaggccctgtgtccacacagtctccctccctctcactcc

SEQ ID NO: 92992 - DNA, 601 bp, Human
ggggttgccggctgcacccccacagatgccacagctgcctccctgcatccctgtgcaccatcccagaaggaaacaaatgcaattttcagagacaagagcctgctgaggtcagcaaagcccctctctgtccatgcttctgtgtgcctctggctgtgcacgcgtggctgggttttctgaaagaaccagagtgagagaggggtgccatcttgtggagggaccctctgtggccagtctgcttgtgtgatctctgtggactgactgggagttgtggcaaatatggccagaaatggggcctagtctyagactgtgtcccggggttatgtggatttagggtcagtgaggggcatggccactcaggaggccacgcttggtagatgggagacgggagtcaggatgacggcagggcctgagcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccgggggc

SEQ ID NO: 92993 - DNA, 601 bp, Human
gggttgccggctgcacccccacagatgccacagctgcctccctgcatccctgtgcaccatcccagaaggaaacaaatgcaattttcagagacaagagcctgctgaggtcagcaaagcccctctctgtccatgcttctgtgtgcctctggctgtgcacgcgtggctgggttttctgaaagaaccagagtgagagaggggtgccatcttgtggagggaccctctgtggccagtctgcttgtgtgatctctgtggactgactgggagttgtggcaaatatggccagaaatggggcctagtctcrgactgtgtcccggggttatgtggatttagggtcagtgaggggcatggccactcaggaggccacgcttggtagatgggagacgggagtcaggatgacggcagggcctgagcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccgggggct

SEQ ID NO: 92994 - DNA, 601 bp, Human
gcctgctgaggtcagcaaagcccctctctgtccatgcttctgtgtgcctctggctgtgcacgcgtggctgggttttctgaaagaaccagagtgagagaggggtgccatcttgtggagggaccctctgtggccagtctgcttgtgtgatctctgtggactgactgggagttgtggcaaatatggccagaaatggggcctagtctcagactgtgtcccggggttatgtggatttagggtcagtgaggggcatggccactcaggaggccacgcttggtagatgggagacgggagtcaggatgayggcagggcctgagcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccgggggcttctgtgaaaggggccatgaatgggcccagccaggagacccaggggacaagggcatctgcaggccctgtcagttccatgtccccgatttccagttca

SEQ ID NO: 92995 - DNA, 601 bp, Human
cccctctctgtccatgcttctgtgtgcctctggctgtgcacgcgtggctgggttttctgaaagaaccagagtgagagaggggtgccatcttgtggagggaccctctgtggccagtctgcttgtgtgatctctgtggactgactgggagttgtggcaaatatggccagaaatggggcctagtctcagactgtgtcccggggttatgtggatttagggtcagtgaggggcatggccactcaggaggccacgcttggtagatgggagacgggagtcaggatgacggcagggcctgagcaaagcrgggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccgggggcttctgtgaaaggggccatgaatgggcccagccaggagacccaggggacaagggcatctgcaggccctgtcagttccatgtccccgatttccagttcacaccgtttgctgttctctgc

SEQ ID NO: 92996 - DNA, 601 bp, Human
agtctcagactgtgtcccggggttatgtggatttagggtcagtgaggggcatggccactcaggaggccacgcttggtagatgggagacgggagtcaggatgacggcagggcctgagcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccrggggcttctgtgaaaggggccatgaatgggcccagccaggagacccaggggacaagggcatctgcaggccctgtcagttccatgtccccgatttccagttcacaccgtttgctgttctctgcccagggcctgaagccaatggaccacaatgggctggcagacccctacgtcaagctgcacctgctgccaggagccagtaaggtgaggggttccacctaggcctgcccaccagctgcacccgcccaccacctcaggcaatgcactctggtccttttgctttggggcctggactgggctgcg

SEQ ID NO: 92997 - DNA, 601 bp, Human
agcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcactccctccatctggaggtgtggggcccgggggcttctgtgaaaggggccatgaatgggcccagccaggagacccaggggacaagggcatctgcaggccctgtcagttccatgtccccgatttccagttcacaccgtttgctsttctctgcccagggcctgaagccaatggaccacaatgggctggcagacccctacgtcaagctgcacctgctgccaggagccagtaaggtgaggggttccacctaggcctgcccaccagctgcacccgcccaccacctcaggcaatgcactctggtccttttgctttggggcctggactgggctgcgggcacccagggaggcccacagctgccactcccctcagagtccaagcaagctgatgggacctcagccattcaactgcacacagagcacccagtctgccccacaccctgttgcctc

SEQ ID NO: 92998 - DNA, 601 bp, Human
ccctgggccaggatgttttggggaggggagattgcatcagcgttgagccatcctcactccctccatctggaggtgtggggcccgggggcttctgtgaaaggggccatgaatgggcccagccaggagacccaggggacaagggcatctgcaggccctgtcagttccatgtccccgatttccagttcacaccgtttgctgttctctgcccagggcctgaagccaatggaccacaatgggctggcagacccctacgtcaagctgcacctgctgccaggagccagtaaggtgaggggttccaccyaggcctgcccaccagctgcacccgcccaccacctcaggcaatgcactctggtccttttgctttggggcctggactgggctgcgggcacccagggaggcccacagctgccactcccctcagagtccaagcaagctgatgggacctcagccattcaactgcacacagagcacccagtctgccccacaccctgttgcctcctggggacctcacgagtcagcgttacctacctgctgatctggggaaacccctggagaatttccaggccagcattttataagaagcattctcagctggaagtta

SEQ ID NO: 92999 - DNA, 601 bp, Human
gctttggggcctggactgggctgcgggcacccagggaggcccacagctgccactcccctcagagtccaagcaagctgatgggacctcagccattcaactgcacacagagcacccagtctgccccacaccctgttgcctcctggggacctcacgagtcagcgttacctacctgctgatctggggaaacccctggagaatttccaggccagcattttataagaagcattctcagctggaagttactattaggtgcaaacaaaggactctgtggttaaataacatggggaaacattgttaaacrggtttctgtaccacaggacttctcagagcatctaacgtgttgatgggctgttccctgactctccgcaagggggatgaagtgggcagaatctgcccctcattcctacgccggatgacccaagcgtccgaccacacatgtgctcagggcaccagcacaacaggtgcatctcggacaggagagagaaaaattgctgttaaataaaagcatcaaggtgaccttgagccatggaaagtcagaacttaattagacttccttctgtgcatcctacacttcagtgctgttttatttttaatttcatgg

SEQ ID NO: 93000 - DNA, 601 bp, Human
acaggagagagaaaaattgctgttaaataaaagcatcaaggtgaccttgagccatggaaagtcagaacttaattagacttccttctgtgcatcctacacttcagtgctgttttatttttaatttcatggggcagagtctgagtttacgtggaggcctaaatgggtaggcctggggcccacagcagcccaggaggaccaccccagaaggggcccttcccccttctctagggaaggcaggactgtaggagaaatggcagtgccccaccacctactcctggggaagaaatgggctccccacacmgggtcttgatgcccttatgctgcaagaagggctcagggatatgagggccgagggcgagtatgaccagggaagtgtgctcagtgacccttcatttgtgggactggagccggcagtgcatggctgccgagttgtaggaagtccccaggactttccctagtgttttataaagagcagtctccttacaaacagctcctgaaagcaatgggagagagggattcctgtgccctttccacagtggggaacctgatgctgccacagagctggaattggaagcccaggctgtctgacctcccagcctgg

SEQ ID NO: 93001 - DNA, 601 bp, Human
aaccctaagtccacctgcagcctcagtccacttggccatgttgataacacattcacaggctccaagatgagcacgtggccatctctgggggccattgttctgtttgatacacactttgatgctaataagatcatttttctcttctccaggcaaataagctcagaacaaaaactctccgtaacactctgaaccccacatggaacgagaccctcacttactacgggatcacagatgaagacatgatccgcaagaccctgcggtgggtgagggtcccaggccgcctgctccctccccaaccccyactcccacccggcttttcctaatgaaggcaggactggagggtcagatggtcccctgtgggttcaacctcatgccagcaactccagcctgggggcttgaagaaaggcagaaaggtctgcccacgccaatggagcctggtgggtggaaaagggtcaccctggccccagtcccctgaaggtgcttcctggggcctctcagggtgctggaggtggttccctccagagaaccggctctcccagcctcctggctactcctggcactggttctgccttctcctgtcccctcttccaacctgaggaca

SEQ ID NO: 93002 - DNA, 601 bp, Human
ggggccattgttctgtttgatacacactttgatgctaataagatcatttttctcttctccaggcaaataagctcagaacaaaaactctccgtaacactctgaaccccacatggaacgagaccctcacttactacgggatcacagatgaagacatgatccgcaagaccctgcggtgggtgagggtcccaggccgcctgctccctccccaacccccactcccacccggcttttcctaatgaaggcaggactggagggtcagatggtcccctgtgggttcaacctcatgccagcaactccagcytgggggcttgaagaaaggcagaaaggtctgcccacgccaatggagcctggtgggtggaaaagggtcaccctggccccagtcccctgaaggtgcttcctggggcctctcagggtgctggaggtggttccctccagagaaccggctctcccagcctcctggctactcctggcactggttctgccttctcctgtcccctcttccaacctgaggacacttgtccatgaggacagtgcctgatatcgtgccacactctgcccctgtcagggcccaggcatcttgtgcgtctcccaccccagacca

SEQ ID NO: 93003 - DNA, 601 bp, Human
tggcctgaccttggcagcggtaggagggcttgattctgaaccagatgtgcaggcagcagataggacgtccttgggtgagggaagggcagatccgaggtttggggcctgagccactgaagcctgaggggctgtttgctgcactcagaggactcagcagggaccacgggtggacaggacgcgcaaggagcacgcttggaacatgttagacctgagtgcctgtgagatacgcagaggagacagcagagtatcctttcctagaaatggcatttgtctcaacgttatgtcagaacagatttgcccycggcctgctccagcagctacgccctctgagtcttggtctctatgtccctcttccctcccccatcctcccttgtctatggcctcaccttcacctggttcatagggctggtgaagccaggagtcccccgtgccactggggtcaagagaaatcctggggcctcagcctcccagcgttcaggacacaggcggaggcatggtcccctcgatggcacgttgtccccctaagaggactgggcaaggggcaagtttgggaggacagagcccggcggctgtccccagtgtacccagccccagtggggcc

SEQ ID NO: 93004 - DNA, 601 bp, Human
atcaaggccctcacacacaaagctctgcctgagcggcagatagcgagatctcgcaggcctggcctgatccaccaggaatggctgcctgagcactgtgttgaaaaggattctgaggtggcattggagcctagggcaaatgctaggatcgattagccatgtctgctctgggcgtgggaggtggcgaaggtggctggtggggcatgtatgtcttccctgctcaacatccctgctcacctcacaggagtctcatctccagaaagggttagatgtagccagagggactcactttggtgttaggcarggcacggttgtgggcaaaaggaggtggctggggctgcttgggagaggagcctggtagagtcctaaggggatccagggggacacagggctcaagctgggcgtgtgtgggtgggctcaagctgggtttgtctgggggggctgagggcctaggagagagggtttggggtgtgcagcagccagaaggaagaagccgggtagtctcgggagggcaaggaatggagaagcatcaggctggctggggatggggaggcctggagctgagatctgccttgagaggcaggcactggcagctgctgaggca

SEQ ID NO: 93005 - DNA, 601 bp, Human
gactcactttggtgttaggcaaggcacggttgtgggcaaaaggaggtggctggggctgcttgggagaggagcctggtagagtcctaaggggatccagggggacacagggctcaagctgggcgtgtgtgggtgggctcaagctgggtttgtctgggggggctgagggcctaggagagagggtttggggtgtgcagcagccagaaggaagaagccgggtagtctcgggagggcaaggaatggagaagcatcaggctggctggggatggggaggcctggagctgagatctgccttgagaggcargcactggcagctgctgaggcagggaaggcactggatgggctccctacttggctcccagcttctccagggtgaggaatgtaccagaactctgtcttcggggttctcctgagggagccacatccagcaccctgagaggctccaggtagcaccttcagggaactggggccacggtgacccttttccatccaccaggctccattgtcatgggcagacctttctgcctttctttgaacctccaggctggagttgcttgtatgaggttgaacgcacaggggaccatctgtccctccattcctgcct

SEQ ID NO: 93006 - DNA, 601 bp, Human
caggtattatctggatgcggtggctcatacctgtaatcccagcacttcaggaggctgaggtgggtggatcacttgaggtcaggaattcgagaccagcctggcagacatggcaaaaccctgtctctaccaaaaaatagaaaaattagactgtagtcccagctactcagaaggctgaggcaggagaatcgcttaaacccgggaggcagaggttgtagtgagccaagatcatgccactgcactccagcctgggtgacaagagtcagactctgtcaaaatcaaaatttacaggtagagttccaamttcaaggaacttagaggctggggcagacccctgaggaagcagggggccacaccaggccatgacaggataaacccgaggcagtgggcgcgcagaggggacggccaacccaccctgagggtcagaaaagccccccaggcccagaaggaccaggaatttatcaacggtgaacactgaggaggtcagaggagggtgctggagctgtggattaagggtgcgcaaaggtgtggaggtgggacccggcttcaaagccaagggaaagtccgggcgggctgtgaggaggacctggtggaagaccgtccg

SEQ ID NO: 93007 - DNA, 601 bp, Human
acctgtaatcccagcacttcaggaggctgaggtgggtggatcacttgaggtcaggaattcgagaccagcctggcagacatggcaaaaccctgtctctaccaaaaaatagaaaaattagactgtagtcccagctactcagaaggctgaggcaggagaatcgcttaaacccgggaggcagaggttgtagtgagccaagatcatgccactgcactccagcctgggtgacaagagtcagactctgtcaaaatcaaaatttacaggtagagttccaaattcaaggaacttagaggctggggcagasccctgaggaagcagggggccacaccaggccatgacaggataaacccgaggcagtgggcgcgcagaggggacggccaacccaccctgagggtcagaaaagccccccaggcccagaaggaccaggaatttatcaacggtgaacactgaggaggtcagaggagggtgctggagctgtggattaagggtgcgcaaaggtgtggaggtgggacccggcttcaaagccaagggaaagtccgggcgggctgtgaggaggacctggtggaagaccgtccgcggaagccgagcgcgccaggccgggggc

SEQ ID NO: 93008 - DNA, 601 bp, Human
aggccatgacaggataaacccgaggcagtgggcgcgcagaggggacggccaacccaccctgagggtcagaaaagccccccaggcccagaaggaccaggaatttatcaacggtgaacactgaggaggtcagaggagggtgctggagctgtggattaagggtgcgcaaaggtgtggaggtgggacccggcttcaaagccaagggaaagtccgggcgggctgtgaggaggacctggtggaagaccgtccgcggaagccgagcgcgccaggccgggggctgcagacccgtgaagggccgcttagygctaatgttaggctctgtgtgcctcgcaatctgtggccaccatgcagctctgtccttagggcaaaagcagccatagagaagcatcacggagctggcaaggctgcgttccaacaacacggtgttaatggaagctgaagtgtgaatttcatgtcattttcatgtgtcacaaaatatttttcatttcatttttctttctgctattccaaaaagtaagaaccagctgggcacggtggctcatgtctgtaatcccagcactttgggaggccaaggtgggaagatcccttgagcccaggagtttga

SEQ ID NO: 93009 - DNA, 601 bp, Human
gggaaagtccgggcgggctgtgaggaggacctggtggaagaccgtccgcggaagccgagcgcgccaggccgggggctgcagacccgtgaagggccgcttagtgctaatgttaggctctgtgtgcctcgcaatctgtggccaccatgcagctctgtccttagggcaaaagcagccatagagaagcatcacggagctggcaaggctgcgttccaacaacacggtgttaatggaagctgaagtgtgaatttcatgtcattttcatgtgtcacaaaatatttttcatttcatttttctttctgcyattccaaaaagtaagaaccagctgggcacggtggctcatgtctgtaatcccagcactttgggaggccaaggtgggaagatcccttgagcccaggagtttgagatcagcctgggcaaaatagtgagacccctgtctctatttttttgaaaaagaaattgtttaagataagggtaagagccatgcttagctcacatcccacacagagccaggcgtcgggcctgatctggcccccgggctgcagttgccaacccctgggctggcccttgctgggctgtgaaggccaccgtaggccacatgcag

SEQ ID NO: 93010 - DNA, 601 bp, Human
cgggctgcagttgccaacccctgggctggcccttgctgggctgtgaaggccaccgtaggccacatgcagccaagaacagggagggtgtgggtcagatccagccctggaagagcccttgggagggaagagatgacagaagggctgtgagttcacagtgaggccactcaccagggaccgtgaccaggcccggctgcagcagccggatgggcgggctcaggaagaggaggccaaggacggccaagagaggggtgggagcaggtgaggactgagtgaccgtcccgtccaacaggtggacaagacygaagacaagtccctggaggagcggggccgcatcctcatctcgctcaagtacagctcacagaagcaaggcctgctggtaggcatcgtgcggtgcgcccacctggccgccatggacgccaacggctactcggacccctacgtgaaaacgtgagtgtgccgtgcgcgtgaccacctgccacgtcttcacctccaaggacgggggtccgtgtgccggctccgtggtcccaggtggcaggcacccagggagtgcctgaggtacaggggcgctgtgttccctgatgggctaccttggcaactccag

SEQ ID NO: 93011 - DNA, 601 bp, Human
gtgaaggccaccgtaggccacatgcagccaagaacagggagggtgtgggtcagatccagccctggaagagcccttgggagggaagagatgacagaagggctgtgagttcacagtgaggccactcaccagggaccgtgaccaggcccggctgcagcagccggatgggcgggctcaggaagaggaggccaaggacggccaagagaggggtgggagcaggtgaggactgagtgaccgtcccgtccaacaggtggacaagaccgaagacaagtccctggaggagcggggccgcatcctcatctcsctcaagtacagctcacagaagcaaggcctgctggtaggcatcgtgcggtgcgcccacctggccgccatggacgccaacggctactcggacccctacgtgaaaacgtgagtgtgccgtgcgcgtgaccacctgccacgtcttcacctccaaggacgggggtccgtgtgccggctccgtggtcccaggtggcaggcacccagggagtgcctgaggtacaggggcgctgtgttccctgatgggctaccttggcaactccaggggttaagcatggccagcccatttcacagatggggaaactga

SEQ ID NO: 93012 - DNA, 601 bp, Human
acctgccacgtcttcacctccaaggacgggggtccgtgtgccggctccgtggtcccaggtggcaggcacccagggagtgcctgaggtacaggggcgctgtgttccctgatgggctaccttggcaactccaggggttaagcatggccagcccatttcacagatggggaaactgagggacagagaagctgagtggcttcccagggtcatgcaggtattagttatcacctgatgctatgtccaggcctctctgtgactgaggggcccaggaggggccatgagttgcaggaggggacagaaggcrgggccagtgccgggggtagccaggaggctgggggaggatgcagaggaactctgccaggcctttgcaactgcccacatttgcccagccctataatggtgctacagatgcggataagagtccacccagctctaccaacagggctgatggtgggcctggggagagacactaactcagggggccatgccaggtggcctgggccgcagagctgtggagctgtgagcctggtcaggagaggctgtgtagctctgagagccaggcaggagctggcgaccctttggagagggtgctacaggtgccaca

SEQ ID NO: 93013 - DNA, 601 bp, Human
gtgctacaggtgccacagtgactaccgtcagtgctcggggctcttcagaaactaggtaggtatgagtgtgagctcacagggagactctggaaaactgagacttggggaggaatttagttcagcagaaaggaggggcaggtgcttcagggagggggaatgacagagggatggccctgacctaggggacaccaaggacccaggtgactaaggcctcagggacatcttggcaccatgaagaggccagtactcctcgtggcacagctctaggggcaccattcccatggccatgatcatatttctstcactttaaaaattgtatgtggcaggtgcagtgagttacacttacattctgaacactttgggaggccaaggcaggaggattgcttgaggctaggagtttgagaccatcctgggcaacatagtgagacctccatctctacaaaaaaattaaaaattagcctggtgtagtggcatgtccctgtagtcctaactacttgagaggattgcttgaacccaggaatttgagaccagccttggcaacatactgagaccttgtctctacagttaaaaatagtaataaattaggctgagtgcagtggct

SEQ ID NO: 93014 - DNA, 601 bp, Human
tgcttcagggagggggaatgacagagggatggccctgacctaggggacaccaaggacccaggtgactaaggcctcagggacatcttggcaccatgaagaggccagtactcctcgtggcacagctctaggggcaccattcccatggccatgatcatatttctgtcactttaaaaattgtatgtggcaggtgcagtgagttacacttacattctgaacactttgggaggccaaggcaggaggattgcttgaggctaggagtttgagaccatcctgggcaacatagtgagacctccatctctayaaaaaaattaaaaattagcctggtgtagtggcatgtccctgtagtcctaactacttgagaggattgcttgaacccaggaatttgagaccagccttggcaacatactgagaccttgtctctacagttaaaaatagtaataaattaggctgagtgcagtggctcgtgcttgtaatcccagtactttgggaggccgaggcgcacggatcacctgaggtcaggagtttgagaccagcttggccaatatggggaaacccgtctctactaaaaataaaaaaattagctgggtgtggtggcgggcgc

SEQ ID NO: 93015 - DNA, 601 bp, Human
ggaggaccttggaaacaagatgctaagcgagagaagccagacacagacggccacgtgttgcaggactctatttctatgacgtgtccagaataggtcaacccacagaggcagagagtagatttgtggttgcaggagccaggggaagcttgaggggacatgggcagtgtgtagaatgtggtactatgaagttaaaaatgaataaatttgaactagaggaattattataacacggacagctgtcgaaaacacaacaaacgacacacacagtaggatactggtttgcgtatatatatgttttttyttctgatttgtcattgacttgaatttcacgcgtatatatccttgcaggaggatatgcaatctgaagccaaaatggtgtgatttttttttttttgagacagagtcttactctgttgcccaggctggagtgcagtggcgtgatctcagctcactgcaacgtctgcctcccaggttcaagcagttctcatccctcagcttcccaagtagctgggattacaggcatgcgccaccacgccaggctaatttttgtatttttagtagacggggtttcaccatgttggccaggctggtcttgaactcc

SEQ ID NO: 93016 - DNA, 601 bp, Human
cgatcacagctcacagcagcctcaaactcctgggctcaagcagtccttccccctcagcctcctgagtagctgggactacaggtgtgcaccaccacgcctggctagttgttttttgtattttttgtagagactgggttttgccgtattggccaggctggtctcaaactgctggactcaaacgatcctcctagctcggcctcccaaagtgctgggattacaggtgcaagccaccatgcccagctagcaccattatttttataaagctcatctctggtgatacttgccccagtttccccaggcyggaagttgaccccaggcccagctcttgagggtttgatggaaaaccccaggagtagcagtgcctgtgacaatcgctgacatgtcgagttacacgtaatatccctgagctgcgcgatggctgcgtgtgacgcgctcagcagcctgtgcggtcgctcctgttgttatctccatttcatgcctgtgaaaatggcagtaactggcagcaacgtgctgtgccaccctgggcaactcccttctctggctgtcttatgtataaccagaaggggtttcttctcaaagccacaggcaagcagaaggcact

SEQ ID NO: 93017 - DNA, 601 bp, Human
cgatcctcctagctcggcctcccaaagtgctgggattacaggtgcaagccaccatgcccagctagcaccattatttttataaagctcatctctggtgatacttgccccagtttccccaggctggaagttgaccccaggcccagctcttgagggtttgatggaaaaccccaggagtagcagtgcctgtgacaatcgctgacatgtcgagttacacgtaatatccctgagctgcgcgatggctgcgtgtgacgcgctcagcagcctgtgcggtcgctcctgttgttatctccatttcatgccygtgaaaatggcagtaactggcagcaacgtgctgtgccaccctgggcaactcccttctctggctgtcttatgtataaccagaaggggtttcttctcaaagccacaggcaagcagaaggcactgtgcagagggctcagaggtacacggcacagggcggctccgtgagccccggaggccaggaccactgtcctgacagcaagggagggagagacgccacagggcgggcctcaggggctttgcagggtgggcttgtgccagagtagggtatgctcagggagggtgctgagggatttccccagag

SEQ ID NO: 93018 - DNA, 601 bp, Human
tcttgagggtttgatggaaaaccccaggagtagcagtgcctgtgacaatcgctgacatgtcgagttacacgtaatatccctgagctgcgcgatggctgcgtgtgacgcgctcagcagcctgtgcggtcgctcctgttgttatctccatttcatgcctgtgaaaatggcagtaactggcagcaacgtgctgtgccaccctgggcaactcccttctctggctgtcttatgtataaccagaaggggtttcttctcaaagccacaggcaagcagaaggcactgtgcagagggctcagaggtacayggcacagggcggctccgtgagccccggaggccaggaccactgtcctgacagcaagggagggagagacgccacagggcgggcctcaggggctttgcagggtgggcttgtgccagagtagggtatgctcagggagggtgctgagggatttccccagagtggtcaggtgaggagggaagggcacttctggtagagaaaacagcagaacagagggcaacgctggcggaactgtccatggctgaaggtgccgaggctggagcctgtcgtggaagtctggtggctgagtgaggggtcaccagatgg

SEQ ID NO: 93019 - DNA, 601 bp, Human
cagaacagagggcaacgctggcggaactgtccatggctgaaggtgccgaggctggagcctgtcgtggaagtctggtggctgagtgaggggtcaccagatgggcacaagttgtccaggctgagggtgcagagatcccaaaacaactttccttccaggggcttgtgaaggcagggcacgcaggacccttctgtccctgctcctcacccgtcaccaaacaggccaaggacagttcacagcagacacaatataccaatacctagagaaatggccaaggagcatagtaagtaactaaggaaatccrctgtctccgggtggcgggcttaggggaatccccccaaacttttttaaaatcaggtttattgaggtacaggttgagcgtcccaaagctgtaaatccaaaaccccaaacattccaagcaccgacatgacgctcaaagggaatgcttattggcgcgtttgggatttcagatttttgaatttttgagttagggatgctgaactggtaaatatactgcaaagattacaaaatatgaaaaaatccaaaattcaaaacatctggtccaagcatttcagataatggatcctcaacctgtatcattcat

SEQ ID NO: 93020 - DNA, 601 bp, Human
cacaagtttgttgttgatgagttccccagttgaagggcgtgtggttgtttgcaatttttggtgatggtagaaagctgcaatgaacaggtttttgtgtggacatatgtcttcatttctctctcctaatcccaacttttgtccacatgcattttctagtgcttctgtaataaaccagtattatttatgccatgaaagtcacaattttaaaatatgcaaagtaaagcaactatgagatatcattttctgcctctcaaaccagcaaggagtttttaaatgatagcattcagctttgtcgcaggctactgtgtgtcaaccatgcagcctttctggagaggaactgggcagaataagctggacatgggcgtgtctttgggcggtgccttcacttctagggatgcaggttaagctggacatgggcgtgtctttgggcggtggcttcacttctagggatgcaggtattcgctggacagatgtttgttaagctccctggtgccaggcccagggagttggtcgtgggtgagaccccagagaccccagagcacattcagcagggacaaggcaattgtcatgcaattatctatgcaggaacagggtgagaagc

SEQ ID NO: 93021 - DNA, 601 bp, Human
tgggggtgtggctgggttttcaaaaggtcatggcgggatggggagggtggtcagagacggtggggaggggccgcaccaagccacagacacaggggagctgggggacccctggaaagctcttggcaggacttgtcggatgtagggctggggggagggaagtgttgaggggagtcctgggttcctcatggaggcaacagggcaaagagggggtgaggaagatggggagaaactctgtgtggggcaaggggactcgagacaccctggggccccaggaagtcttccgcccaaggcggcaagtacrgctggaaatgcggattccccccaaggaacaagaaggaaagaagagcagaggggccttgggtagagcccacaccacaccagtgatccagaggcaggcaggggaggtcaagatgcttccagagagtgaggggaaccccggatggaagggagggtcccacagagaagggaggggtcagcaaagccaggccccagagagggccaggatgacaaggactgtggggcgtgcagtgcctctgcagtcaggaggctcccggggtgtggggagagcaggctcagggacaaggagcaagcgggcgagggg

SEQ ID NO: 93022 - DNA, 601 bp, Human
ggcaaagagggggtgaggaagatggggagaaactctgtgtggggcaaggggactcgagacaccctggggccccaggaagtcttccgcccaaggcggcaagtacagctggaaatgcggattccccccaaggaacaagaaggaaagaagagcagaggggccttgggtagagcccacaccacaccagtgatccagaggcaggcaggggaggtcaagatgcttccagagagtgaggggaaccccggatggaagggagggtcccacagagaagggaggggtcagcaaagccaggccccagagaggsccaggatgacaaggactgtggggcgtgcagtgcctctgcagtcaggaggctcccggggtgtggggagagcaggctcagggacaaggagcaagcgggcgaggggacaggggccctgaagaccccagtggagctcagggggaagtgggcgagacatgtgagcatccacccatcatccactctgagcactgatcacccccatccctcctctgtccctacacctcatacccctcctggcccccggcggaggcccaggcccaggcatcagccctaacactcccttcttgccagcaggagttctgt

SEQ ID NO: 93023 - DNA, 601 bp, Human
ggggacctggccaagaagtccctggaggtcaccgtttgggattacgacattggaaaatccaacgatttcattggtaaggggacatagtgggaacaccgtctcactgtgtgcctgtcctggatcaggccacagcccctctttcctggtccatggggaaagctggagccacggaccacctgcccctaggtcaggggcctcagaccttctccagcctgacccttgtgccccaggaagagacaggcccagggatggaaggagttctgggagggtcacacagcactctgtggtggagcacagacargagacaatgatgggcagtgcctcgggctggactctgagccctagaggccccaaattcccagtgggcctggtggctgcgcatagtggggctgcccggccctttctcccctcttcaggcccccattccttgacccctgatgctgcctctgcaccctgcccctatccctgccctggtggaagagagacaggatggctgggccctgacggggccagagtgtggcatggaggtcaggtcctgttcatgctcagaacccagcgggcagtgggagaggctggccttcgagcacagaacctgggaggg

SEQ ID NO: 93024 - DNA, 601 bp, Human
gcagtgcctcgggctggactctgagccctagaggccccaaattcccagtgggcctggtggctgcgcatagtggggctgcccggccctttctcccctcttcaggcccccattccttgacccctgatgctgcctctgcaccctgcccctatccctgccctggtggaagagagacaggatggctgggccctgacggggccagagtgtggcatggaggtcaggtcctgttcatgctcagaacccagcgggcagtgggagaggctggccttcgagcacagaacctgggagggggcatgggccccaygcctgggagttgggggtccctgtgccccagctgcccctcctgtcctcctgcaggtggtgtggttctgggcatccacgccaagggggagcgcctgaagcactggtttgactgcctgaagaacaaggacaagcgcatcgagcgctggcacacgctcaccagcgagctcccaggggctgtgctcagcgactgacgcccacccgccactgctacccctgccgccacctgcgcccagcacggccggccccgggcttccccagcagccaccaaggcctgtggcccccacactgggggagatccaga

SEQ ID NO: 93025 - DNA, 601 bp, Human
acaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacgatctttgtgctttaagattttaagatgtgtcaaaggtttagtgactaaataatacagggtcatggctaatctggtggattcagctgtggggctgagatgagaaatgggatgtgtcacatgagtaaagagggcaagtygcagtgccaggttttccataggggagtaactcatttgattttcacaaacgtctcaggaggtaggaattattatcctcatttacagataggaaaaccaaggcttagtaaatggtaaggagactgccacagaaaagagctggctgagctaggatttattccaggcctgtctggttccaaaacctatggatttcccattctacttaactgggaccagttgccatgtttccttggaaaatggacacttaacgattgtttagaggctgtggtctaatcctcagagtaatttagggctgatggaca

SEQ ID NO: 93026 - DNA, 601 bp, Human
caggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccacgatctttgtgctttaagattttaagatgtgtcaaaggtttagtgactaaataatacagggtcatggctaatctggtggattcagctgtggggctgagatgagaaatgggatgtgtcacatgagtaaagagggcaagtcscagtgccaggttttccataggggagtaactcatttgattttcacaaacgtctcaggaggtaggaattattatcctcatttacagataggaaaaccaaggcttagtaaatggtaaggagactgccacagaaaagagctggctgagctaggatttattccaggcctgtctggttccaaaacctatggatttcccattctacttaactgggaccagttgccatgtttccttggaaaatggacacttaacgattgtttagaggctgtggtctaatcctcagagtaatttagggctgatggacag

SEQ ID NO: 93027 - DNA, 601 bp, Human
tgtggggctgagatgagaaatgggatgtgtcacatgagtaaagagggcaagtcgcagtgccaggttttccataggggagtaactcatttgattttcacaaacgtctcaggaggtaggaattattatcctcatttacagataggaaaaccaaggcttagtaaatggtaaggagactgccacagaaaagagctggctgagctaggatttattccaggcctgtctggttccaaaacctatggatttcccattctacttaactgggaccagttgccatgtttccttggaaaatggacacttaacrattgtttagaggctgtggtctaatcctcagagtaatttagggctgatggacagttagcaacaatgttaggtgaaaaagtccctgccattctatcttggcagagaagacagcagccatgggtcttcacaggaagaaatacagggaaaggccagtgacggatcagtgtcaatgctggatgtggcataacatcaaggtttgattataaaccctaagatagtggagctttagagaaggactttaggctatgcagagttcagaacgactctcacaagggtgtttcagagtggtgatagggaaagt

SEQ ID NO: 93028 - DNA, 601 bp, Human
ggctgatggacagttagcaacaatgttaggtgaaaaagtccctgccattctatcttggcagagaagacagcagccatgggtcttcacaggaagaaatacagggaaaggccagtgacggatcagtgtcaatgctggatgtggcataacatcaaggtttgattataaaccctaagatagtggagctttagagaaggactttaggctatgcagagttcagaacgactctcacaagggtgtttcagagtggtgatagggaaagttacaaaaggaagcagtaggggggcaagatagagggttcagsgtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaag

SEQ ID NO: 93029 - DNA, 601 bp, Human
cctaagatagtggagctttagagaaggactttaggctatgcagagttcagaacgactctcacaagggtgtttcagagtggtgatagggaaagttacaaaaggaagcagtaggggggcaagatagagggttcagggtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggatt

SEQ ID NO: 93030 - DNA, 601 bp, Human
tgcagagttcagaacgactctcacaagggtgtttcagagtggtgatagggaaagttacaaaaggaagcagtaggggggcaagatagagggttcagggtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctccttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctc

SEQ ID NO: 93031 - DNA, 601 bp, Human
tcacaagggtgtttcagagtggtgatagggaaagttacaaaaggaagcagtaggggggcaagatagagggttcagggtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagytttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctc

SEQ ID NO: 93032 - DNA, 601 bp, Human
ggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattayaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaaattcaga

SEQ ID NO: 93033 - DNA, 601 bp, Human
agttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattacargcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaaattcagatg

SEQ ID NO: 93034 - DNA, 601 bp, Human
ctcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacgrggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaaattcagatgccagcagaattaaactacgtaaatatagagacagaaagatgg

SEQ ID NO: 93035 - DNA, 601 bp, Human
tctctctttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaayaggctctctgctaaccagctcatctctgtggggcaggagccacaggttgctgtcattcatgggatttgctaccagacctcctgagtgaggattgataacttctggactgagttaggatgtgagcaagagggaaattcagatgccagcagaattaaactacgtaaatatagagacagaaagatggagtgtgggagagtgggggagagccaaaaaaacaaacacactgtggagagtcctgaagcttgtatgcagcaaagggagcttcttagatagcttcctactaacaaatatatagcttat

SEQ ID NO: 93036 - DNA, 601 bp, Human
cctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatrtgagcaagagggaaattcagatgccagcagaattaaactacgtaaatatagagacagaaagatggagtgtgggagagtgggggagagccaaaaaaacaaacacactgtggagagtcctgaagcttgtatgcagcaaagggagcttcttagatagcttcctactaacaaatatatagcttatattcatttttcagaggttggatttacttaaaataatttcatggaggtgaatggtaaacatgtatagtggagtacaaaaatatattccatgaaagatcattgttcttctaaccccaacct

SEQ ID NO: 93037 - DNA, 601 bp, Human
ggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaarttcagatgccagcagaattaaactacgtaaatatagagacagaaagatggagtgtgggagagtgggggagagccaaaaaaacaaacacactgtggagagtcctgaagcttgtatgcagcaaagggagcttcttagatagcttcctactaacaaatatatagcttatattcatttttcagaggttggatttacttaaaataatttcatggaggtgaatggtaaacatgtatagtggagtacaaaaatatattccatgaaagatcattgttcttctaaccccaacctgcaggtctgtttgtc

SEQ ID NO: 93038 - DNA, 601 bp, Human
taaaacctaccaacctggcacaccttggggcaagttgctaactttctactttctaatacctgatgtctagtgtttactaggtcagtagcttagtgaaatttagtcaacttttatttatttatttattttttgagacacagtctcgctctatcgcccaggctggagtgcagtggtgcaatcttggctcactgcaacctccacctcccgggctcagacgattctctcacctcagcctcttgagtagctgagattacaggcgtgcgcggcgatgcccagctaatttttgtacttttagtagaggcagagtttcaccatgttggtcaggctggtctcaaactcctgacctcaaatgattgcccgcctcggcctcccaaagtgctgggattacaggcgtgagccactgcatctggccttagtagaatttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacat

SEQ ID NO: 93039 - DNA, 601 bp, Human
tggcacaccttggggcaagttgctaactttctactttctaatacctgatgtctagtgtttactaggtcagtagcttagtgaaatttagtcaacttttatttatttatttattttttgagacacagtctcgctctatcgcccaggctggagtgcagtggtgcaatcttggctcactgcaacctccacctcccgggctcagacgattctctcacctcagcctcttgagtagctgagattacaggcgtgcgcggcgatgcccagctaatttttgtacttttagtagagacagagtttcaccatrttggtcaggctggtctcaaactcctgacctcaaatgattgcccgcctcggcctcccaaagtgctgggattacaggcgtgagccactgcatctggccttagtagaatttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacatatattagaagaaaat

SEQ ID NO: 93040 - DNA, 601 bp, Human
atttattttttgagacacagtctcgctctatcgcccaggctggagtgcagtggtgcaatcttggctcactgcaacctccacctcccgggctcagacgattctctcacctcagcctcttgagtagctgagattacaggcgtgcgcggcgatgcccagctaatttttgtacttttagtagagacagagtttcaccatgttggtcaggctggtctcaaactcctgacctcaaatgattgcccgcctcggcctcccaaagtgctgggattacaggcgtgagccactgcatctggccttagtagamtttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacatatattagaagaaaatctctaaaatctttagccaaagattggctaagactgaccagattaactggatagtctttgaataacgagtgtaaaatatttttgttgttattttcttacatgattg

SEQ ID NO: 93041 - DNA, 601 bp, Human
atttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacatatattagaagaaaatctctaaaatctttagccaaagattggctaagactgaccagattaactggatagtctttgaataacgagtgtaaaatatttttgttgttattttcttacatgattktggatattactgtggaaagaaatagtcttttgaagaaattctgtttattgctgttgcttgtaccagcaggatcagttgttagcaggtacactttttttttgttttttttttttgagacagtctcactctgtcgcttaggctggagtgctgtggcgcgatcccagctcactgcaacctctgcctcctgggttcaagagattctggtgcctgagcctcttgagtagctgggattacaggcgctcaccaccacccgtttaatttttgtattttagtagagatggggtttcaccatgttggcca

SEQ ID NO: 93042 - DNA, 601 bp, Human
gccaaagattggctaagactgaccagattaactggatagtctttgaataacgagtgtaaaatatttttgttgttattttcttacatgattgtggatattactgtggaaagaaatagtcttttgaagaaattctgtttattgctgttgcttgtaccagcaggatcagttgttagcaggtacactttttttttgttttttttttttgagacagtctcactctgtcgcttaggctggagtgctgtggcgcgatcccagctcactgcaacctctgcctcctgggttcaagagattctggtgcctsagcctcttgagtagctgggattacaggcgctcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggccgcaggtacactattgataagcaaatagtttattcccagccatttttggagtattcagaaaaaaaaaagataaatgattttgactctacatgacaaataattaacggcaaatttacatttt

SEQ ID NO: 93043 - DNA, 601 bp, Human
actttttttttgttttttttttttgagacagtctcactctgtcgcttaggctggagtgctgtggcgcgatcccagctcactgcaacctctgcctcctgggttcaagagattctggtgcctgagcctcttgagtagctgggattacaggcgctcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggcygcaggtacactattgataagcaaatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcctcagcctcccatgctcctatagaatgctg

SEQ ID NO: 93044 - DNA, 601 bp, Human
ttgagacagtctcactctgtcgcttaggctggagtgctgtggcgcgatcccagctcactgcaacctctgcctcctgggttcaagagattctggtgcctgagcctcttgagtagctgggattacaggcgctcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggccgcaggtacactattgataagcraatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcctcagcctcccatgctcctatagaatgctgtttgacacagtacttaatgcaa

SEQ ID NO: 93045 - DNA, 601 bp, Human
gatcccagctcactgcaacctctgcctcctgggttcaagagattctggtgcctgagcctcttgagtagctgggattacaggcgctcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggccgcaggtacactattgataagcaaatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcctcagcctcccatgctcctatagaatgctgtttgacacagtacttaatgcaaaggtctgcatagttctcttcctctccttttctgtgcagaagctgt

SEQ ID NO: 93046 - DNA, 601 bp, Human
tgagctaccgtgcctggccgcaggtacactattgataagcaaatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcctcagcctcccrtgctcctatagaatgctgtttgacacagtacttaatgcaaaggtctgcatagttctcttcctctccttttctgtgcagaagctgtcagatgaagggttgcattgtagataattcagttctgcatgtgtgtcctttgtaaggacctgaatgttatctgtcttggggccctcccttttggagcaccggggacttccatccacactcacattcaccctcccccagatcaaaccacctcgggcccccctgggcagctccagcctcttctgtggctcgtggcccagtttcagtcacctttcccct

SEQ ID NO: 93047 - DNA, 601 bp, Human
gggacttccatccacactcacattcaccctcccccagatcaaaccacctcgggcccccctgggcagctccagcctcttctgtggctcgtggcccagtttcagtcacctttcccctgttagaaggatcagtcaggtctgtgtctaatattgaaggggcctttccttcacttttcttcagcagttactccacttggagagcacacagtgagagagcacacgccagttgggaaacacattgtgtcgtatgtttaagtgcttaaaagttcataaaacatgaaatgtgttcgtttgaaaatggaayagtatcccatgcagtttttacaagtaagagatatggctggtgaattcacaacggaagatagttgtttaaattaaaaaaaacaattttttagagcagttttaggttcacagcaaaattgagaggaaggtacggagattttttttatatactccctgccccaacacatgcagagcctctcccacattaccagcatccccatcagagtggtgcatttgctagcatcgatgaacttacactgatgcatcattgtcatccagagtccgtagtttgcataggggtttgctcttgttgatgtacttt

SEQ ID NO: 93048 - DNA, 601 bp, Human
tgtgtcgtatgtttaagtgcttaaaagttcataaaacatgaaatgtgttcgtttgaaaatggaatagtatcccatgcagtttttacaagtaagagatatggctggtgaattcacaacggaagatagttgtttaaattaaaaaaaacaattttttagagcagttttaggttcacagcaaaattgagaggaaggtacggagattttttttatatactccctgccccaacacatgcagagcctctcccacattaccagcatccccatcagagtggtgcatttgctagcatcgatgaacttacaytgatgcatcattgtcatccagagtccgtagtttgcataggggtttgctcttgttgatgtactttttaatgggtttggacaaatgtgtaatagcttgtgtccattatagtattcacagcattgccactgtcctaaaaattctctgtgggattatttaaatttaagataacattttaaacattttagagttttttgcaaatttttattttattttaaatttttgtttatttaattaattttttttttttttgagacgaagtcttgatcttgtctcccaggctggggtgtagtggtgtgatct

SEQ ID NO: 93049 - DNA, 601 bp, Human
tttttagagcagttttaggttcacagcaaaattgagaggaaggtacggagattttttttatatactccctgccccaacacatgcagagcctctcccacattaccagcatccccatcagagtggtgcatttgctagcatcgatgaacttacactgatgcatcattgtcatccagagtccgtagtttgcataggggtttgctcttgttgatgtactttttaatgggtttggacaaatgtgtaatagcttgtgtccattatagtattcacagcattgccactgtcctaaaaattctctgtgggrttatttaaatttaagataacattttaaacattttagagttttttgcaaatttttattttattttaaatttttgtttatttaattaattttttttttttttgagacgaagtcttgatcttgtctcccaggctggggtgtagtggtgtgatctcggctcactgcaatctccgcctcccaggttcaagcgattttcctgtctcagcctcctgaatagctgggattacaggcatgcaccaccaaacctggctaatttttgtattttaaattagccactcccactaatttttatatttttggtag

SEQ ID NO: 93050 - DNA, 601 bp, Human
tctgtgggattatttaaatttaagataacattttaaacattttagagttttttgcaaatttttattttattttaaatttttgtttatttaattaattttttttttttttgagacgaagtcttgatcttgtctcccaggctggggtgtagtggtgtgatctcggctcactgcaatctccgcctcccaggttcaagcgattttcctgtctcagcctcctgaatagctgggattacaggcatgcaccaccaaacctggctaatttttgtattttaaattagccactcccactaatttttatatytttggtagagacagggtttcaccatgttggccaggttggtcttgaactcctgacctcaggtgctccgcctgcctcggcctcccaaaatgctgggattacaggcatgagccaccaggactggccatttatttagaggcagggtctcattctgtctcccaggctggagtgtagtggctccatcatggctcactgcatcctccaactcctaggctcaaacaattctcccacctcagcctcccgagcagttaggactacaggtgcacgctatcatgcctggctaatttttaaaatttttctttc

SEQ ID NO: 93051 - DNA, 601 bp, Human
gtatttttagtagagacgaggtttcaccatgttggccaggctggtctcgaattcctgacctcacgtgatccacccgcctcggcctcccaaagtgctgggattacaggtgtgagccaccgcgcccggtgacctctgaatttttaaggtgattaaaaattcaaatgtagtttaacgacttaagatgtaattcatataccaggtaattcatttgtctcaagtgtacaattcagtgttttttagtaaattcacagggttgtaccacagtcacaagaatctggttttggaacatttcagtcactcyccatgtactcttcgctccagccctaggcagacactaatagattttctgtctctacagaggtgtctattctggaaattttatataactggaatgataagatgtgtaaccttttgtgtcttacttctcttacttagcctgatgtttctaagtttatccatgttgtagcatgtatttttaattattattgttcctttatattagtaatatttcatcatatggatatataccacattatttttctgtttatcagctgatgaacatctgggttacttatgggttttggctattatgagtaatgtt

SEQ ID NO: 93052 - DNA, 601 bp, Human
tacttgtcacagagtttatattgaaaggaacagtatttgtggaagtaaagcaattcataaagggacctggagagagtttttctttgctgtagctgtattattggttggtagaaatattggtatctatatgaagggctaaagtaacattttggactttgggtgacatgtgtttcctgaaaacgagggagcaagaattctgttgccctaaaacttggcaggaatagttttaatctgtgagtttctttttttttctattattatactttaagttttagggtacatgtgcacaacgtgcaggttwgttacatatgtatacatgtgccatgttggtgtgctgcacccattaactcatcatttaacattaggtatatctcctaatgctatccctcccccctccccccaccccacaacaggccctggtgtgtgatgttccccttcctgtgtccatgtgttctcattgttcgattcccacctatgagtgagaacatgtggtggttggtgttttgtccttgcgatagtttgctgagaatgatggtttccagtttcatccatgtccctacaaaggacatgaactcatccttttttatggctgcatagtatt

SEQ ID NO: 93053 - DNA, 601 bp, Human
gtatacatgtgccatgttggtgtgctgcacccattaactcatcatttaacattaggtatatctcctaatgctatccctcccccctccccccaccccacaacaggccctggtgtgtgatgttccccttcctgtgtccatgtgttctcattgttcgattcccacctatgagtgagaacatgtggtggttggtgttttgtccttgcgatagtttgctgagaatgatggtttccagtttcatccatgtccctacaaaggacatgaactcatccttttttatggctgcatagtattccatggtgtwtatgtgccacattttcttaatccagtctattattgttgtacatttgggttggtttcaagtctttgctattgtgaatagtgccgctataaacatacgtgtgcatgtgccttttaatctgtgagtttctaaaattggaaaaccactgtcactcttctggggagtgaaagagaaaacccgagagttggtgaaaatggacagctgtccttcatgtggccagtgggaagagggcagttcacaaagactttcagacctggttgtagcattggggaacttttacaggtggtgacactaggtattgtc

SEQ ID NO: 93054 - DNA, 601 bp, Human
aaaaccactgtcactcttctggggagtgaaagagaaaacccgagagttggtgaaaatggacagctgtccttcatgtggccagtgggaagagggcagttcacaaagactttcagacctggttgtagcattggggaacttttacaggtggtgacactaggtattgtccttgtattgtgctgccttacgcttgctgccatagggaacttttggaaggtcacaaaggtcatctgtgtcatcagtgtcacttgcttactcagcagcatccccctggagttctttgactcacatattcctagttacytggtggtttgaggatcctgtcctgttgatcacccctcaggtacctacttacttttggagtcttgtgaatgcctttttgtcctctttttatattaattaacttatttttaaaaactctcttttattgtggtacaatatgcacaacttaaaatttatcattttaggctgggcgcagtggctcacgcctgtaatcccagcactttgggaggccgaggcgggcagatcatctgaggtcaggagttcgagaccagcctgaccaacatggcgaatccctgtctctactaaaaatacaaaaattagt

SEQ ID NO: 93055 - DNA, 601 bp, Human
actccagtctgtctcaaaaaaaaaaaaaaaaaatatatatatatatatatatatatttatcattgtaaccatttttaagcatagagttcagtggtattaggtacattcaccataatgtgcaactgtcaccaccatccatctccagaacttcccagacagaaactctgtacccattaaacgattatttcccatttacccctctcatgaactaacttatgactgaggccagtctcttatgcaagcccagctttcttgaaagttccctggcttctgaaatcacctgtagactcacatgagttamgatgattcctttgatctctgccagcatcctttcttggctctcttaactcccaaatgtttcctgtattgctgacttcttcctttgttttaagtgctgctctaacctgtgcctcttgggtaatagggggctccaaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcc

SEQ ID NO: 93056 - DNA, 601 bp, Human
ctccagaacttcccagacagaaactctgtacccattaaacgattatttcccatttacccctctcatgaactaacttatgactgaggccagtctcttatgcaagcccagctttcttgaaagttccctggcttctgaaatcacctgtagactcacatgagttacgatgattcctttgatctctgccagcatcctttcttggctctcttaactcccaaatgtttcctgtattgctgacttcttcctttgttttaagtgctgctctaacctgtgcctcttgggtaatagggggctccaaagtctrtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaa

SEQ ID NO: 93057 - DNA, 601 bp, Human
cctggcttctgaaatcacctgtagactcacatgagttacgatgattcctttgatctctgccagcatcctttcttggctctcttaactcccaaatgtttcctgtattgctgacttcttcctttgttttaagtgctgctctaacctgtgcctcttgggtaatagggggctccaaagtctgtaaaataactgaggtttatagggaacggatgcaggggactgtatactaacaccttatgcagtacactgtaaattctgtctgatgatctggactctgagcctaggagtgcccttagttgtaccrtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaacgtctgcaggcagacttca

SEQ ID NO: 93058 - DNA, 601 bp, Human
ctgaaatcacctgtagactcacatgagttacgatgattcctttgatctctgccagcatcctttcttggctctcttaactcccaaatgtttcctgtattgctgacttcttcctttgttttaagtgctgctctaacctgtgcctcttgggtaatagggggctccaaagtctgtaaaataactgaggtttatagggaacggatgcaggggactgtatactaacaccttatgcagtacactgtaaattctgtctgatgatctggactctgagcctaggagtgcccttagttgtaccgtgaagcaraggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaacgtctgcaggcagacttcatagttgct

SEQ ID NO: 93059 - DNA, 601 bp, Human
ccaaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatsacaaaaaaatccaattcggtgtttttgagtctcctatgaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaag

SEQ ID NO: 93060 - DNA, 601 bp, Human
aaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcayaaaaaaatccaattcggtgtttttgagtctcctatgaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggt

SEQ ID NO: 93061 - DNA, 601 bp, Human
cactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaamcaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttca

SEQ ID NO: 93062 - DNA, 601 bp, Human
agtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaasgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttcagaacttataaaaattgccgttaactacccgttaactctagt

SEQ ID NO: 93063 - DNA, 601 bp, Human
gaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcarcatatagtaacagatgactttcaatgttgatttcagaacttataaaaattgccgttaactacccgttaactctagtcctgaggttttaggttttatttaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggag

SEQ ID NO: 93064 - DNA, 601 bp, Human
attcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcagcatrtagtaacagatgactttcaatgttgatttcagaacttataaaaattgccgttaactacccgttaactctagtcctgaggttttaggttttatttaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatg

SEQ ID NO: 93065 - DNA, 601 bp, Human
gttgctaatctggtctcattgtacaataccactgaacatgctttccagaaaaaaatgtataagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttcagaacttataaaaattgccgttaactacccgttaactctagtcctgaggttttaggttttatytaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaa

SEQ ID NO: 93066 - DNA, 601 bp, Human
attggcagtaaggttcttagatactgcttcagccatccattgccattcagcatatagtaacagatgactttcaatgttgatttcagaacttataaaaattgccgttaactacccgttaactctagtcctgaggttttaggttttatttaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcrtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacacaaaatacaaattagttcagtgaagcagattggatttatcaaatggcaataaatgtttgctgaattgaattgatctctgctggagagtttgctgtctgagcaagatttcctccctcactcttct

SEQ ID NO: 93067 - DNA, 601 bp, Human
gcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacayaaaatacaaattagttcagtgaagcagattggatttatcaaatggcaataaatgtttgctgaattgaattgatctctgctggagagtttgctgtctgagcaagatttcctccctcactcttcttactctgttttttcattttacttctttattcgttcaacaaatgttcattctatggctgcattgagccagatcctattctaggtgcaggatatatagcagtgcatatatctctcacatggaccttatatctcttgggggctgccagggaagacagttgataaacaagtacatcaataa

SEQ ID NO: 93068 - DNA, 601 bp, Human
cactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacacaaaatacaaattarttcagtgaagcagattggatttatcaaatggcaataaatgtttgctgaattgaattgatctctgctggagagtttgctgtctgagcaagatttcctccctcactcttcttactctgttttttcattttacttctttattcgttcaacaaatgttcattctatggctgcattgagccagatcctattctaggtgcaggatatatagcagtgcatatatctctcacatggaccttatatctcttgggggctgccagggaagacagttgataaacaagtacatcaataaataagatatttgca

SEQ ID NO: 93069 - DNA, 601 bp, Human
agagcgagactctgtctcaaaaaaaattaaatacataaaaagtaaaataaaatacacaaaatacaaattagttcagtgaagcagattggatttatcaaatggcaataaatgtttgctgaattgaattgatctctgctggagagtttgctgtctgagcaagatttcctccctcactcttcttactctgttttttcattttacttctttattcgttcaacaaatgttcattctatggctgcattgagccagatcctattctaggtgcaggatatatagcagtgcatatatctctcacatggaycttatatctcttgggggctgccagggaagacagttgataaacaagtacatcaataaataagatatttgcagtaagtggtaagtgctgtaaagaaaaacaaagtgatatgatggatgtgaccaaggggacacgggctgttttaaatagggtggtcaaagaagggaggcctctctaaggaagttaagtcagagctagtcccaaatgacagtgagccattctcatcaagatctggggaaagagcatttgaggaggaaggagcagcaaggtgagactgtgctgaggcaggcagctgtgagcctg

SEQ ID NO: 93070 - DNA, 601 bp, Human
gcgcacagctgcctgtgtataccacggaaagggttgggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttccgcagtgtttgtgtccctgggtasttgagattagggattggtgatgactcttaaggagtatgctgccttcaagtatctgtttaacaaagcacagtttgcaccgcccttaatccatttaacccttagtggacacagcacatgtttcagagagcacggggttgggggtaaggttatagattaacagcatcccaaggcagaagaatttttcctagtacagaacaaaatggagtctcctatgtctgcttctttctacacagacacagtaacaatctgatctttcttttccacacatttcccccttttctattcgacaaaaccgccatt

SEQ ID NO: 93071 - DNA, 601 bp, Human
gtgtataccacggaaagggttgggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttccgcagtgtttgtgtccctgggtacttgagattagggaktggtgatgactcttaaggagtatgctgccttcaagtatctgtttaacaaagcacagtttgcaccgcccttaatccatttaacccttagtggacacagcacatgtttcagagagcacggggttgggggtaaggttatagattaacagcatcccaaggcagaagaatttttcctagtacagaacaaaatggagtctcctatgtctgcttctttctacacagacacagtaacaatctgatctttcttttccacacatttcccccttttctattcgacaaaaccgccattgtcatcatggcctg

SEQ ID NO: 93072 - DNA, 601 bp, Human
gggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttccgcagtgtttgtgtccctgggtacttgagattagggattggtgatgactcttaaggagyatgctgccttcaagtatctgtttaacaaagcacagtttgcaccgcccttaatccatttaacccttagtggacacagcacatgtttcagagagcacggggttgggggtaaggttatagattaacagcatcccaaggcagaagaatttttcctagtacagaacaaaatggagtctcctatgtctgcttctttctacacagacacagtaacaatctgatctttcttttccacacatttcccccttttctattcgacaaaaccgccattgtcatcatggcctgttctcaatgagctgttgggta

SEQ ID NO: 93073 - DNA, 601 bp, Human
tggctgctacagcgcagccagcactaggtggtcggggttttcctagttaggtgaggttatgtacatcagcgtggtcaggtgaataacggcctcccaaaagatgcctgtgccctaatccctggaacctgtgaacttggtaccttacatggcagaagggactttgcaaatgtgattgagtcaagagtcttgagatgagtgagatgatcctggattttccggatgggcacaatctaatggcatgaatccttaaaagtggagagctccctgggtgtggtagctcatgcctctcatcccagcattytgggaggctgaggctgaaggattgcttaagctcaggagtttgggaccagcctgggcaacagcgagatcaggtctctacaaaaaaaaaaaaaaaaaaaaattagccaggtgtgggggtggctgcttttagtcccagctgcttgcgaggctgaggtgggaggattgcctgaccccaggatttcaaggctgcagtgaacagtgatcatgccactgcatttcagcctgggtgacagagtgaggccacgtctcttaaaaaaaaaaaaaaaaaagggcaggggaagtgtggacagaacctttcctg

SEQ ID NO: 93074 - DNA, 601 bp, Human
tgcttaagctcaggagtttgggaccagcctgggcaacagcgagatcaggtctctacaaaaaaaaaaaaaaaaaaaaattagccaggtgtgggggtggctgcttttagtcccagctgcttgcgaggctgaggtgggaggattgcctgaccccaggatttcaaggctgcagtgaacagtgatcatgccactgcatttcagcctgggtgacagagtgaggccacgtctcttaaaaaaaaaaaaaaaaaagggcaggggaagtgtggacagaacctttcctggctgcaactagagatgccatgasagaagacacaggagagtttccaggcttgacagagacttgacctgctattgctggctttgaaggtggaggaagggaacccctcagccaaagaatatgggaggcctctacaggctagcaacagccctcagctgacagccagcaaggaatgggacctagtcctactaacacacagggagctgaattctgccaactaactgattgagcaaagaaacagtccctgctagaggctccagaaagaaatgtagccccacagacaccttgacagagactggcgtcagatttcggacccacagaactcta

SEQ ID NO: 93075 - DNA, 601 bp, Human
aaagggcaggggaagtgtggacagaacctttcctggctgcaactagagatgccatgacagaagacacaggagagtttccaggcttgacagagacttgacctgctattgctggctttgaaggtggaggaagggaacccctcagccaaagaatatgggaggcctctacaggctagcaacagccctcagctgacagccagcaaggaatgggacctagtcctactaacacacagggagctgaattctgccaactaactgattgagcaaagaaacagtccctgctagaggctccagaaagaaatgyagccccacagacaccttgacagagactggcgtcagatttcggacccacagaactctaagatagtcaatttgtgtcatttacgccactaaatttctggtgatttgttaacacagtgaaagatgactaatgcaactggtatagtttataatctagatttcccttgttagtggggttgaacatcgttccgtatgtttaaaggccatttgtattttattctctgaaccatctatgtcctttgcccatttctctattgatcccggccaacatcaagaatttccttatttattgtggagattggcc

SEQ ID NO: 93076 - DNA, 601 bp, Human
gggagctgaattctgccaactaactgattgagcaaagaaacagtccctgctagaggctccagaaagaaatgtagccccacagacaccttgacagagactggcgtcagatttcggacccacagaactctaagatagtcaatttgtgtcatttacgccactaaatttctggtgatttgttaacacagtgaaagatgactaatgcaactggtatagtttataatctagatttcccttgttagtggggttgaacatcgttccgtatgtttaaaggccatttgtattttattctctgaaccatctrtgtcctttgcccatttctctattgatcccggccaacatcaagaatttccttatttattgtggagattggccctttttgatatgaggtgcaagtttcccccgactatttggtattttaaaccaggaaactatatgagactggcgggggacagactgcggggtgataagagtcccaggactgagtcctcgtcactgcactctttggaggacaagcagaggagcagagaagcctgtaacttttccacttcctgttggtaggccattcttcagtccaaatgaaaatggccatagaatggctaaa

SEQ ID NO: 93077 - DNA, 601 bp, Human
atgaataaaataataatatctatctaggatatcttgtagaattgttagagtgctcatttttttcttaagatatgtatggtacttaatttttcataaatatatatgatatatatgaaatataaggtatttatgaaaaatacctttgtacactgtgatgaagtacatgaacaagtcatagagctcacatttcagatattaataggaggagcagatgaatgagcccggatatgatttatcctgtagcaataaacaagtttttgcaaaaatgaagctacctgaacagatacaacaagaattacakctttgggtgaggattacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccaaggtgggcggatcacctaaggtcaggag

SEQ ID NO: 93078 - DNA, 601 bp, Human
caataaacaagtttttgcaaaaatgaagctacctgaacagatacaacaagaattacatctttgggtgaggattacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcayacctgtaatcccagcactttgggaggccaaggtgggcggatcacctaaggtcaggagttcgagaccagcctggccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgt

SEQ ID NO: 93079 - DNA, 601 bp, Human
tacctgaacagatacaacaagaattacatctttgggtgaggattacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccmaggtgggcggatcacctaaggtcaggagttcgagaccagcctggccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgttttataaccacacaaatactcaggactct

SEQ ID NO: 93080 - DNA, 601 bp, Human
tctttgggtgaggattacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccaaggtgggcggatcacctaaggtcaggakttcgagaccagcctggccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgttttataaccacacaaatactcaggactctgagattgggacgttacctttagcagaac

SEQ ID NO: 93081 - DNA, 601 bp, Human
tacataacccatcacatttccctacacccccagttgccaggaatctcagagacacatcttaatgctcaaacattgtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccaaggtgggcggatcacctaaggtcaggagttcgagaccagcctrgccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgttttataaccacacaaatactcaggactctgagattgggacgttacctttagcagaacaggtaaagcaccatc

SEQ ID NO: 93082 - DNA, 601 bp, Human
ctaggtgtgtcacactgtgatccattgtaaaagggactcatttacctcatggtggggatagtattttaaagtgtttagtttcagaagttttccttcttgaaaacactcaaaacttgtgtttacttgaaaataaacagtgtcagatttttcattaggggcaaaacagaaagcaacgagagagtctcaaggacgctattgggctgatacactgataccaaatgcagtggatgggcaaggaagtaacaagcggaagcaatgtatgtacacggtgcataattcctctttagtgagtttgagatgygtgtgagactgtcccatggcttcccaccccaggagctgctaccttgtagagtccagtcatccacttgatgagggtggtgttcattttccttatcaccctctccctcaatttttatctgagagatggaattatgagttacaggaggaaggagtaagaggcacatcaaagcctttttgtgtggctttgaataagcggccttattggtttggggttgttagctttgggtgtgctattttcatcatgaagcacctggggtttgtttttttctaaaagatgtagataaactagagagaatccagg

SEQ ID NO: 93083 - DNA, 601 bp, Human
tcacattagtttgtgtttccaggatgcaggatggtaggaggaagaagtgacgtttgtcaaactgaagatccacacacgactatgaatcacgttttcctaattcctctctgggaagccaggagagcgggcagtgctttattctgtgcctcctaagcatgcagtcggtttaattctcaactctttggcattatgttttcataggtggtagtaataattataacccgagtagctctcatttaccgagtgtctgccttgtggcaggtgttgtcttagctgctttgttatttatattttcatttawtctttacggcaactctgtaaataggaagtatgtttttccaattatagggaaattgaggtttagtaacttccacaagatggcatgtgtattaagtggtggaggtggaactcaaacccgggtctgtgacccacagcccatgctcatgccctacatcgggctccattactctgtcattgtggtcatgagagtagtaactgggacccagtaggtggccaggtggtttgtatcttggtacaagggtaagtaaaatagttgatgtccaaggctccctttgctttctttttctcttattttcctttc

SEQ ID NO: 93084 - DNA, 601 bp, Human
aattatagggaaattgaggtttagtaacttccacaagatggcatgtgtattaagtggtggaggtggaactcaaacccgggtctgtgacccacagcccatgctcatgccctacatcgggctccattactctgtcattgtggtcatgagagtagtaactgggacccagtaggtggccaggtggtttgtatcttggtacaagggtaagtaaaatagttgatgtccaaggctccctttgctttctttttctcttattttcctttcttgagatatattttctctgtaagtgctgtgttattaacayactacattttatcattctgtaaattaagttatactatatgcttttagtcatctttgtggttatatagtgatatgtacaatctcacttaggaaatcaacaattgttgttttttattttgagacagggtctctatcgcccaggctggagtgcagtcgtgtgatcacagctcactgcagccttgacttcctgggctcaagcagtcctcccacctcagcctcctgattagctgggactacaggcgcaagccaccatgcccggctaagttttgtatttttttgtagagatggggttttaccatgt

SEQ ID NO: 93085 - DNA, 601 bp, Human
caaccttacaaggttatcgtaggtagcgtttgaaagaatatacataaaatgttgtttatgaattgcagagtatacttaaatgaaaaatgttaagtttaaaagttagcatcggctgggcacgttggctcatgcctataatcccagcactttggaaggccaaggcaggtagatggcttgagcccaggagtttgagatcagcctgggcaacatggtgaagccccattcctacaaaaaataaaaaaattagctgggtatggtggcacacacctgtggtctcagctacttgggagatgcaggtggkaggatcacctgagcctggggaggttgaggctggagtgaaccatgatcgtgccacctcactccagcctgggtgacagagtgagacactatctgaaaaaataataataataaaaataaaagttagcatcctttatattagcagcttttttcttagtgcagcttctcttggtaaaactctgatatagtttagggatggttgaggcttctgaggaagttgacatccaaaggaccttgttagatttttatccgggggcggaacagaaagtactaagtgaatttcaaggatattctactaaggcca

SEQ ID NO: 93086 - DNA, 601 bp, Human
tccgtcataattttttcactaagcttagctcttcagctgtgaaatccttttagccacagcattgtagtctcttctcagaaggttaagctttctgatacttttttagtctgtcacttttctggtctctgttgggtccaagaaagaacccctggtgagtctaaaggctttgcttattttgttctttaagcttaggttcccatatttctcattttcttgacttttttttttttttttttttgagacagggtcttactccattgcccacgctggagtgcagtggtgtgatcatggctcactgcaycctctagtcctggggctcaggtgattctccaacctcagcctcccgagtagctggaactacaggtgcacaccgccaagtgtggctaattttttttgtgtgtatgtagaaacagggtttctccatgttgcccaggctggttttaaactcctgggctcagctgatcctcctgacacccaaagtgcggggattacagttgtgagccattgtgcccatacattcaagccttttaaaactgtattattgggtttcagggggtctttgaacccaaggtctggctctgttgcccaggctggagtgcaa

SEQ ID NO: 93087 - DNA, 601 bp, Human
ggttttgccacgttgcccaggctagtcttgaattattgagctcgagcaattctccaccttggcctcccaaagtgctgggattacaggcatgaaccggtagcccggctggtctttgaactcttttttttttttgagactgagtcttgccctgtcacccaggctggagtgcagtggcacaatctcggctcactgcaagctccgcgtcccgggttcacgccattctcctgcctcagcctccagagtagctgggactacaggcatgcgccaccacgcccggctaattttttttttttttttttttggtagagacggggtttcaccgtgttagccaggatggtctcgatctcctgacctcgtgatccgcccgcctctgcctcccaaagtgctgggattacagacgcgagccaccgcgcccggctaactttttgtatttttagtagagacggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcc

SEQ ID NO: 93088 - DNA, 601 bp, Human
tattgagctcgagcaattctccaccttggcctcccaaagtgctgggattacaggcatgaaccggtagcccggctggtctttgaactcttttttttttttgagactgagtcttgccctgtcacccaggctggagtgcagtggcacaatctcggctcactgcaagctccgcgtcccgggttcacgccattctcctgcctcagcctccagagtagctgggactacaggcatgcgccaccacgcccggctaattttttttttttttttttttggtagagacggggtttcaccgtgttagccaggwtggtctcgatctcctgacctcgtgatccgcccgcctctgcctcccaaagtgctgggattacagacgcgagccaccgcgcccggctaactttttgtatttttagtagagacggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgt

SEQ ID NO: 93089 - DNA, 601 bp, Human
ttgccctgtcacccaggctggagtgcagtggcacaatctcggctcactgcaagctccgcgtcccgggttcacgccattctcctgcctcagcctccagagtagctgggactacaggcatgcgccaccacgcccggctaattttttttttttttttttttggtagagacggggtttcaccgtgttagccaggatggtctcgatctcctgacctcgtgatccgcccgcctctgcctcccaaagtgctgggattacagacgcgagccaccgcgcccggctaactttttgtatttttagtagagamggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgtgacctaaaaagtattaagaaccactgctttgagtttaaaacgatggcccttttccaacaactaccatttcttgttatattttcttcatctctctatatacctatttacat

SEQ ID NO: 93090 - DNA, 601 bp, Human
agctccgcgtcccgggttcacgccattctcctgcctcagcctccagagtagctgggactacaggcatgcgccaccacgcccggctaattttttttttttttttttttggtagagacggggtttcaccgtgttagccaggatggtctcgatctcctgacctcgtgatccgcccgcctctgcctcccaaagtgctgggattacagacgcgagccaccgcgcccggctaactttttgtatttttagtagagacggggtttcaccgtgttagccaggatggtctcaatctcctgacctcgtgatycgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgtgacctaaaaagtattaagaaccactgctttgagtttaaaacgatggcccttttccaacaactaccatttcttgttatattttcttcatctctctatatacctatttacatttttctattgatttctgagtaaataggaagcagactttatattatttgaga

SEQ ID NO: 93091 - DNA, 601 bp, Human
gatctcctgacctcgtgatccgcccgcctctgcctcccaaagtgctgggattacagacgcgagccaccgcgcccggctaactttttgtatttttagtagagacggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgtgacctaaraagtattaagaaccactgctttgagtttaaaacgatggcccttttccaacaactaccatttcttgttatattttcttcatctctctatatacctatttacatttttctattgatttctgagtaaataggaagcagactttatattatttgagacccttctaaaaataacttactgaggtataatttacatgccataaaactcaccatctttttttttgtgatggcatctcactctgtcacccaggctggagtgcagtggcttgatttcggctcactgcaacctctgcctcccaggttcaa

SEQ ID NO: 93092 - DNA, 601 bp, Human
caccatctttttttttgtgatggcatctcactctgtcacccaggctggagtgcagtggcttgatttcggctcactgcaacctctgcctcccaggttcaagggattctcctgcctgagcctcccgagtagctgggattacaggcgcccgccaccatgccaggctaattttttgtatttttagtagagatggggtttcaccatgttggccaggctggtctcgaactcctgaccttgtgatccacccgccttggcctcccaaagtgctgggattacaggcgtgagccagtgcgcccggccaaarctcactatcttaaggtgatgtttaatatattcacagagttgggtaaacatcaccactatcaaattttaaaacattctcataccatctccaaaaaactcatacccattactggttactgggtttcttcccccagcctctggtaaccactagcctactttctatctgtataggtttgcctattccagacatttcatgtaaatggaatcatacactgtgggattatttgtgtctgacttcttccacttagcatgtttttgaggttcatccgtgttgtagcatgtttcaggacatcaggacttc

SEQ ID NO: 93093 - DNA, 601 bp, Human
gcaacctctgcctcccaggttcaagggattctcctgcctgagcctcccgagtagctgggattacaggcgcccgccaccatgccaggctaattttttgtatttttagtagagatggggtttcaccatgttggccaggctggtctcgaactcctgaccttgtgatccacccgccttggcctcccaaagtgctgggattacaggcgtgagccagtgcgcccggccaaaactcactatcttaaggtgatgtttaatatattcacagagttgggtaaacatcaccactatcaaattttaaaacatkctcataccatctccaaaaaactcatacccattactggttactgggtttcttcccccagcctctggtaaccactagcctactttctatctgtataggtttgcctattccagacatttcatgtaaatggaatcatacactgtgggattatttgtgtctgacttcttccacttagcatgtttttgaggttcatccgtgttgtagcatgtttcaggacatcaggacttctttttattacttatcagtattttattgtatgaatatacaacatttcgtttactcatcagttaatggaaaacattt

SEQ ID NO: 93094 - DNA, 601 bp, Human
tgcagtttgctgacggctaatgacgttgtgcatcttctcatgcactttgtgccatttttgtctgtcttctttagagaaaatggttattcaagtcctttgcccatttgtaagttttttttgtttgtttttttaagtttgaattgtaaaacacatttctataagcattttttttttttgagatggagttttgcgcttgttgcccaggctggagtgcagtggcgcaatcttggctcaccataacctccacctcccgggttcaagtgattctcctgcctcagactcctgagtagctgggattacrggtgcctgccaccacgcccagctaattttttgtattttcttttttttttttagtagagatggggtttcatcttgttggccaggctggtctcgaactcccgacctcaggtgatccacccgccttggcctcccaaaatgttgggattacaggcgtgatccaccgcgcccagcctctatagacatttaatgttcttaggttatcgctaggtcttgtgaatgagtgaaataaaggaagggaaaccctttagcttggcagtggcaaaggtgaggtgaaaggcagtggaaaggtgttttaataact

SEQ ID NO: 93095 - DNA, 601 bp, Human
ccgggttcaagtgattctcctgcctcagactcctgagtagctgggattacgggtgcctgccaccacgcccagctaattttttgtattttcttttttttttttagtagagatggggtttcatcttgttggccaggctggtctcgaactcccgacctcaggtgatccacccgccttggcctcccaaaatgttgggattacaggcgtgatccaccgcgcccagcctctatagacatttaatgttcttaggttatcgctaggtcttgtgaatgagtgaaataaaggaagggaaaccctttagctwggcagtggcaaaggtgaggtgaaaggcagtggaaaggtgttttaataactgggggaatggccttctaataccttttaagtattgtattgtccatttggagagactaaggctaaagatgacctgcagggagagaacagacaatgcatagatttggaagtgagaaaaagaaaagaagagaaaaagttcaccttctagtactccccccaaaattcaattagtaggggaaaagaaatataggaagtgggcatatttaacttggaagtggaaagtacctaaaagctctcaaggaaataaattatt

SEQ ID NO: 93096 - DNA, 601 bp, Human
aggaaataaattattcctacagagtatggtgaccatgtattttgtatttctcttaagattaaacgaggaaacaaatttaaaatgtagtccttttggtaagtgagattttagcattggcatggtgctctctcagctttgaataggggatagaatctcttttctcctcatgtgtatgattctctttgaaggtaatgaatgagtcaacaatacctcttgaaattttttcccagtcttgagattctattaaatcattttgttttgttttttgagatggtgtaagttttgattcatggatcagaayatcaggatcatttgaatagttctcagaaaaatcatagcgccttcatctaatatttatacagttgagatatagattgggtccctttttatatctagatctagttcttgctttgtttccccttcattgtcattttcagccctttatttgtttctgaacttgtatataagtttattttacacaatcttaatatatacagcaaatgtgtatgaggcacacacaagccttaaatacatgtctgtgcatgctatgttagatattcttgttaatgatggcaactgccataaactccctgctcctagt

SEQ ID NO: 93097 - DNA, 601 bp, Human
tacagagtatggtgaccatgtattttgtatttctcttaagattaaacgaggaaacaaatttaaaatgtagtccttttggtaagtgagattttagcattggcatggtgctctctcagctttgaataggggatagaatctcttttctcctcatgtgtatgattctctttgaaggtaatgaatgagtcaacaatacctcttgaaattttttcccagtcttgagattctattaaatcattttgttttgttttttgagatggtgtaagttttgattcatggatcagaacatcaggatcatttgaayagttctcagaaaaatcatagcgccttcatctaatatttatacagttgagatatagattgggtccctttttatatctagatctagttcttgctttgtttccccttcattgtcattttcagccctttatttgtttctgaacttgtatataagtttattttacacaatcttaatatatacagcaaatgtgtatgaggcacacacaagccttaaatacatgtctgtgcatgctatgttagatattcttgttaatgatggcaactgccataaactccctgctcctagttagaaaaagggccatga

SEQ ID NO: 93098 - DNA, 601 bp, Human
aggcacacacaagccttaaatacatgtctgtgcatgctatgttagatattcttgttaatgatggcaactgccataaactccctgctcctagttagaaaaagggccatgatgcctgaaaggaatttggaacaaagcagtacccctttcttcaaatcttgatgccttaatttcttgagtgaaatttaggtatgcatcctctctgtggacacaaaaggaacttccttcttggctgtcttggccttccttcctctcttcttgggacttgtcataaccctgtattaaaaacaataacaacaacaasaagttaatcttttttttttttttttttttttttgagatggagtctcgctctgtcaccccagctggagtgcagtggcgctatctcacttcactgcaagctccacctcccgggttcatgccattctcttgcctcagcctcttgagtagctgggactacgggtgcccgccaccacgcccggcaaattttttgtattttttttagtagagacggggtttcaccatgttagccaggatggtctgaatctcttgaccttgtgatccacccacctcagcctcccaaagtgctgggattacaggcgtg

SEQ ID NO: 93099 - DNA, 601 bp, Human
gtctcgctctgtcaccccagctggagtgcagtggcgctatctcacttcactgcaagctccacctcccgggttcatgccattctcttgcctcagcctcttgagtagctgggactacgggtgcccgccaccacgcccggcaaattttttgtattttttttagtagagacggggtttcaccatgttagccaggatggtctgaatctcttgaccttgtgatccacccacctcagcctcccaaagtgctgggattacaggcgtgagccaccgcgcccggccaacacttaatcttaaaacctgtatrtttgtaggagtatgtgcttgtcgttctgatagtggcccttccctcattgtaaattttaaaaaacatgtctttattctcttactcttaaaaccagtattgtttccgtggtggaataaaccttgagaattgtgggtgaggctagtggttgacgcagttacagatgataccaggtgctgcccacagactttgcaaactcactttccacagatagggctcccagacctgggcctgacagctttagagtctttgtccttctctgacacaggctggaccctccccacagagattttcctaggttct

SEQ ID NO: 93100 - DNA, 601 bp, Human
gcccggccaacacttaatcttaaaacctgtatatttgtaggagtatgtgcttgtcgttctgatagtggcccttccctcattgtaaattttaaaaaacatgtctttattctcttactcttaaaaccagtattgtttccgtggtggaataaaccttgagaattgtgggtgaggctagtggttgacgcagttacagatgataccaggtgctgcccacagactttgcaaactcactttccacagatagggctcccagacctgggcctgacagctttagagtctttgtccttctctgacacaggcyggaccctccccacagagattttcctaggttctgcatctattttgattactgtcacatagtttttgatacttgagaggtatcaagaccttgtgaggtaaaatttcagaaagcatgttaggtttctggtgatccagatgtacaaattctgtacaatgaagatcaccaaatgaggaaaatgaaaatatatggatgatggtgtgactatagttgtgggccagttagatagcttctgtcatgctgtttgtgtcttggttgccatagagacattttagctaacaagcccagcatggctctttgtag

SEQ ID NO: 93101 - DNA, 601 bp, Human
tgtcttggttgccatagagacattttagctaacaagcccagcatggctctttgtagtcatttctttcagttcagatttgattttcttttcaggtaagattttgagacacgtgcatgtgtgtgtatgtatgtatgtatgtgtacgtatgtgtgtgtgcatatatagtgtatgtacacacacatatatatttacgctcatatcccaagttaccagagccttcagggcttttgaactgctggaaaatagctgcgtccggtgtttaaaagccagaagcccctgtctctggccaaaaagaggtgcyacatgtgattggcagagctgtgtcacctgcctggctgggaactcgagttcccgcccctacactggggatgctggagttgacacagtatggcatgctttgctgcacccttttatccctgtggttagtggtagatttggtggagcagttagccctagggacacaattgagagctgggtgacaggtcttcttacctggttccgagtagcttgtgtatatcctttgagaacagcacaacatagttaggttagcagcagctggcagtgaggctgcagtttccaagtacagagctgaacaagaagc

SEQ ID NO: 93102 - DNA, 601 bp, Human
actggggatgctggagttgacacagtatggcatgctttgctgcacccttttatccctgtggttagtggtagatttggtggagcagttagccctagggacacaattgagagctgggtgacaggtcttcttacctggttccgagtagcttgtgtatatcctttgagaacagcacaacatagttaggttagcagcagctggcagtgaggctgcagtttccaagtacagagctgaacaagaagccagaatttagagggagctgcttccaggataaggtagaagagccacaagtcaggggctttgkgccagtgggaagtgacctggggccaaatcatgactctcagccactgccttacctgacattccctgctgaaaaggggaaaaggcctagaccatcacagtctgtctttggagcttaagaacttgacctctttgcttgacacactcccatgtgagtgcttaaagttagtagtcatttatattcttttccaggaaactgctaggttgactcctcgtcaataggcttttttttttttaatctattgagacagagtcttgccctatcatccagtctggagtgcagtggtgaaatcatagctgacta

SEQ ID NO: 93103 - DNA, 601 bp, Human
ctgggtgacaggtcttcttacctggttccgagtagcttgtgtatatcctttgagaacagcacaacatagttaggttagcagcagctggcagtgaggctgcagtttccaagtacagagctgaacaagaagccagaatttagagggagctgcttccaggataaggtagaagagccacaagtcaggggctttgtgccagtgggaagtgacctggggccaaatcatgactctcagccactgccttacctgacattccctgctgaaaaggggaaaaggcctagaccatcacagtctgtctttggakcttaagaacttgacctctttgcttgacacactcccatgtgagtgcttaaagttagtagtcatttatattcttttccaggaaactgctaggttgactcctcgtcaataggcttttttttttttaatctattgagacagagtcttgccctatcatccagtctggagtgcagtggtgaaatcatagctgactacaacccccacctcctgagctcaagtgatccttccccactcagcctcctgagtagctgggtctataggctcgtgccactatgcccagctattttaaaatgttttgtagaga

SEQ ID NO: 93104 - DNA, 601 bp, Human
tcctttgagaacagcacaacatagttaggttagcagcagctggcagtgaggctgcagtttccaagtacagagctgaacaagaagccagaatttagagggagctgcttccaggataaggtagaagagccacaagtcaggggctttgtgccagtgggaagtgacctggggccaaatcatgactctcagccactgccttacctgacattccctgctgaaaaggggaaaaggcctagaccatcacagtctgtctttggagcttaagaacttgacctctttgcttgacacactcccatgtgagtgmttaaagttagtagtcatttatattcttttccaggaaactgctaggttgactcctcgtcaataggcttttttttttttaatctattgagacagagtcttgccctatcatccagtctggagtgcagtggtgaaatcatagctgactacaacccccacctcctgagctcaagtgatccttccccactcagcctcctgagtagctgggtctataggctcgtgccactatgcccagctattttaaaatgttttgtagagatggggtctcgccatgttgctcaggttggtctggaacttctgacct

SEQ ID NO: 93105 - DNA, 601 bp, Human
caagaagccagaatttagagggagctgcttccaggataaggtagaagagccacaagtcaggggctttgtgccagtgggaagtgacctggggccaaatcatgactctcagccactgccttacctgacattccctgctgaaaaggggaaaaggcctagaccatcacagtctgtctttggagcttaagaacttgacctctttgcttgacacactcccatgtgagtgcttaaagttagtagtcatttatattcttttccaggaaactgctaggttgactcctcgtcaataggcttttttttttttaatctattgagacagagtcttgccctatcatccagtctggagtgcagtggtgaaatcatagctgactacaacccccacctcctgagctcaagtgatccttccccactcagcctcctgagtagctgggtctataggctcgtgccactatgcccagctattttaaaatgttttgtagagatggggtctcgccatgttgctcaggttggtctggaacttctgacctcaagcagtcctcccgccttggcctcttgaagtgctgagattacaggcatgaccgctgtgcccaggtaacaggtgtct

SEQ ID NO: 93106 - DNA, 601 bp, Human
gtcctcccgccttggcctcttgaagtgctgagattacaggcatgaccgctgtgcccaggtaacaggtgtctgagaatgtctatcagccagactccacggctcccttttccccttctgacacggcatggtagacaagtgtgaggtctcagaagaggctgcctcagccatggtcccacttccagttacatgtgtgtcctcagacttgctcagaagaggctgcctcagccatggtcccacttccagttacatgtgtgtcctcagacttgccacttgaacctctctgggtgtagaaacaagggawgaaattacctccaaggacttctctgtggtcacattctgtgaaaggctattggatttaattctctgtggttcaccttccctgactttggtaaaaatgatggttgaaagaatggatgaatttttatttgtagaatcaccttcttttaatgtcaaagaagctttattccaaaggaataaaaaaattgagtggtctcgttcccaggatatacatacactctgctgaacaggttttgaaccgtgtaataccttagaggtatgtctcacccccctggagggtgcagtaagggttctgaaggaggcg

SEQ ID NO: 93107 - DNA, 601 bp, Human
ggatcacctgaggtcaggagttcgagaccagcctggccaatatggtgaatccctgtctctactaaaaatacaaaattgcctgggcatggtggcgcatgcctgtaatcccagccattcaggaggctgaggcaggagaattgcttgaacctgggaggcagaggttgcagtgagctgagattgtgtcattgcactccaacctgggcaaccagcaaaactcagtctcaaaaaaaaaaaaaaaaaaagaaaagaaaaggaaaaaaagtatacttgggtagcttgccatgtgctaaggaccagcggycttccccacccttgccgctgcatcatcagtgcccgtcaccacagcaaaaaaggcaaattacatctttatgttattgcaaaaatacttctgacctcttgggccctcagaaggaagttgtaggcgaggacctccaaccacattttgacagctgctgcgataagatgtaagggtgtgatttcttgacatcaaagcaccaagcttgaatgggtttaaagcagttctcaacttgctctgcctgggtcccattgcgggaggctgtcacgcaaagtggtctggggtgtggcctgatcatggggaatt

SEQ ID NO: 93108 - DNA, 601 bp, Human
gagttcgagaccagcctggccaatatggtgaatccctgtctctactaaaaatacaaaattgcctgggcatggtggcgcatgcctgtaatcccagccattcaggaggctgaggcaggagaattgcttgaacctgggaggcagaggttgcagtgagctgagattgtgtcattgcactccaacctgggcaaccagcaaaactcagtctcaaaaaaaaaaaaaaaaaaagaaaagaaaaggaaaaaaagtatacttgggtagcttgccatgtgctaaggaccagcggtcttccccacccttgcckctgcatcatcagtgcccgtcaccacagcaaaaaaggcaaattacatctttatgttattgcaaaaatacttctgacctcttgggccctcagaaggaagttgtaggcgaggacctccaaccacattttgacagctgctgcgataagatgtaagggtgtgatttcttgacatcaaagcaccaagcttgaatgggtttaaagcagttctcaacttgctctgcctgggtcccattgcgggaggctgtcacgcaaagtggtctggggtgtggcctgatcatggggaattctatagaccccccccac

SEQ ID NO: 93109 - DNA, 601 bp, Human
acttcatgctggaaactgtgatgtttggttttttcatggaggtgagtgtggatccagatttgaacacaaaggactcaaagtgcaacaactttgggaatcatgacaccagcaaagaggggggcaagccttcacccaccttaaaatgaattactggttaactactattaatatgtcatgggcccagagaccagcatataacactccacgatcagtaagggtatttatcatgtgcaggtattgatccctcatgaaggagtgaatcatatttcacactgcatgttagtgcaaaaaaaaaaaaaaagtagcagagggattgtgaagccctatcaaagaactggatgtgcagaaggtaaacgggtgtagccatgaacatgagtattagaataagaggtgactgagctcataagcaacatctctgcagatgcatctgaggggagacagtgagctctgttatggtctgtgggacaaatgctattggtaatttttccagatgtgtatttcttgagttcctgttgcttttctgagtggttggatccagtccttctgatcttttgttcttattgcacaaattaggagtatataccaatggtaacacttaaaa

SEQ ID NO: 93110 - DNA, 601 bp, Human
ggaggtgagtgtggatccagatttgaacacaaaggactcaaagtgcaacaactttgggaatcatgacaccagcaaagaggggggcaagccttcacccaccttaaaatgaattactggttaactactattaatatgtcatgggcccagagaccagcatataacactccacgatcagtaagggtatttatcatgtgcaggtattgatccctcatgaaggagtgaatcatatttcacactgcatgttagtgcaaaaaaaaaaaaaaagtagcagagggattgtgaagccctatcaaagaactgratgtgcagaaggtaaacgggtgtagccatgaacatgagtattagaataagaggtgactgagctcataagcaacatctctgcagatgcatctgaggggagacagtgagctctgttatggtctgtgggacaaatgctattggtaatttttccagatgtgtatttcttgagttcctgttgcttttctgagtggttggatccagtccttctgatcttttgttcttattgcacaaattaggagtatataccaatggtaacacttaaaacatctggccaggtgcggtggctcacgcctgtaatccc

SEQ ID NO: 93111 - DNA, 601 bp, Human
tggatccagatttgaacacaaaggactcaaagtgcaacaactttgggaatcatgacaccagcaaagaggggggcaagccttcacccaccttaaaatgaattactggttaactactattaatatgtcatgggcccagagaccagcatataacactccacgatcagtaagggtatttatcatgtgcaggtattgatccctcatgaaggagtgaatcatatttcacactgcatgttagtgcaaaaaaaaaaaaaaagtagcagagggattgtgaagccctatcaaagaactggatgtgcagaargtaaacgggtgtagccatgaacatgagtattagaataagaggtgactgagctcataagcaacatctctgcagatgcatctgaggggagacagtgagctctgttatggtctgtgggacaaatgctattggtaatttttccagatgtgtatttcttgagttcctgttgcttttctgagtggttggatccagtccttctgatcttttgttcttattgcacaaattaggagtatataccaatggtaacacttaaaacatctggccaggtgcggtggctcacgcctgtaatcccagcactttggg

SEQ ID NO: 93112 - DNA, 601 bp, Human
tcttccaagtgaaagacattaggattctgcaagaactgttctcattctggatgcatttgccatgctcaggcttcctcagtggggatttgattcaacgcaatgccacatatatatttgggagttcagtgcaagtgtttgaccctctttttcactttcccagctttattgacgtatcatgggtaaaaaaagttgtatatatttaagatgtacaatgtgatgatttgatatatgtgtaccttgcacaatgattgccacaattaagctaattaacaaacacattaatcacctcacatagttaccwtttttatgtgtgtggttgataacacttaagatctactctattagcatttttcaggtgtacagtatattattaagtacagtcaccatgctgtatgttagattcccagaatttactcatcttataactgaaacttttttttttttttttttttttgagagggagtcttgctctgtcacccagctggagtacagtggcgcgatctcggctcactgcaacctctgcctcccgggttcaagccattctcctgcctcagcctcccgagtagctgggactacaggcacgcgccaccaagcccagcta

SEQ ID NO: 93113 - DNA, 601 bp, Human
gaattgacttttctaagcccacttcaagaaaatgtgaattgaaattttcctctgacccattctgttccattttgcgtctgcctttttcaggtattaaaatgttgttaaaattgaagtcattaggttgataaaattgaagtcattccacttttgggatcttttgctaccctcagggatctgacttcttgggcatattaaaatgtcaattttaatcccctgagctacaaattttcttaagttcttcatacgttttatttttggaatcatattattattattattattattattattattattttttttgagacagattctcgctctgtcgcccaggctggggtgcagtggcgccatctcggctcactgcaacctctgcctcctgggttcaagtgattctcctgcctcagcctactgagtagctgggactacaggcacgtgccatcacgcgtggctatttttttttctgtatttttagcagagatggtgtttcaccatgttagccaggatggtctcaatctcctgacctcgtgatccaccagcctcgggctcccaaagtgctgggattacaggcgtgagggaatcatactatttttgaagggag

SEQ ID NO: 93114 - DNA, 601 bp, Human
tgaattgaaattttcctctgacccattctgttccattttgcgtctgcctttttcaggtattaaaatgttgttaaaattgaagtcattaggttgataaaattgaagtcattccacttttgggatcttttgctaccctcagggatctgacttcttgggcatattaaaatgtcaattttaatcccctgagctacaaattttcttaagttcttcatacgttttatttttggaatcatattattattattattattattattattattattatttttgagacagattctcgctctgtcgcccaggstggggtgcagtggcgccatctcggctcactgcaacctctgcctcctgggttcaagtgattctcctgcctcagcctactgagtagctgggactacaggcacgtgccatcacgcgtggctatttttttttctgtatttttagcagagatggtgtttcaccatgttagccaggatggtctcaatctcctgacctcgtgatccaccagcctcgggctcccaaagtgctgggattacaggcgtgagggaatcatactatttttgaagggagcttttaaagcacattgatattggaattgagaggt

SEQ ID NO: 93115 - DNA, 601 bp, Human
gtagctgggattacaggcatgtgccaccacgcccggctaatttttgtatttttagtggacatggggtttcaccatgttgtccaggctgttctcaaactcctggcctcaagtgatccgcccactcggcctcccaaagtgctgggattacaggcatgagtcaccgtgcctggcccagagaggtagcagaagtgtcaggaacagagatctggatggcagtcttttcctcacttcgctttttctgctgttcctggaaggctctctcactctgctctttggacaatgccttgcccctcttggtggyagcttcctaggagagggcagagtcgggggctcttctttggttgctgccctgcttttctgtcttctttgtagaaggtgccccaccgctgcacttggagagcacctgtgctgttctctcctgactgattttcttggtgtgaaaatggctcaaccttgaggccagaatgtgaggttgggtcttcaactactttcttgactgtgttgctaaggccggactctcctcctaacttaaccagatggagtcatctttttattagctatcctgcctagtaggatgtaaactctctttttctttttagat

SEQ ID NO: 93116 - DNA, 601 bp, Human
aaagcttgtgcccccagatgtgtagacttacattccagccacgtttagggtgtggccaaatggcagcactggcagttatttcgttctttctggtggttatgtggtctcctctgaagtgttttatggttgtccattgacgataaggcacctcgcaggaatgcattcatgtcttaacatgcttccagagcccaccatgtgctggggatctaccactgaacaaaacacaaaaattgggaaaagtgagtcttgggagaaggctgctatttcttgatccctgtagttggggattgcctaaaccttgctacaggtaggaaggaaaccgcgttctggcatctgaggcttgaagcacagaaaaaagtgcccccttgtgagtgttcctggcccggtgctccagcaccttctgcctgctgagggtggaagggttgggaagggcactcagaaaagccagtaccttttcactgcttgtccgccgtaaggagcagccagacaggctctcgttttcccactgccccccctttttttgttgttttttaagtgtagctcagcatcagaacaacctgtttgttagcttgaaagaatggtcaaaacaagtcactttcca

SEQ ID NO: 93117 - DNA, 601 bp, Human
aagcttgtgcccccagatgtgtagacttacattccagccacgtttagggtgtggccaaatggcagcactggcagttatttcgttctttctggtggttatgtggtctcctctgaagtgttttatggttgtccattgacgataaggcacctcgcaggaatgcattcatgtcttaacatgcttccagagcccaccatgtgctggggatctaccactgaacaaaacacaaaaattgggaaaagtgagtcttgggagaaggctgctatttcttgatccctgtagttggggattgcctaaacctttatacaggtaggaaggaaaccgcgttctggcatctgaggcttgaagcacagaaaaaagtgcccccttgtgagtgttcctggcccggtgctccagcaccttctgcctgctgagggtggaagggttgggaagggcactcagaaaagccagtaccttttcactgcttgtccgccgtaaggagcagccagacaggctctcgttttcccactgccccccctttttttgttgttttttaagtgtagctcagcatcagaacaacctgtttgttagcttgaaagaatggtcaaaacaagtcactttccaa

SEQ ID NO: 93118 - DNA, 601 bp, Human
agacttacattccagccacgtttagggtgtggccaaatggcagcactggcagttatttcgttctttctggtggttatgtggtctcctctgaagtgttttatggttgtccattgacgataaggcacctcgcaggaatgcattcatgtcttaacatgcttccagagcccaccatgtgctggggatctaccactgaacaaaacacaaaaattgggaaaagtgagtcttgggagaaggctgctatttcttgatccctgtagttggggattgcctaaacctttctacaggtaggaaggaaaccgcrttctggcatctgaggcttgaagcacagaaaaaagtgcccccttgtgagtgttcctggcccggtgctccagcaccttctgcctgctgagggtggaagggttgggaagggcactcagaaaagccagtaccttttcactgcttgtccgccgtaaggagcagccagacaggctctcgttttcccactgccccccctttttttgttgttttttaagtgtagctcagcatcagaacaacctgtttgttagcttgaaagaatggtcaaaacaagtcactttccaaagtatctgctgtgtgggggtgg

SEQ ID NO: 93119 - DNA, 601 bp, Human
aggagcagccagacaggctctcgttttcccactgccccccctttttttgttgttttttaagtgtagctcagcatcagaacaacctgtttgttagcttgaaagaatggtcaaaacaagtcactttccaaagtatctgctgtgtgggggtggccagagcactctctgcagctgtgccatatttgtgctgtaggaaggcgcagtgagggtggagccatgggaagacaaggcggaaacctggctctcaggagacagttatgatgaacaaatatgattttaaaatactcttaaattgaaaaaaaamcaacaaagacataatagggagaagacagcagaatgcaaaatctacttaatttttttttttttttggagacagcgtcttgctctgttacccagactggagtgcagtagtgcgatcgtagctcactgcagcctccaactcctgggttcgagtgatcctcccatctcagtctcacgagtagctgggactacaggtgtgtgccaccatgccacacctggctaattaaaaaactttttttgtagagatgggggtctcagtgtggtgccgaggctggtcttaaacttttggctcaagtgagcctcc

SEQ ID NO: 93120 - DNA, 601 bp, Human
ccatatttgtgctgtaggaaggcgcagtgagggtggagccatgggaagacaaggcggaaacctggctctcaggagacagttatgatgaacaaatatgattttaaaatactcttaaattgaaaaaaaaacaacaaagacataatagggagaagacagcagaatgcaaaatctacttaatttttttttttttttggagacagcgtcttgctctgttacccagactggagtgcagtagtgcgatcgtagctcactgcagcctccaactcctgggttcgagtgatcctcccatctcagtctcacragtagctgggactacaggtgtgtgccaccatgccacacctggctaattaaaaaactttttttgtagagatgggggtctcagtgtggtgccgaggctggtcttaaacttttggctcaagtgagcctcctgcctcagcctctagaagcgctgggattacaggcttgagctgctgtgcctagctctacttcaggttttatttttaattattattattttttaattgagaaggatcttgctctctcacccaggccagagtgcagcagcataatctcagttcactgtagcctccacctcctggac

SEQ ID NO: 93121 - DNA, 601 bp, Human
tggagacagcgtcttgctctgttacccagactggagtgcagtagtgcgatcgtagctcactgcagcctccaactcctgggttcgagtgatcctcccatctcagtctcacgagtagctgggactacaggtgtgtgccaccatgccacacctggctaattaaaaaactttttttgtagagatgggggtctcagtgtggtgccgaggctggtcttaaacttttggctcaagtgagcctcctgcctcagcctctagaagcgctgggattacaggcttgagctgctgtgcctagctctacttcagkttttatttttaattattattattttttaattgagaaggatcttgctctctcacccaggccagagtgcagcagcataatctcagttcactgtagcctccacctcctggacttaagcgatcctcctacctcagccccctcagtagctgaggctacaggcatgtaccaccacacccagctaatttctgtactttttgtagagatggggtttcaccatgttgcctgggctggtctcagactcctggacattcaagtgatctgcctgccctggcctcccacagtgctgggattgcaggcatgagc

SEQ ID NO: 93122 - DNA, 601 bp, Human
acagcgtcttgctctgttacccagactggagtgcagtagtgcgatcgtagctcactgcagcctccaactcctgggttcgagtgatcctcccatctcagtctcacgagtagctgggactacaggtgtgtgccaccatgccacacctggctaattaaaaaactttttttgtagagatgggggtctcagtgtggtgccgaggctggtcttaaacttttggctcaagtgagcctcctgcctcagcctctagaagcgctgggattacaggcttgagctgctgtgcctagctctacttcaggttttwtttttaattattattattttttaattgagaaggatcttgctctctcacccaggccagagtgcagcagcataatctcagttcactgtagcctccacctcctggacttaagcgatcctcctacctcagccccctcagtagctgaggctacaggcatgtaccaccacacccagctaatttctgtactttttgtagagatggggtttcaccatgttgcctgggctggtctcagactcctggacattcaagtgatctgcctgccctggcctcccacagtgctgggattgcaggcatgagccacca

SEQ ID NO: 93123 - DNA, 601 bp, Human
ctagttcaagcggttctcctgcctcagcgtcctgagtagctgggattacaggcgtgcaccaccacgcccagctaatttttgtatttttagtcgagatggggttttgccatgttggccaggctggtctcaaactcctgacctcaggtgatccgcccccctcagcctcccaaagtgctgggattacaggcgtgagccaccgcgccagccacttttcaactttttaaaacataaagtgatgtattagatggtgggatgttttttgttaatgctcttattcagcaatgtaaaaagttgatacccrttgtctctcgcctccttcctacaccccctcctcctccaccttttttttttaagactgctgcagtactcagtgtgtccttgtgacaacagtgaagttctttaggggcttcagtgtgctccctttagcaattatgtggacttacatttgtgcttacctcttgacttgcagggtgcttcccctcccaccacattttttttttttttagatggagtcttgctgtcttgcccaggctggagtacaccaatgcagtttctcggctcactgcaacctctgcctcccaggttcaagcgattctcctgc

SEQ ID NO: 93124 - DNA, 601 bp, Human
aatgtaaaaagttgatacccgttgtctctcgcctccttcctacaccccctcctcctccaccttttttttttaagactgctgcagtactcagtgtgtccttgtgacaacagtgaagttctttaggggcttcagtgtgctccctttagcaattatgtggacttacatttgtgcttacctcttgacttgcagggtgcttcccctcccaccacattttttttttttttagatggagtcttgctgtcttgcccaggctggagtacaccaatgcagtttctcggctcactgcaacctctgcctcccrggttcaagcgattctcctgcctcagcctcctgagtagctgggactacaggcacacgccaccatacccagctaatttttatatttttagtagagacagggtttcgccgtgttggccaggttggtctcgaactcctcacctcgagtgatccgcccacctcagcttcccaaagtgctgggattacaggtgtgagccaccatgcccagctttcccctcctttttatgacagccatgggaacaccctcatgctggtctagcattttgaggaattcattcacaggaaccccaagtaggttctgctg

SEQ ID NO: 93125 - DNA, 601 bp, Human
aaggcagacataattctatgtctggagtatttgtataaaaccaaaaaatgggaaggcctggaaatttcgctgtctcctcactcccttgcccgtgtgtgtgtgtgtctgtgtgtggtgtgtgtgtgtgtgtgtgtgtgtgtgtggcactgcaggacatgtcaaactaaagtttatgtacttaaaatcacctttaaagtgtataatggaaaggtgttttgtttgagtcatttgtttgcaagccccgaagaggagtctttcattgcggtgccccgttctcccgttgacagaagcaggtggaccsgtgaggggaagaggagggtgcaagcagaacagccctggaacagtgtcacgctgctgggcacttcctgtctcctattccatttcatccataaacacagcctttccgggctgtgagcctccttttgtggatgaggaaactggggctcagggagatgaagtagctagctagtactgcacggctggaaacggggaagctggatttggagtttgcctgactgcagagaggcacctctgttcccgtggtgtctctgctttccttgcagggcagtgcacatttcttggttttccttttaaagccgtg

SEQ ID NO: 93126 - DNA, 601 bp, Human
ctaacacgtataaaaggaaattatggctcgggtttactgtaatgcatattcttaacaatttaatagaacacaactccaaggtcttgggttgcctgcaaagttaatactaacaccatgagcatcctccaccagccagctcttatccatgggtcgtactctggttcagagactttggatgggtaataacgtataaaacatgcctcttgcttgccagtgaccactgctaataataatagtagtcatcattcactggaatcctgggtttttagggtttacttggtttatttatttgcttagcttraaggaataaaaaaaaaccttgagaggaaacaaggaggcatttcacaaaggagaaaaatatatatccctttaggaaaactgagtggctcctctgatttctttgccgctcttgtccctcagcagcacttagctgttttcttctagctggaggtgagggactgagcacaggggtggtgctcagttagtttaaagggagcttctcaccttggcgctgttcaggccttgggttggttaattctgtgtcctgtgggaattgtgggacactacactgtagtgacagtcagcagcatccctgaccttg

SEQ ID NO: 93127 - DNA, 601 bp, Human
agttcacattctagtaacctcaaatggagtctgaccctttgtatctttttcttcttttactggaattcttttatagctcagtgatcttggggattcattaaggatagtgaatgtttgaatataaataactaaattcctatttcctaatagttctttttatttcatgcttttggaaaacatggaaaaggaattaagggaataaataagcacacgcatggatttgaaattgtgtttattttccagtaagcgttagttaaaaaaaagaattttactgttcatcttcatctttttgtcaaataayacatacattgggattggcagcgttagccagtctatttgtcagatttagcctgttttagttaatataggggattgttgggatctcgtacttccaaggtatatggacgatatgttggtaattgtagagcactggttctcaatctcggtgtcatattagaattaactgggatctttgaaaatatccagggcccaggccacatcccagagcagttaaaccagattttcttgagtggagtccaggcatcagtactgagttcccttctcaccttactccagtgagagtgaagtttgagaaggaacc

SEQ ID NO: 93128 - DNA, 601 bp, Human
taatttttttttttttttaagctggggcagtggctgacacttgtaatctcagcactttgggatgccgaggcgggcggatcacttgaggccaggaatttgagaccagcctaggcaacatggagaaaacgtctctactaaaaatacaaaaattagccggacgtggtggggcatgtctgtagagtaggctactcaggaggctgacgcaggagaatcgcttgaagccaggaagcagaggttgcagtgagccgagattgtgccattgcactccagcctgggcaacagagtgagactcggtctcaaacaattttttttaaagggtttcctttggtcttgggttctgagaggtactaagtatgagaggaaggatcacgtattctagtccctgggcaccagcaatatcagcatctccagcccagtcttaccatcaggacctgcattttaacaggaccccctggccattcatatgcgcattgagagctgctgggaatcatcaaaagatgctgcagtgctctaattgataactgggtgtgtgtagtaaacagctaccatgattgtcccttttctcttaaatggtttagtggcttcttaatgggctcttctg

SEQ ID NO: 93129 - DNA, 601 bp, Human
ggaggctgacgcaggagaatcgcttgaagccaggaagcagaggttgcagtgagccgagattgtgccattgcactccagcctgggcaacagagtgagactcggtctcaaacaattttttttaaagggtttcctttggtcttgggttctgagaggtactaagtatgagaggaaggatcacgtattctagtccctgggcaccagcaatatcagcatctccagcccagtcttaccatcaggacctgcattttaacaggaccccctggccattcatatgcgcattgagagctgctgggaatcatcraaagatgctgcagtgctctaattgataactgggtgtgtgtagtaaacagctaccatgattgtcccttttctcttaaatggtttagtggcttcttaatgggctcttctgctgtgtggtcttatttattaggggtagccagtttttcctttttggctgttttccgagtatagcttctttaaccttctatttagtaaagatttaatgtggccaggcgcggtggctcacgcctgtaatcccagcactttgggaggccgaggcgggcagatcacgaggtcatgagatcgagaccatcctggctaa

SEQ ID NO: 93130 - DNA, 601 bp, Human
tcttctgctgtgtggtcttatttattaggggtagccagtttttcctttttggctgttttccgagtatagcttctttaaccttctatttagtaaagatttaatgtggccaggcgcggtggctcacgcctgtaatcccagcactttgggaggccgaggcgggcagatcacgaggtcatgagatcgagaccatcctggctaacacggtaaaaccctgtctcttctaaaaatgcaaaaaattagccaggcatggtggcgggcgcctgtagtcccagctactcgggaggctgaggcaggagaatgrcgtgaacctgggaggcggagcttgcaatgagccaatatcatgccactgcactccagcctgggcgacagagtgggactctgtctcaaaaaaaaaaaaaaaaaaaaaaagatttaatgtaatggtagaaagtgaaaacggagtgattggcctagaagagacaccatttcatatacttcagaaaaacaaactagaaaggataaaggggacttacccaggtaaacttcacttgagaggaaataatcacctgtaatggtatctttgcttctccagaagaagtaatccactcatgagaacatagat

SEQ ID NO: 93131 - DNA, 601 bp, Human
tagttggtgaattgtccagaatgtagatgttcatagaaaatcttgaggaagcccagtgcctaattttacactaccaggctctgtcaagttagtgctattttctttttcaagtaccatttaaaatacttgattgaaaaacatgattttgaattattttggattattttgaaattactcatatttctggacagaattggtttatcttgaacattcccttagatcgaattttgtttaaaagcgagtaccatctaaatttaagttttaaaagactgtcataaataactgaagtccagctctgttrttgccgtgaagatgtgatcatgagttgaatgctcggtgtctctaacagggtctagatgttcatggaagtgggtcttacacaatcagagtcatcagggccaggaaagtggaaatggagggggggccctttctaagccatcaagtcatatcttcttagctttgaatgagaatcaggaagccacagggaatgaactgcttcttatataaaagctatctcatggtcctaaaggcagggtctggttgccggaaaaaaatgaatgactgctgtgctcacatgcagctgccactgcgaggggcgctt

SEQ ID NO: 93132 - DNA, 601 bp, Human
gtgaattgtccagaatgtagatgttcatagaaaatcttgaggaagcccagtgcctaattttacactaccaggctctgtcaagttagtgctattttctttttcaagtaccatttaaaatacttgattgaaaaacatgattttgaattattttggattattttgaaattactcatatttctggacagaattggtttatcttgaacattcccttagatcgaattttgtttaaaagcgagtaccatctaaatttaagttttaaaagactgtcataaataactgaagtccagctctgttgttgccrtgaagatgtgatcatgagttgaatgctcggtgtctctaacagggtctagatgttcatggaagtgggtcttacacaatcagagtcatcagggccaggaaagtggaaatggagggggggccctttctaagccatcaagtcatatcttcttagctttgaatgagaatcaggaagccacagggaatgaactgcttcttatataaaagctatctcatggtcctaaaggcagggtctggttgccggaaaaaaatgaatgactgctgtgctcacatgcagctgccactgcgaggggcgcttgtgcct

SEQ ID NO: 93133 - DNA, 601 bp, Human
tgaacattcccttagatcgaattttgtttaaaagcgagtaccatctaaatttaagttttaaaagactgtcataaataactgaagtccagctctgttgttgccgtgaagatgtgatcatgagttgaatgctcggtgtctctaacagggtctagatgttcatggaagtgggtcttacacaatcagagtcatcagggccaggaaagtggaaatggagggggggccctttctaagccatcaagtcatatcttcttagctttgaatgagaatcaggaagccacagggaatgaactgcttcttatawaaaagctatctcatggtcctaaaggcagggtctggttgccggaaaaaaatgaatgactgctgtgctcacatgcagctgccactgcgaggggcgcttgtgcctccttactgccttccgagttttgctctgccccatgtgtccagttagcagaagccaaatcacctccagaattcagatctcagactcctgttcttgctgcagggaacagacaccgactaacaggatccagcatggcattgtgctaatgtccacagcttcccattacacatggtttgcatgttgttttacagtatttattta

SEQ ID NO: 93134 - DNA, 601 bp, Human
agatggggtttcattgtgttagccaggatgatctcgatttcctgaccttgtgatctgcccatcttggcctcccaaagtgctgggattacagacgtgagccactgcgtccagcctatagtcattttaaatactctccttatatgaacactgtaaggtaaccaagataaaattccagttttgcacatgaagaaacatgggaagaggtctgataacttgcgcccgttcaaacaaatttgttagtgttacagcagattgtgttgtcccctctccaccaccctgttctcttttgtactggttaatygagcaccaaatgaacagaaggaatttcaggggtgctttagaggggaccttaagatagaaagggcaccatcatagttctaggcccagtacattggaagagcatattcatggctgaggccacttccaacttagataggctattcccttaatttgctttttttttttgagacagggtctttctctgttgcccaggctggagtgcagtagtgcaagcagccacggctcactacagcctcaaactcctgggttcaagtgatcttcctacctcagcctcctgagtagctgagatctcactcgtgca

SEQ ID NO: 93135 - DNA, 601 bp, Human
tttaaagaatttagttataaaatgactttgctatgcttgattcttaatatcatgttttttttcctttctggattcctagagtgacaggagtaagatgagagactctcccttggaagctaaaaatgtattttatggaggatcaatatgaaatacaggggcactttaaatgtggttcaagacctggtattttttgtgaagtgagtttctgtgcattgaaaactcctttcccaaagactttcattttaaaattgaaggcgtattcatctttttggcgaaaacaacataataaaacatttttgartacaatagatctcagagtttatgcagtagcaatgcaaataactctgatataatggctttgaaataaaaaatgactgtttaatgaatcaaagcactttgaaatacatagtaactcgacttcaattttaacatcccccagcattttcactgtggtgagaggcaggtctttacagctgctgcgtttccagatcccgtgtttaagttctttatagttaagcatcctcttttgatgtaggaaagtgagaaacatacacaataggcagtaagtggaaatcagggcagtagagggtgtcttggaaga

SEQ ID NO: 93136 - DNA, 601 bp, Human
ttatgcagtagcaatgcaaataactctgatataatggctttgaaataaaaaatgactgtttaatgaatcaaagcactttgaaatacatagtaactcgacttcaattttaacatcccccagcattttcactgtggtgagaggcaggtctttacagctgctgcgtttccagatcccgtgtttaagttctttatagttaagcatcctcttttgatgtaggaaagtgagaaacatacacaataggcagtaagtggaaatcagggcagtagagggtgtcttggaagagaaaccaatctagaagaayttactctgtgctaaataaaaggatatgttcattttctaagtaacttgactctttagagaacttagagaatgagaatcagaaccatgctttgatttccaaattcagaaccagaaagtctaaaatagctgggcaagttatgctttatttaccatattaacataaaataaaggacttctattaatatgaaatatataggtcacgggagcctatgtagtttgagctgcagagaggccgaagtacacattgttgattgcagtttcacttttattaagaatcactttccgttgggagtggacaagc

SEQ ID NO: 93137 - DNA, 601 bp, Human
ttggcttataagctccctaaggacaaacaacacattttctatactttcttacctgctgtgatgccttttatttatttgttggttgagtgaatgaatgaatgaatctggtattatttttaactgagtttggcctgtaagggcgtgcaagcatgaaaggtcagaatcctaactggcctgtctgcacaatttggggatgaagcagttaaaggaacatttgttaatacagaaaattaagaatgaaacccactttcaggaagaaattgcctgagcttcttacaccaggaataatggaatatttttwgaagcactggcgttcttgagacaaaggtgtaaattcagagcaaggcagtaagacaaaaatataagaggcaatttattagagcagagaggagcgaatttggagaggagcggtaggcatttgaatttatggcagaaaaggaagcgactcagaaggaaagaggttacagtccaggaaagaaaaagaccagctgtactagcgctcacagggaaagaagaataggtgaataccacctacaattccttattacttttctggccatgtgtttatttgaaagagtagtgtgtgaggaggccccaggct

SEQ ID NO: 93138 - DNA, 601 bp, Human
gcactggcgttcttgagacaaaggtgtaaattcagagcaaggcagtaagacaaaaatataagaggcaatttattagagcagagaggagcgaatttggagaggagcggtaggcatttgaatttatggcagaaaaggaagcgactcagaaggaaagaggttacagtccaggaaagaaaaagaccagctgtactagcgctcacagggaaagaagaataggtgaataccacctacaattccttattacttttctggccatgtgtttatttgaaagagtagtgtgtgaggaggccccaggcttaamttcctggtaccctgctaacccactaacagttaagtaggaggcccaagcttcagaaacgagagctgggaagactctaaaatctcagcactatctactttggaattatcttcgagaaggagtgtacaaatacgtagaaaatcaaaatcccagctaatttttaacagaaggcttaatgccttccaaatgtgtgctattttggctttttttatattgcatgaatttttacaaagcaagtgggaaggtaaaggaagcgtgtttggaggtcagtaaggacacctcaaaggtcatctcatgggacac

SEQ ID NO: 93139 - DNA, 601 bp, Human
cagttttatcagcattgacacagtggggtgttctttgagagcatgttagcccttctgggaggtggggctgaggctagagacaggaaatgatgggtggggatgcggacatcagtatattcatttgtgagatatcggcaaaggttggctcataaccagttacatgtggcagatccgtcaagtctaagttcctttggttgattgtgttaatatgtaagttattatttattctaaatagggatttctaaagaacttgaaagacagtgttttcagtaggtttaatgtcttctttaaagtcttattyaagtataaatttgcccattaaatctatgttcttcagtttctttaaaaataaatttaagcttagcttctctgtcatctaaaaaaatgaacccaagttcagtgtcttcctctgggtttgctataaagctggcaacatgaaataaatggaatgttgggcggggggaggggggcattttacagggcaagttttccttttgtcgtgttactgctttttaatgcttttctttgtaaaaggataggagccattccttctttccttatcctgaaaaacgttaagagggtaggtcagagagatggtgga

SEQ ID NO: 93140 - DNA, 601 bp, Human
tggcagtgatgacgggtggtcgaattctggatatattttaaagatagaaccaacaagatttgctgttggtctttggatgggacaggaagagaggagtgaaggatgactccttaatttttgacctgaccaattggtattttgattttctacgtatttgtacactcctcgaagataattccaaagtagattggggtttccaattattgaggtaaagaagactatgggaaaaataagtttgtgtgcattacgagtttaactttgcatgtgttaagtttgagatgtccatgaaccacccaagtgsattgttgattaggagttggatgtgtggagtctgagggggaggggaaatatctctactggagatgaagatttgggggttcagtgcataggtttatttgaagtcaatgtgatgagatcatttggagagatgaatgtaggtggagaatataaaggaccagggactgagcctgcgtgtctccagtgtttatggccctgtagatgaggaggactagcaaggaaaagagggaggaggagcagcctgtgaggcaggagggaaactgtgtgtgagcggtgccttagaagccaaattaaaggattttaa

SEQ ID NO: 93141 - DNA, 601 bp, Human
ctgtgtgtgagcggtgccttagaagccaaattaaaggattttaatgagagccaaagagtgctgatatgtcaaatgagatgaggactggaatcgaccatcagctgttgcaaggtggaaatgatcagtgaccttctgagtggtcactttggtgggaggtgagaaccaaagcctgcctgcgtattcaggagtgcatgggagagaagaattggtgcagtgaatacaggcagctcttcaggagttttgctgtaagaggaatagtgggatgggacgtcaacccgtggggaagtgagttcaaggaagsgccttggctccttctttaaagaagagagattttataatacgcttgtatgctgatgagggcgatcccaatagagggagaatttgtggatacagggagtgtgtggagggcacaattgctgtaggggtgaccctgagcaagccaggtggggtgggaaccaagggtctgcagagtgggggccatggtctgatgtgggtctgggagtgctttgttacttgtctaagaggggagataagaaatagagaggaaacaaactttatagcaatttggtagagcagttttgtctgttgaggttgataaaat

SEQ ID NO: 93142 - DNA, 601 bp, Human
ttcaaggaagggccttggctccttctttaaagaagagagattttataatacgcttgtatgctgatgagggcgatcccaatagagggagaatttgtggatacagggagtgtgtggagggcacaattgctgtaggggtgaccctgagcaagccaggtggggtgggaaccaagggtctgcagagtgggggccatggtctgatgtgggtctgggagtgctttgttacttgtctaagaggggagataagaaatagagaggaaacaaactttatagcaatttggtagagcagttttgtctgttgagkttgataaaatattggggcttgtattttttgtctttcatttttctagtagcctattttttattgaggtagaatccacctaacattaactattaaccataattgaagtgtacaattcagtggcatttggtacattcacagagttgggcaaccgtcacctctatctgattgcaaggcactttcatcaccccaaaaggaaaccccccatcctccctcctccagccccctggtaatcactaatctgctttctgtctctatagatttgccagttctggaatggaatctcataatatgtagcctttt

SEQ ID NO: 93143 - DNA, 601 bp, Human
gggagtgtgtggagggcacaattgctgtaggggtgaccctgagcaagccaggtggggtgggaaccaagggtctgcagagtgggggccatggtctgatgtgggtctgggagtgctttgttacttgtctaagaggggagataagaaatagagaggaaacaaactttatagcaatttggtagagcagttttgtctgttgaggttgataaaatattggggcttgtattttttgtctttcatttttctagtagcctattttttattgaggtagaatccacctaacattaactattaaccataattraagtgtacaattcagtggcatttggtacattcacagagttgggcaaccgtcacctctatctgattgcaaggcactttcatcaccccaaaaggaaaccccccatcctccctcctccagccccctggtaatcactaatctgctttctgtctctatagatttgccagttctggaatggaatctcataatatgtagccttttgtgtcttgcttcgcttagcttaaatgttttcatgattcagctacactgtcgtatagatcagtatttcattcgtttttgtggctcaatatcattccatagtat

SEQ ID NO: 93144 - DNA, 601 bp, Human
tccacctaacattaactattaaccataattgaagtgtacaattcagtggcatttggtacattcacagagttgggcaaccgtcacctctatctgattgcaaggcactttcatcaccccaaaaggaaaccccccatcctccctcctccagccccctggtaatcactaatctgctttctgtctctatagatttgccagttctggaatggaatctcataatatgtagccttttgtgtcttgcttcgcttagcttaaatgttttcatgattcagctacactgtcgtatagatcagtatttcattcstttttgtggctcaatatcattccatagtatggatggatataccacattttgtttagccgttcatcagttgagggatattgggttgtttccaccttttgggtaatgtgaatagtgctgctttgaacatttgtgtacaagtctttgtttgaatgtctgatttcacttcttctgggtgtatgcctagaagtggaattgctgggtcctatggtaagtctatatgtaatttttgaggaacatgttactgtttttcacagcagctgcatcgttttatattcttaccatagtatatgagggttccag

SEQ ID NO: 93145 - DNA, 601 bp, Human
acactgtcgtatagatcagtatttcattcgtttttgtggctcaatatcattccatagtatggatggatataccacattttgtttagccgttcatcagttgagggatattgggttgtttccaccttttgggtaatgtgaatagtgctgctttgaacatttgtgtacaagtctttgtttgaatgtctgatttcacttcttctgggtgtatgcctagaagtggaattgctgggtcctatggtaagtctatatgtaatttttgaggaacatgttactgtttttcacagcagctgcatcgttttayattcttaccatagtatatgagggttccagtttctccacatccttgccaacacttgttttccatttaaaaaaacagtttccagcctgagcaacatagtgagaccccatctctacaaaaaaataaaaaataaaaaattagctgggtttggtgccacccacctgtagttctgactacttgggagggtgaggcaggaagaccactagagcccaggctgcagtgagctatgatcacaccattgcactccagcctgggtgacagagcgaaaccctgagacacacactgcatccagcactgcatcac

SEQ ID NO: 93146 - DNA, 601 bp, Human
atttgtgtacaagtctttgtttgaatgtctgatttcacttcttctgggtgtatgcctagaagtggaattgctgggtcctatggtaagtctatatgtaatttttgaggaacatgttactgtttttcacagcagctgcatcgttttatattcttaccatagtatatgagggttccagtttctccacatccttgccaacacttgttttccatttaaaaaaacagtttccagcctgagcaacatagtgagaccccatctctacaaaaaaataaaaaataaaaaattagctgggtttggtgccacscacctgtagttctgactacttgggagggtgaggcaggaagaccactagagcccaggctgcagtgagctatgatcacaccattgcactccagcctgggtgacagagcgaaaccctgagacacacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaattttt

SEQ ID NO: 93147 - DNA, 601 bp, Human
ttttcacagcagctgcatcgttttatattcttaccatagtatatgagggttccagtttctccacatccttgccaacacttgttttccatttaaaaaaacagtttccagcctgagcaacatagtgagaccccatctctacaaaaaaataaaaaataaaaaattagctgggtttggtgccacccacctgtagttctgactacttgggagggtgaggcaggaagaccactagagcccaggctgcagtgagctatgatcacaccattgcactccagcctgggtgacagagcgaaaccctgagacmcacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaatttttttttttctgtagaaacagagttttgccatattgctcaggctgtcttgaactcctgggctcaagcgatcctcccacctcggcctcccaaagtgctgggattataggtgtgagccatcttac

SEQ ID NO: 93148 - DNA, 601 bp, Human
gagctatgatcacaccattgcactccagcctgggtgacagagcgaaaccctgagacacacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaatttttttttttctgtagaaacagagttttgccatattgctcaggctgtcttgaactcctgggctcaagygatcctcccacctcggcctcccaaagtgctgggattataggtgtgagccatcttacctggccaagaaaaaagtctggggggctctagtaattcatttttattgtattttgccaaagtaccagaccacggtgggttggaaactggaaaaaaaaaagtttaaagcaggcctctcctgctccacagactgtttgaagatcacttgtctagtgcccagatggagggttggcttatataagaatgtggccacttcgtagtaacagatgcaagctgttcgggaagtggtagtgggaacagctttga

SEQ ID NO: 93149 - DNA, 601 bp, Human
acacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaatttttttttttctgtagaaacagagttttgccatattgctcaggctgtcttgaactcctgggctcaagcgatcctcccacctcggcctcccaaagtgctgggattataggtgtgagccatcttayctggccaagaaaaaagtctggggggctctagtaattcatttttattgtattttgccaaagtaccagaccacggtgggttggaaactggaaaaaaaaaagtttaaagcaggcctctcctgctccacagactgtttgaagatcacttgtctagtgcccagatggagggttggcttatataagaatgtggccacttcgtagtaacagatgcaagctgttcgggaagtggtagtgggaacagctttgaaatgatgcttccccagctggtgatgaagagacagatctccacagcagcccctgtgt

SEQ ID NO: 93150 - DNA, 601 bp, Human
taaagcaggcctctcctgctccacagactgtttgaagatcacttgtctagtgcccagatggagggttggcttatataagaatgtggccacttcgtagtaacagatgcaagctgttcgggaagtggtagtgggaacagctttgaaatgatgcttccccagctggtgatgaagagacagatctccacagcagcccctgtgttttaacagatgcacctctgtctagaggtgggtggcactgcacatttgagaatagacatcgttctctgcatgttgaattcttgagtataagttgctggagtaygtggttggtcgacacctgcaaaaaggtttaggtttcagttggtgaaggtaatacacttagatatttttgtctgtttattttgtgatctcggtttaaaagttagaaatggtgccttatttcttttggttccgtctcagagtggcagcctgccgtgcaacttcagccttccttcacgtccaagctgcactcttttcaggagaaagaaacatttaaggtggtgcttacagatcatgaagtgttcatgtattactcatttaacacacagaggttgtcagcagttccgtgaagcgagttgcagag

SEQ ID NO: 93151 - DNA, 601 bp, Human
tgaaggtaatacacttagatatttttgtctgtttattttgtgatctcggtttaaaagttagaaatggtgccttatttcttttggttccgtctcagagtggcagcctgccgtgcaacttcagccttccttcacgtccaagctgcactcttttcaggagaaagaaacatttaaggtggtgcttacagatcatgaagtgttcatgtattactcatttaacacacagaggttgtcagcagttccgtgaagcgagttgcagagcatctacattttacccaaaggtcagatggccaccgtcagtgaygggctccatggagttgaaggcttcatgctcctctgtgatgtgtaagcagcttgcagaggcctctgtgctcccaaatacaacttttcgaatccatctggcgttggcaatgtcgtggaccagggagtctagcagtgcctgatttcactgataccataggcctctccttcaggatgaccaggactgcatgcaaaatgggtagcttgcacctcagggagtggacttgcttaatgctgcatgtcagacttggacttttaggaaaaggtcatctggctgcacctcccaagtttgcaggtgagaaaa

SEQ ID NO: 93152 - DNA, 601 bp, Human
gtatgtgtatcatgattcttgaaattagctagacatcatggtctgccgagtgaggaagatggagcatactaattttaagcagataataaacatttggaaatggcagctttaaagatgtattttttaatatattacacttatgatatgtttgccaagtaaaacacaccagtgcttttcagggaatgtgaagaacaccagcaggtccctttatgcctaaagaatggtacagaagcaagctgacatgctgttggatgaggacaagcagatttctgtctttccttcaaacttctttctctttctrcatacaaagagcaccccacaaggcaaactgtgggcaagattgagagctgtcgggctcctaacgtgtcctctgtgtaaagcactgccatttgacaaggcctcctccaggctgtagtctggaaatagcaggacttcccaggggcctacctcagggaggtcacacttactcatgtaaggataaggtccattcactgcagcatgttagcaagaattaccagggtgtgtgcccacacggagggtcagcttcgtacttctccaggtgcctggcatcgtgcagtgttctcagatggctcccgggatg

SEQ ID NO: 93153 - DNA, 601 bp, Human
atattacacttatgatatgtttgccaagtaaaacacaccagtgcttttcagggaatgtgaagaacaccagcaggtccctttatgcctaaagaatggtacagaagcaagctgacatgctgttggatgaggacaagcagatttctgtctttccttcaaacttctttctctttctacatacaaagagcaccccacaaggcaaactgtgggcaagattgagagctgtcgggctcctaacgtgtcctctgtgtaaagcactgccatttgacaaggcctcctccaggctgtagtctggaaatagcargacttcccaggggcctacctcagggaggtcacacttactcatgtaaggataaggtccattcactgcagcatgttagcaagaattaccagggtgtgtgcccacacggagggtcagcttcgtacttctccaggtgcctggcatcgtgcagtgttctcagatggctcccgggatggtttgtcatttcttaaatgagtaagaaaccaactgtggaatcttttctgttcgttcctcatctacttggagttaggtattccagtgaagcattcggtgaaataaatcagacaccaacaaacatggggt

SEQ ID NO: 93154 - DNA, 601 bp, Human
ccattcactgcagcatgttagcaagaattaccagggtgtgtgcccacacggagggtcagcttcgtacttctccaggtgcctggcatcgtgcagtgttctcagatggctcccgggatggtttgtcatttcttaaatgagtaagaaaccaactgtggaatcttttctgttcgttcctcatctacttggagttaggtattccagtgaagcattcggtgaaataaatcagacaccaacaaacatggggtactgtccccaggccacagacatcttggatttatgccatgtagaatcttccctttgsaaaacttgaattttggggacttaattatctatgtgtgactggtattttgattaagaacgcagccctgccggagggtcaggggtgcttattcaatattcacacttaacagagaggatgggtgtgcaggcagagcgccgtgacttcctctaagccttgttgctagtgtttaagaggaggagccagcctacgaactcagacccctgaattactttcctgggcgctctttcttctagtatatcctgtgtttttctcttcatttccttccttttctttttcttcccttacaaacacacgtgcagc

SEQ ID NO: 93155 - DNA, 601 bp, Human
tatatcctgtgtttttctcttcatttccttccttttctttttcttcccttacaaacacacgtgcagctcctccagtgtctgtaagacaatatctgaccactctgtgtataactcatttaattatctggataatgctattatccccatttgacagatgaggatattgaagcatagagacagtgcctgttaggtaggggaaaagaggggtcctgttccagtgtggcacgtggaggaactgaagctcagtgatgatgctgtttatccaaggcctcactgggctacagtctagcaccctcatgtyttaagtattttcaaggaaatggtggctgtgattggggttgagagtgcacttgggaatattctatttgcagggactaaaggcatggatgcagtttgtttggctgtaatgatgagatacctgtcttacaggtagcacatgcctgatgcagaaatgcccccatctggggttgtggttctgtagcacattactgtcatagtaaaaaaactcaaaagcaaacttaaacccttcggcatatcaggtgtggtgttctctttacattgctattcccaaagctcagtataaactttaagatacctttat

SEQ ID NO: 93156 - DNA, 601 bp, Human
gggaaaagaggggtcctgttccagtgtggcacgtggaggaactgaagctcagtgatgatgctgtttatccaaggcctcactgggctacagtctagcaccctcatgtcttaagtattttcaaggaaatggtggctgtgattggggttgagagtgcacttgggaatattctatttgcagggactaaaggcatggatgcagtttgtttggctgtaatgatgagatacctgtcttacaggtagcacatgcctgatgcagaaatgcccccatctggggttgtggttctgtagcacattactgtcayagtaaaaaaactcaaaagcaaacttaaacccttcggcatatcaggtgtggtgttctctttacattgctattcccaaagctcagtataaactttaagatacctttatgagcacagtaaagtcacttttaattttgtgattatatttgaattttccttttatttaataagagagagtcaagtggaagggttaatatttgataagggcagaaatcacaaaatttaactagtgattagctttgaaatcataagtgcaaatagaaacacaatcagctactttcaaaaatatttattctctttttt

SEQ ID NO: 93157 - DNA, 601 bp, Human
atgatgctgtttatccaaggcctcactgggctacagtctagcaccctcatgtcttaagtattttcaaggaaatggtggctgtgattggggttgagagtgcacttgggaatattctatttgcagggactaaaggcatggatgcagtttgtttggctgtaatgatgagatacctgtcttacaggtagcacatgcctgatgcagaaatgcccccatctggggttgtggttctgtagcacattactgtcatagtaaaaaaactcaaaagcaaacttaaacccttcggcatatcaggtgtggtgttctctttacattgctattcccaaagctcagtataaactttaagatacctttatgagcacagtaaagtcacttttaattttgtgattatatttgaattttccttttatttaataagagagagtcaagtggaagggttaatatttgataagggcagaaatcacaaaatttaactagtgattagctttgaaatcataagtgcaaatagaaacacaatcagctactttcaaaaatatttattctcttttttccctgtgggcatcagctgttaagtgattacatattctacttgttattttattgt

SEQ ID NO: 93158 - DNA, 601 bp, Human
ttgttattttattgttaaactcctgtgactaagaggcctggcagttttcctcagataatttttgaggaagatgttatttaatcttcacctagtctgtcagcagcttatcatgagattgcttttacgactttaatttattctgtaaaagctatagattgaatacacagagcaactacacagaggttttcattttggctaaagattgcagcctagagaagacacaggtagagagagagagagagagagagagagagagaagctctggaaaccacagtttaggaatgcctaaatgctctgacawagccaggttgaacatacttactagaaaacattgcctgtctgttttcaatgctgatgttatcttcatgggattcaggtgtggcagtgagttccatccctgcctgctcagtagagggacccagctctcttgtgggtacatcacaaatcatcaagttggccagtttctgttactcatttagagaccatttgtatttgaacatcccagagaactgacgtctgtctgttgggccctccttggatgtgacactagccagttgggttagagcttccagcatcctcactcatgagatttcctcatttg

SEQ ID NO: 93159 - DNA, 601 bp, Human
aactcctgtgactaagaggcctggcagttttcctcagataatttttgaggaagatgttatttaatcttcacctagtctgtcagcagcttatcatgagattgcttttacgactttaatttattctgtaaaagctatagattgaatacacagagcaactacacagaggttttcattttggctaaagattgcagcctagagaagacacaggtagagagagagagagagagagagagagagagaagctctggaaaccacagtttaggaatgcctaaatgctctgacatagccaggttgaacatayttactagaaaacattgcctgtctgttttcaatgctgatgttatcttcatgggattcaggtgtggcagtgagttccatccctgcctgctcagtagagggacccagctctcttgtgggtacatcacaaatcatcaagttggccagtttctgttactcatttagagaccatttgtatttgaacatcccagagaactgacgtctgtctgttgggccctccttggatgtgacactagccagttgggttagagcttccagcatcctcactcatgagatttcctcatttgaatctgacctgaatcca

SEQ ID NO: 93160 - DNA, 601 bp, Human
gcagtcccatgatcatctgcttaacacacatattttaaaattctctgttaagtatagcaggattgttaggagagtcattttgtggtctttaaacacctggctttacattgaatccagggtctctcccccatgtatacttgcataaaatctgggttagggatttcctctactttaaatgcagaggtcaacatagccttcccagccatactctctgcctcttagttgcagtgtcttcttactagagatgattaactcggccaggtctgagcttcctgaggcagcgaaagaaacaatcacaggygtatggaacttgacctctaggggcagtagaggagccagaagctttccattggctttgactcttggagaaccagagactatacccaaatcagcccagtagttttttaccagggtgggtcggcccaacatgtacaatcactttattaagatttcgagataaaatgtaggacactcagttaaatttaagtttaagatgtacaacaacaaatgtttagtataagcatgttatgaatattttattatactaaaattatttgtttctgaaatttaaattttatttatttatttatttttatttatt

SEQ ID NO: 93161 - DNA, 601 bp, Human
ctggactcgagctcctaggctcaagtgttcctcctgccttagcctccagagtatcatttttatttctacaaaaacagtacaagagggcaatgctaatcatgcttggaaagctcttattttgattgatgttgtttagtaatttcttggtgaaaagtttctggattgtagtttatccttgaacatattaacatattatttctccttctgcttgggtgatacataggtccagaaaggtcaaaagaatattctttctttctttctattatataggctagacacattcatatatgtaaatgaaagytaatccactgctgctcagaatgaaaatggaaatttatacttttcatgcattttgttccgttgtccccctgtttgtgccaggcctaacagtgactcttaaagctgttctgcagggtcagttcctcaatatctctttccttaagtccccccaggatgtaaactgatggctcagtcagtaaacaagtgagaaattcattgagtgccagttagtgtctgggcctagcataatgctctgggagatgaaccatgagagaaggcgtggctgcagggatagtgaaaggtcagcggttttagggacacc

SEQ ID NO: 93162 - DNA, 601 bp, Human
aggctagagtgcagtggcatgataatagctcattgtagccttgaactccttggctcaagtcatctgaattccttggctcaagtgatcctcctgcctcagcctctcaagtagataggactacaggtgtgcaccaccacacttggctattttttttattaaaaaaatttttttttttttgagacggagtttcgctctgtcgcccaggctggagtgcagtggtgcgatctcggctcactgcaagctccgcctctcgggttcatgccattctgcctcagcctcctgagtagctggggctacaggygcccgccaccatgcccagcaaatcctttgtatttttagtagagacagggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagacatgagccattgtgcccagccctgtttgtcttttt

SEQ ID NO: 93163 - DNA, 601 bp, Human
tccttggctcaagtcatctgaattccttggctcaagtgatcctcctgcctcagcctctcaagtagataggactacaggtgtgcaccaccacacttggctattttttttattaaaaaaatttttttttttttgagacggagtttcgctctgtcgcccaggctggagtgcagtggtgcgatctcggctcactgcaagctccgcctctcgggttcatgccattctgcctcagcctcctgagtagctggggctacaggcgcccgccaccatgcccagcaaatcctttgtatttttagtagagacrgggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagacatgagccattgtgcccagccctgtttgtctttttataactgcttcattaaaatataactcatataccataaaattcatcc

SEQ ID NO: 93164 - DNA, 601 bp, Human
tctgcctcagcctcctgagtagctggggctacaggcgcccgccaccatgcccagcaaatcctttgtatttttagtagagacagggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagrcatgagccattgtgcccagccctgtttgtctttttataactgcttcattaaaatataactcatataccataaaattcatccttttaaaatgtatgattcattggattttagtatattaacaaagctatggaaccatcactgctatctaattccaaaacatttccatcatccccaaaacaatccccatattactcccatttctgcctccctcccagcccctgccaaaatactagtttactttctgtctctatgaatttgcctgttctggactttttgtataaatgggatcatagaatatgt

SEQ ID NO: 93165 - DNA, 601 bp, Human
tgcctcagcctcctgagtagctggggctacaggcgcccgccaccatgcccagcaaatcctttgtatttttagtagagacagggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagacrtgagccattgtgcccagccctgtttgtctttttataactgcttcattaaaatataactcatataccataaaattcatccttttaaaatgtatgattcattggattttagtatattaacaaagctatggaaccatcactgctatctaattccaaaacatttccatcatccccaaaacaatccccatattactcccatttctgcctccctcccagcccctgccaaaatactagtttactttctgtctctatgaatttgcctgttctggactttttgtataaatgggatcatagaatatgtgg

SEQ ID NO: 93166 - DNA, 601 bp, Human
ggtggcccaacaacagaaatttattttcttatagtctggaggctggaagtccaagatcaaggtgctgtcagagttgctttccggtaaggcttctctcctgggttgtagactgccatcttatgtcctcacatggcttttcctctttgtgtgtgtggagatagacacagagagagaatggaatgtgagttctggtctctcttcttcttaaaaggacactagtcttagagagtatgacctcatttaaccccagttatctccctaaaggccctgtctccaaatacagtcacattgggagctaggrcttcagtagttttagcacagagactacattcagtcactaacactactgaagggttttatgtctctaaatgtctcttcttgatgagatttggtgggtcggtgtgtgtaaaatgaacggagtatgttgtgtgttttcaggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacg

SEQ ID NO: 93167 - DNA, 601 bp, Human
atttattttcttatagtctggaggctggaagtccaagatcaaggtgctgtcagagttgctttccggtaaggcttctctcctgggttgtagactgccatcttatgtcctcacatggcttttcctctttgtgtgtgtggagatagacacagagagagaatggaatgtgagttctggtctctcttcttcttaaaaggacactagtcttagagagtatgacctcatttaaccccagttatctccctaaaggccctgtctccaaatacagtcacattgggagctaggacttcagtagttttagcasagagactacattcagtcactaacactactgaagggttttatgtctctaaatgtctcttcttgatgagatttggtgggtcggtgtgtgtaaaatgaacggagtatgttgtgtgttttcaggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacgggaacacttttccagatt

SEQ ID NO: 93168 - DNA, 601 bp, Human
aggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacgggaacacttttccagattgttgctcttcttttcctcatttaactccctagaatttcatttcatttcatttctacctctgaatttcagaaaatttctaatccatgccatctttgccttttaacaaatgctctgcatraccttaaacagtttaactctgatgtactgctaaagtgagagactttgccagttttcctggcagatacagcagaatttgggcctccacacgcagggacatgaatgagagagcagtgcgttatttcttgatgttataatgagccaatgcaatggtaacttcagagtgaactggctaacattcatgaactatctaatgtctatatagaccatccatatatgaaaaataaacttttacttttggaagcactttgacatagatcattttgttcagtcctaacaacaatcttactaagtaatgaga

SEQ ID NO: 93169 - DNA, 601 bp, Human
ccttttggtccagtaaatctctataatgactcacagaactcagaaagtgctttacttactctaagcagttttttttaaataaaggatacaactcaggagcagccaaatggaagatgtgcatggggcgcggtatctccgtgctctttgagatttccaagctttcttttttttttttgagacagggttttgctctgtcacccaggctggagtgcaatggcgtgatcttggcccactgcaacctccgtctcccgggttcaaacgattctcctgcctcagcctcccgagtggctgggattacagstgcacaccaccatgcccagcaaatttttgtatttttagtagagatggggtttcaccatgttggccaagctggtcttgaagtcctgacctcaggtgatcaatccaccctcctgggcctcccaaagtgctgggattacaggtgtgagccaccacgccccggtgagagctccaagcttttaatcaaggcttagggtctttcgggcgaccagcccccatcctgatgttatctaactgcctgccaccaagtcactttattagaataaaagaggcttctacatccttagcactcaggaaattccaa

SEQ ID NO: 93170 - DNA, 601 bp, Human
tgcttgtctccacttctttatgaaggatgtgtgttgcttgatacttatttacttgggagtcaagagagaactgttgaaatgtatgcattccttttgcaaattagacttatcagaggtctgccccttcttggtaggacatagatattgcagttttattgtagtagctctatggttatgaaatacctgcttcatatttaatactagatgaaagaactatctcctggctttcttcttggcttttttgatgggccattgtcttcttccacttaacatctcctgtgaggttattaggctatattartaatgtcttcttcaggccgggtgtggtggctcatgcctgtaatcctagaactttgggaggctgaggcaggtggatcacctgaggtcaggagttcgagaccagcctggccaacatggcgaaaccctgtctctactaaaaatacaaagaattagccaagtgtggtggcaggcgccagcaatcccagctactcgggaggctgaggcaatgagaatcgcttgaacctgggaggcggaaattgcagtgagccgagatcacaccattgcactccagcctgggcaacagagcaaaacttcatctcaa

SEQ ID NO: 93171 - DNA, 601 bp, Human
tgaaagaactatctcctggctttcttcttggcttttttgatgggccattgtcttcttccacttaacatctcctgtgaggttattaggctatattaataatgtcttcttcaggccgggtgtggtggctcatgcctgtaatcctagaactttgggaggctgaggcaggtggatcacctgaggtcaggagttcgagaccagcctggccaacatggcgaaaccctgtctctactaaaaatacaaagaattagccaagtgtggtggcaggcgccagcaatcccagctactcgggaggctgaggcartgagaatcgcttgaacctgggaggcggaaattgcagtgagccgagatcacaccattgcactccagcctgggcaacagagcaaaacttcatctcaaaaaaaaaaaaaaaaagtcttcttcaaggaagccctgataatcctttcttattacattttttcttactgtgttaaatatacataacataaaatgtcaaaatttgccattttaacatttttaagcatacaattcagtagcgttaaatgcattcacaatcttgtataaccatcaccactatctatttgcagaatgtttttttatcatt

SEQ ID NO: 93172 - DNA, 601 bp, Human
ggccgggtgtggtggctcatgcctgtaatcctagaactttgggaggctgaggcaggtggatcacctgaggtcaggagttcgagaccagcctggccaacatggcgaaaccctgtctctactaaaaatacaaagaattagccaagtgtggtggcaggcgccagcaatcccagctactcgggaggctgaggcaatgagaatcgcttgaacctgggaggcggaaattgcagtgagccgagatcacaccattgcactccagcctgggcaacagagcaaaacttcatctcaaaaaaaaaaaaaaaaagtcttcttcaaggaagccctgataatcctttcttattacattttttcttactgtgttaaatatacataacataaaatgtcaaaatttgccattttaacatttttaagcatacaattcagtagcgttaaatgcattcacaatcttgtataaccatcaccactatctatttgcagaatgtttttttatcattccaaacagaaactctttacctcttaagcaataacttcccattttccatttcctcctgcccctggtaatctctcttctactttccatctttatgaatttgcctatttcaaa

SEQ ID NO: 93173 - DNA, 601 bp, Human
ttccatttcctcctgcccctggtaatctctcttctactttccatctttatgaatttgcctatttcaaatacctcatataaatggaatgatgccatatttgtccttttgcatctggcttatttcactaagcacggtgttttcaaggttcatccatgttgtggcatgtgtcagaccctcattcctttttatggctgaataatattgcattgcctgtgtgcgccttcttttgtttatctgttcttctgttgatgggcacttgggtttccaccctttggctactgtgaaataatgctgctgtgargtttggtgtacaagtatctgtgtgagtacctgctttcagttcttctggatatatatctagaagtagaattgctgcgttaaatggtaattttatggttaagtttttgcagaactgccaaactggtttccacagtgtcagcatgattttacattccagtcagcagtgcatgatggttcaactttttccatatccttcccaactcttgttgttttccgtttttttgataatagccttcctaatgggtgtaaagtggaatctgatcatgagtttgatttgcgtttcactgatggctaatgatgt

SEQ ID NO: 93174 - DNA, 601 bp, Human
tctttattatgttctggatacaaatccttttaagctatgatttccaagtattttttttcccattctgtgggttgtctttttactctctttttagtatcttttgcacaaaagttttttttttattttgataaagtccaagttatctagtttttcttttgttgcctgtgcttttggtgtcatatttaagaaaccattgtcaaatccaaggttataaagatttatttttgtttttttaagagttttatagttatagttttagctcttaagatctttcattaattttaagttgatttttgtatayaatgtaaggtaaggatctaactctattctttggtatgtggatatcccgttttcccaacattgtttattgaaaagactccttttcccagtgagtggtcttagcacacttgtcaaaaatcagttgaccgtatatttgagggtttatattgcagcttttgtagtgagttttgaaatcaggaaatgtgatccctctaattttgttctttcttttcaggttatgttggctatttgatgtgccttggaattccatatgaattttacaatgggtttttctatttatgcaaaaaacagattttgagat

SEQ ID NO: 93175 - DNA, 601 bp, Human
aggtaaggatctaactctattctttggtatgtggatatcccgttttcccaacattgtttattgaaaagactccttttcccagtgagtggtcttagcacacttgtcaaaaatcagttgaccgtatatttgagggtttatattgcagcttttgtagtgagttttgaaatcaggaaatgtgatccctctaattttgttctttcttttcaggttatgttggctatttgatgtgccttggaattccatatgaattttacaatgggtttttctatttatgcaaaaaacagattttgagattttgatrgaaattgaattgaatctgtagattgttttgggtactattgtcatcttaacaatattaagtcttccagtccatgaacacgggatgatgtctttctatttatttaggtatttaatactttctttaagcatttttaatagttttatctgtgcctgtcacctccctggttaaatttatttctgaatattatttttgatggtattgtaaatagaatttcttaatattttgttgctagggtatagaaatacaactgatttttgtgtgttgattttatatcctgcaactttgctgaatttattagct

SEQ ID NO: 93176 - DNA, 601 bp, Human
ttatgcctgtgcatccttttcccctaagaatcctcttcgtttacacgatttagtggatcctgacctagccctgctcatcttctgtctgtcctagatagttcagcttcttcctttcaagatgcttccatcccagtgcttaccctccactctagagaccacttaccaggccactaaggacctccttttaactgtctgcttattcctgttgcacttaactcccaaattgcaccatatgctgggaacaatcttaactccctacccagtcctcctaacttccctcattcaccaagtcttcttcttyaattagccgtctctaaaactcttatgtcaggatatttccaaaatgaatgacaaaaacagagttaatttaccgtggccagtcttgttttgaaatatgaaacttccccacacatgctgaaaatattttgtcctgttctctgttgtatattctttctctcgtttgttctctggactttattattcctttattggcatttaatgcacacctaagctacaaagagggctttgcattattctctgcttaactcctattttagagcatcatacaaagttatttttatcatttttaccaaaagcaata

SEQ ID NO: 93177 - DNA, 601 bp, Human
gaagtgctatagcctttatgcaaacagtatggtgggtcttcaaaatatgaacccaaattaccacatgatccagcaattacacttcttgatatttaccccaaagaagtgaaagcagggtccagagatatttgtacactcaatgttcacagcagcataaatgggggtcaacctaagtgtccatcaacagagggtggacaaagaaaatgtggcgcatgcatgagcgtgtgcgcacacacaccccctccccccccccacacatatgcaatggaatattaaaggaaggaaaatctgactcatgttrtaacatggatgaaccttgaggacattatgctaagttacatgtcgttcacaagaagacaaatactgtatgattccacatgtttaaggtacttagagtagtcaaaacatagaggcaaaaagtggagtagtggttgctgggtgttgaggggaggacagaatggagagttatcgtttttttgggtatagagttacagtttgagaacataaaaagttctggagatggagggtggtgatggttacacagcagcctgaatgaacttaattgctattgaactgtacacttaaaaaatggttaggatgg

SEQ ID NO: 93178 - DNA, 601 bp, Human
acagagggtggacaaagaaaatgtggcgcatgcatgagcgtgtgcgcacacacaccccctccccccccccacacatatgcaatggaatattaaaggaaggaaaatctgactcatgttataacatggatgaaccttgaggacattatgctaagttacatgtcgttcacaagaagacaaatactgtatgattccacatgtttaaggtacttagagtagtcaaaacatagaggcaaaaagtggagtagtggttgctgggtgttgaggggaggacagaatggagagttatcgtttttttgggtayagagttacagtttgagaacataaaaagttctggagatggagggtggtgatggttacacagcagcctgaatgaacttaattgctattgaactgtacacttaaaaaatggttaggatggtaaattttatgtttacatgtatttcaccaccaaaaaaataggaagaaaagaaaaaagtatggacattttatttatatcaagtatcttttttgcatgtatcaaaatgataacattattttctctttatttatgtagtaagtcacattgatgaatgtcctaatgtggaatgattcttatattcct

SEQ ID NO: 93179 - DNA, 601 bp, Human
tatgtttacatgtatttcaccaccaaaaaaataggaagaaaagaaaaaagtatggacattttatttatatcaagtatcttttttgcatgtatcaaaatgataacattattttctctttatttatgtagtaagtcacattgatgaatgtcctaatgtggaatgattcttatattcctggaataaatcttatctggttatgaggtattgtccttttagtacattgctggattcaggttgtttgtatttatttaggacatctgcacttatatccagaagtgagcttggctttctatcccagttygtggtatccttgtaatgttgttatatcatggttatgtataacatgaaacagaagccatcatcttcctttattctctgggacattttaagtgacataggtatgacaacatcttggtatttgaataaaattgcccatgaccatctaggccttggtctttttggagatggggggtaaatcttttgattaacttttctgtttcttttatggtaatcttttaaaaacaagctttcttcctcagttttggcaatgtgtctttctttaaagagaaatatcaattttccttttcctttttatttgagt

SEQ ID NO: 93180 - DNA, 601 bp, Human
aattctggaagttggaggtcacggagctcaaccccttcactttatttttattttatttttttgagacagagtctgactctgttgctcaggctggaatgcagtggcgcgatctcggctcactgcagcctccgcctcccgaccaaccccttcactttagatgtggaaactgaggccccagagatgacttgcccaaggggacggtatagcccttcaagacaaatactgtctgaagtcaagttttattattgtactactaaccatttcctgtcgctggagtcatagatctcagccggagctggaytctatgttagcttctttgatgaatggatttctcccaacagtgggcctggggtcagccatgctgtgtttctgttagatgttccaggagcccttgctgctgctgactgggaggtgctggagctcactggggtgaatcagttcatttttcattttctccaccttgacttcatggaaggtcacatgaggtggaattgggtaattacttatctactctgaaaacacacctgtatggatttgcacagaatgtgggcctcctgtgctgctgctttgtgctttgggaacacagtggggagcttgaggc

SEQ ID NO: 93181 - DNA, 601 bp, Human
gtgagactccatcttaaaaaacaaaacaaaacaaaaacacacacttgccaggtgcagtgtctcacacctgtaatcccttgaggccaggagtttaagatcagcctgggcaacaaagcctttctcttcaaaaaataaaacaattagctggcatggtgacgtatacctgtagtcctagctacttgggaggctgaggcaggaggatctcgcttgagcccaggagttcgagactgcaagccaactgtgacagccccattgcactgaagcctgggagagcaagaccctctctcggggaaaaaaaaamcccaaaaaacccacaaaaaacttttctgaagtatgattgacaataccgaaagctgttcttatttagtgtatacaacttggtgagtttggagataagtatacacccgtgacacgatcaccacaatctgtgccacaaacctacccatcacctgcaaaagtttcttactgtctgctttattattttgtttattcatgataagaacacttgacataagacctaccctcttagcaagtttttaagcataaaatacagtattgttaactgtaggcactaagctgcacagatttctaggacttatct

SEQ ID NO: 93182 - DNA, 601 bp, Human
gtaggcactaagctgcacagatttctaggacttatcttgtgtaactgaaactttgtaccctttaagcacttccctgttttccctttctctcaggccctgtagccaccattctactctgcttctgtgggtttggctattttagatttctcatgtaagtggaaatcacagagtacttgtccttccgtgtctggcttatttcacttagcacagtgtcctccaggttcattccgttgcaaatggtaagatttccttctttttaaggctgaataatattccactgtatgcatatagcacattgtcsttattcatctgtctgtcagtggacatgtaggttgcttccatgcattccttgggtactgtgactagtgctgcagtaaatatgggtgtgcagataccttttcaagatcctgatttcaattctttgaatatacactcagaagtagcattcttggatcatacagtagtttattgaagtctcttctgcttggaaagtggaaagatgtgggaatttgggtctcttggatatctccttactcagctcatttttagaaggcaaacctgcaactcagttgatgccttagacttcaaagctgtctttttg

SEQ ID NO: 93183 - DNA, 601 bp, Human
atctacttggaatgtgggatcagggaggagtgtgtgggttggagtcagtgcctgggcatttaaatactttcaacagtaacattaagggtgaaattaattatattgtgaccaaatgttggcgtgttggttaggcagagtcagtgaaatttatgttctttttttgttgatcattttttaaagccgaaagggtttttttccttaggagatattctcatagcctatagacttaaatctttaagacttcaaaggttttgaaagatacacatctttgaaatgtgtagagactttctttgtggactgstacatggttattttgcatacatgctttgtgtgtccctgtgaagaatgcggatttgttcattgttggatgcagaattttatatacgtggagtcaagcttacttatcttgtttacattttcagtcaattaataatgaaagtgatctatctaaaacgtatctgacggccaccccttatctatttttctaaggtagtagctttaataagcctcctttattatggagaaaaaaaaaagtctgtgtatctttttggtcttctagctttagtcattctgatatttctgttagtgtctggagtttagt

SEQ ID NO: 93184 - DNA, 601 bp, Human
tttgtggactggtacatggttattttgcatacatgctttgtgtgtccctgtgaagaatgcggatttgttcattgttggatgcagaattttatatacgtggagtcaagcttacttatcttgtttacattttcagtcaattaataatgaaagtgatctatctaaaacgtatctgacggccaccccttatctatttttctaaggtagtagctttaataagcctcctttattatggagaaaaaaaaaagtctgtgtatctttttggtcttctagctttagtcattctgatatttctgttagtgtctggagtttagttatacccatccaaggacagagtttaagggtagattcgagctgcctcattaactcgccatcattgagaaatgatctgtttcacatacatgcatttattttctaaatgatgaaaatcttctcttgcagttgtcaaaggcctctgcccccccgacctttgatgacaggaaagtttatcaagtggattcttctctctcgcctgcaggaagctgacccattcttgaggttttggattcgttgccacctctgttgttgtactccctctccactgctgcttaagctgcttcttagt

SEQ ID NO: 93185 - DNA, 601 bp, Human
gaagaggatggacagttgttgtttaatgggtacagaatttcagtttgggaagatgaagaagttttggagatggatggtggcagtggttgtgaatgtacttcaaatgcatgtatttcactgaacgctacacttgaaaatggttaagggccaggtgtggtggctcatgccggtaatcccagcactttgggaagctgaggcaagaggatcacctgagcccagaagtttgaggctgcagtgagttatgattgagccattgcactccagcctgggagacagagcaagaccctgtctcaaaaaaaamaaaaacaaaaaacaaaaaacccaaaatttaaaaggccatacagacaatttttaaatgatgaaatgataaatgttctgctatgtgtattttactacaataaaaaattaagcaaatgctggaagaagccaatttgttgaccaggggaagaaataattaaataaaaatttatctcatgctttggtaaataactgccagcctttctttccttaagttcagagcctcgctctcttgacccagtaccaacaggccctttctgggatcatctcacccagagatcataggtggttgttctgagaagcc

SEQ ID NO: 93186 - DNA, 601 bp, Human
tgatagttgtatcaacgaggaagcactgataatttacctgattccatctataggatctttcatttaatttacctgatgccatctataggttctttcatttacagtgattggccagttctctctacaatacgcaaagtgcagagctagcccccttcaaaaccgatactcgattttaaagctgataactaagatatggtgttacggaaaacacaatcctatgctccactctctcatcactactctttaattgcactcgggggaaaaacacatttaattgtttcaacgatcattacttttttttagtaaatttatagtaaatggaggagattaccaaagggctatttttttctcagcttgtggtttctaattacatcagttacagctcagccttcttcttaactagagtgcaggcatgaactggaaaagaatgagctaatccatgatagatcaggtggaataaagatctccattcatatctttaccttttatcccttgttctgagtgccaagaattaatgctatttgaaagtacaaactgaacctgccaagcttcggacagctaagataatcctaattattttaaatgttagtgagaagggcag

SEQ ID NO: 93187 - DNA, 601 bp, Human
aagcactgataatttacctgattccatctataggatctttcatttaatttacctgatgccatctataggttctttcatttacagtgattggccagttctctctacaatacgcaaagtgcagagctagcccccttcaaaaccgatactcgattttaaagctgataactaagatatggtgttacggaaaacacaatcctatgctccactctctcatcactactctttaattgcactcgggggaaaaacacatttaattgtttcaacgatcattacttttttttagtaaatttatagtaaatgraggagattaccaaagggctatttttttctcagcttgtggtttctaattacatcagttacagctcagccttcttcttaactagagtgcaggcatgaactggaaaagaatgagctaatccatgatagatcaggtggaataaagatctccattcatatctttaccttttatcccttgttctgagtgccaagaattaatgctatttgaaagtacaaactgaacctgccaagcttcggacagctaagataatcctaattattttaaatgttagtgagaagggcagcagttccactctggaaaaga

SEQ ID NO: 93188 - DNA, 601 bp, Human; identical to SEQ ID NO: 40581

SEQ ID NO: 93189 - DNA, 601 bp, Human
tttgtctatattcccaacttgtcaagttcaattatcaaatgtctttcaagtcgcatttctaaccgatgttttattagagataacagcactaagaagataaaatatcaaacagcaacaaacaaatcagatacaaccctttttggcactttggggattatgaggacagctatgtgacatattgccaaatgcatgatgcagggcaagaattatgttgatgtaaactttacgtatattttatggcttactctacgtccccccctccaaggtaatacctctaactttataaagtggcattcggaarcaacttaccaaaggtcagaagccagaacccggagtctgaaccccattccaaataccagttaccaatggcgtttaccgtctctgacttaaatacctgcaacaatttgtcaacttttaccttccattcttcacccagagcgtcagcagcaacttctgtggccatacgcttctcatagaaagtacgaagtttgcgttcatcgtccacttcaatgagtttctggcagccagtggctgggaaggagatgttcagctaaggattaaaaggggggaaatagtttacgaaactatctatacaggtaat

SEQ ID NO: 93190 - DNA, 601 bp, Human
tctttctccagttctccttggtctgtaacaggaatgccccttactcagtagcaggcggacacggccatgggtcaagacaccctgcttcatggggaaaccttgtttgtcgttcccaccactgattcggaccacataaccctgcaagagcatacaatgaatgacacatttactatttctattccaaaattatacagtacaggattgtgacctctgtgaacacacctatatgagaaagtataattatgaaaaccaatttgaacttaagcacgttttctctgttcagtgagttttgtctatattyccaacttgtcaagttcaattatcaaatgtctttcaagtcgcatttctaaccgatgttttattagagataacagcactaagaagataaaatatcaaacagcaacaaacaaatcagatacaaccctttttggcactttggggattatgaggacagctatgtgacatattgccaaatgcatgatgcagggcaagaattatgttgatgtaaactttacgtatattttatggcttactctacgtccccccctccaaggtaatacctctaactttataaagtggcattcggaagcaacttaccaaa

SEQ ID NO: 93191 - DNA, 601 bp, Human
aaccgattgttccgggattcactgaagtctttgtaactgcaagacccatcttccaacccgtatgactgaccgggcatgatggctggctgcttggagacacagacattcagcttctgcccaaacatgaagttgttgttgaggtgggtaatgacccggtccacagcgtagccatcagccatctccaccatggcgcccccggcttgcttttcaggaatttcaccttctccacattgccatacaagcagaagacattgaagactaggtcacagttcatcttagattgatgcaagccttagaccaygagcacagggctgtcggcgtgagggccatactcgggtggtgggggagggggtggggggtgcccatactggggggccgtagcgacttgggccccgacagtgacccccgactggtggacccatccttctcccttcgtagtgaggtcgggggggcccgtggccctcatcatggtaatggctgtggtacccaccgtggggccctccatattctgcggggtgatctcccaggagagggggctgcctctggcgtttgttggggttgctgccagggtcaccttgtccactgagattggggtttgtgt

SEQ ID NO: 93192 - DNA, 601 bp, Human
gggtggagaaccgattgttccgggattcactgaagtctttgtaactgcaagacccatcttccaacccgtatgactgaccgggcatgatggctggctgcttggagacacagacattcagcttctgcccaaacatgaagttgttgttgaggtgggtaatgacccggtccacagcgtagccatcagccatctccaccatggcgcccccggcttgcttttcaggaatttcaccttctccacattgccatacaagcagaagacattgaagactaggtcacagttcatcttagattgatgcaagccwtagaccacgagcacagggctgtcggcgtgagggccatactcgggtggtgggggagggggtggggggtgcccatactggggggccgtagcgacttgggccccgacagtgacccccgactggtggacccatccttctcccttcgtagtgaggtcgggggggcccgtggccctcatcatggtaatggctgtggtacccaccgtggggccctccatattctgcggggtgatctcccaggagagggggctgcctctggcgtttgttggggttgctgccagggtcaccttgtccactgagattggg

SEQ ID NO: 93193 - DNA, 601 bp, Human
tttaaagtgaaggttaatcttgggagatatcagttcccctctccctccccctgcagacttccagcgtttccgttaaggttaagcctctacgaacctagcattaaaaaaaaaaaaaaaaaaaaaaggaatacaagatcttttgcaaataacaaaaacaaaaaccaaaaaatggcataaaggaaagagaaataccttcctgctcagatgggactcttcctaggcacctaattagaaggcgtgctgagcggtggagaaacacaacttcagagtgtaagggtatggaccattgggtttttcatcwggtaatggttcaggaagcccggagtctccagggcatcgctcttggattcccattccagcagtccagaggagctgcgctcgctttcgcctgagaatactttcacagaagatggccgcttcactcccagctcatcatagatctcaaagaagttctcctcggtcgcctccagcggggcgttgaagaagtgcagcacgttgctggggtgctggatgcggttcttggctgcctgctctggggtggagaaccgattgttccgggattcactgaagtctttgtaactgcaagacccatcttccaacc

SEQ ID NO: 93194 - DNA, 601 bp, Human
ggtactttaaagacggaattggttaccagatgttagaaggctctagaagttcttgagcaggagtaattatagacatcagtttaccttaaatgggcagaattcagatagataacaacaacaacaaaaagagactgtggaggttattcatagtggactaatttgtttggaaaaaataagtagctataaatcagtatattctagtatctttgagacaacaaatattggaaattgtttttcttttcttttctttttttcccagcaagtgctgtgtttattttccaaacaattttattgaaatgtsccaggagtagatgggcagcacaaatgtatgaacaggaaaaaaaaatcacatgtacaataatttttttaaagtgaaggttaatcttgggagatatcagttcccctctccctccccctgcagacttccagcgtttccgttaaggttaagcctctacgaacctagcattaaaaaaaaaaaaaaaaaaaaaaggaatacaagatcttttgcaaataacaaaaacaaaaaccaaaaaatggcataaaggaaagagaaataccttcctgctcagatgggactcttcctaggcacctaattagaagg

SEQ ID NO: 93195 - DNA, 601 bp, Human; identical to SEQ ID NO: 22605

SEQ ID NO: 93196 - DNA, 601 bp, Human; identical to SEQ ID NO: 22606

SEQ ID NO: 93197 - DNA, 601 bp, Human; identical to SEQ ID NO: 22607

SEQ ID NO: 93198 - DNA, 601 bp, Human
ttaatagcaatagctatcattcattaagtgtttatggcatgctacaaagatgctcttctatgtgcttcttaatacagtagctcatagcaacccatgaaatagaaactattttaacctacattttattgaaaaaactaaggctcagagaggttaagtaacttgctacaagccacacagctaataagtcagtaacacttcaaaggttggttggtctccatgtatttaactttgaccaagaatacttagcataatgtcatgtgcacaatcatcatttaataaattattattgaattgagttactttttttttttttacaaacttctgaactgaagagaacacatacactatggaagttatctacctaaatcagaactattttctatttggaattaactctgtttgtacacttgagtttaatattcttcctcctagcagatgtagaatgtcatcagttttttgtgtgctcacagattttgaactctgctgcttagatttttctttttttttcctttttgaggaattattttgcctggtgttacacttaagagggggaagtaagcgggaacatgaactggtaccaacacatgggggctgtggtcag

SEQ ID NO: 93199 - DNA, 601 bp, Human
aagagcctagagacgtaaatctacaggttgattcggcaagtttggaatttctatatatgggagatggtccaggggaggagggacatcaatttgcaacttgatccctcactggtagttgacgcttgtgattccccaacaggtctacgattctaaatggccagtaatagggtatactagccccctgagtggggttttttttttctcaacctctgtatgaaatattgaaaggatgtcccttcatcatttgcttggcctctcagctctttacacaggctggtaggaactatttagtgaatgacaytgaatgtcaaaaataatatctatgtgttctggtcttggttccaagtttaaacgtctctttgatagaagttgactatttaagcaacagattttcatgtgttttttactccattttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactga

SEQ ID NO: 93200 - DNA, 601 bp, Human
ttttggaaatacttgcatttaaggaaattagtattctctttacattagacagcaagtgacttttattgtgtggaggagaattttgcattacactttcttttctccaacccagtcaagttttatatcttatactctcaacaagggacactggtttctcgctccctgtctctttttaaaaagtttttactgagttataatacatgaacaaaattacacaaatcataacctatagctcaatgatttttcacaaatgatttttcacctatgtaaccagcaccacagaagcccccttcagttgctrtcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacatgccatcaagcccagctttttttttttttttgtattttttagtagagacgaggttt

SEQ ID NO: 93201 - DNA, 601 bp, Human
cctgtctctttttaaaaagtttttactgagttataatacatgaacaaaattacacaaatcataacctatagctcaatgatttttcacaaatgatttttcacctatgtaaccagcaccacagaagcccccttcagttgctatcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcartctcagctcactgcaacctccacctcccgggttcaagcgattctcctgtcttagcgtgcggagtagctgggattacaggcacatgccatcaagcccagctttttttttttttttgtattttttagtagagacgaggtttcgccatgttaggcaggctcctggctctcgaactcctggcctcatgtgatccaccctcctcagcctcccaaagtgctgggattacaggcgtgagccactgtgcctggcccagaatgtacttttttgtgtgtttgccctttttttcactcaacattatgttta

SEQ ID NO: 93202 - DNA, 601 bp, Human
cacaaatgatttttcacctatgtaaccagcaccacagaagcccccttcagttgctatcctcccaaagagcagctactctcctggcttctaatcccatagattgattttgttgctactttaaaactttatataaatggaattatatagaacgtacttttttttttcgagacagagtcttgctctgtcacccaggctggagtgcagtgcagtggcgcaatctcagctcactgcaacctccacctcccgggttcaagcgattctcctgtcttagcgtgcggagtagctgggattacaggcacaygccatcaagcccagctttttttttttttttgtattttttagtagagacgaggtttcgccatgttaggcaggctcctggctctcgaactcctggcctcatgtgatccaccctcctcagcctcccaaagtgctgggattacaggcgtgagccactgtgcctggcccagaatgtacttttttgtgtgtttgccctttttttcactcaacattatgtttatgagattcaccaatgttgtttcttatagctgtagatggcacgttctcactacattcattccattgtgtgaatataccatacttt

SEQ ID NO: 93203 - DNA, 601 bp, Human
gtgctgggattacaggcgtgagccactgtgcctggcccagaatgtacttttttgtgtgtttgccctttttttcactcaacattatgtttatgagattcaccaatgttgtttcttatagctgtagatggcacgttctcactacattcattccattgtgtgaatataccatactttatccattctcccattgatggacgtttggatagtttcccatttggttttatgaatggagttcttatgaacgttcacatacttgtctcttggtacacatgtgcgtacatttgtatggggcatttatatrggcatatgtgggtcataaggttacatatgattgtctctagtagataataacagttttcctggatggttgtgccagtttacactactaagcagaaattgtgagttctagatgcttcatatcctcacaacacttgttgttgtcaggtaagtgtgtgtattgttatcttgtggatttaatttgcatttttctcatgaccagtgatgttgaacactttttcagatgtttattcgcaacttgcttatcctcttatgaagtgcctgttcaagtcttttgccagtttttttaaaattgggttttctg

SEQ ID NO: 93204 - DNA, 601 bp, Human
gagagccatgggctcttgcctcaataatgtgtgaaaccacaaaatccagaattgttccccccataacatcaataacactgagaaacctaattagggagtgccttcacctgcgtgtcatagaagtccaacttagtggcttgcccaggtggaggcttgttttcctcacatcctgagtggcacagaggcaggctgtgcgtggctggtgggggctccgtgtgcccagagtcctgggtaccttctgtcttccacgccaccatcctaagggtgggtttcatcctcactgcttccagatggctgctcyacccccacaggagggtgcggcagggcagaaggggtccctggataggaaagaatcatcaacagagagcagcctgcatctcactggcgacagctgtgttacctggtaaccttgcttttcaaaggagactatgaaaaatagttttaaagtggacacatttccctccccatcaaattgggttttatactttaggaagaagggaagaatggatatagtgtaatcaactaccagaaagggtgtgtactgtagtcatcagattttggaaaggccctagatctgtggctctttatttttgaatcttac

SEQ ID NO: 93205 - DNA, 601 bp, Human; identical to SEQ ID NO: 32296

SEQ ID NO: 93206 - DNA, 601 bp, Human; identical to SEQ ID NO: 19620

SEQ ID NO: 93207 - DNA, 601 bp, Human
ttccttcctccttaacctttcttgcaagtttcttgatgaagagaaggatctcatgatttctgctctgacaacctcccaggcacaagggctgtactttttctctgtcaggtagagagtgattctttggaagtattttctcacagccaggatggagtcctcattcatcaggggagtccctcccacccacacctcctgcatcacacaggcttccaggtcattcagctgctggtaaagttcagtatagagtttgtctagaagcctctcatcccaagcaacagatgagtcctttgtgctgaagagrttgaaggtctgctgaatcacctcatggaggacagagatggcttcagccttctggaactggttgccatcaaactcctcctggggaaatctgaagtcatgtctgtccttcagacaggagaaaagagagattctcctcatttgtgccaggagcatcatggtcctcctgtgacccaggctgtgggtctgaggcagatcacagtccagagagcagcttgacttgcagctgagcaccaccagggccatcagtaaagcaaaaggcaaagccattgtagatgttgcagatgctgttggacttgttgag

SEQ ID NO: 93208 - DNA, 601 bp, Human
atctgtaaagattttgtccctgtggagctaaagaagtgttgcttaacacgtgtgaaacgtttgaaaattttgattcaactcaagtcatggatatagcagaaattaatatttgaaacggcagaactcaagaagtgtgaaatggtgtactagtcaatgagaatcatttcgatgttgaaccagttttcattccttcctccttaatctttcttgcaagtttgctgataaagagaaggatctcatgatttctgctctgacaacctcccatgcacaagggctgtatttcttctctgtcagatagagrgtgattctttgaaagtattttctcacagtcaggatagagtccacattcatcagaggagtgtcttccactccaacctcctgcatcatacaggcttccaggtcattcagctgctggtaaagttcagtgtagaatttgtctagaagtgtctcatcccaagtagcagatgagtcctttgtgctgaagagattgaaggtctgctggatcatctcatggaggacagagatggcttgagccttctggaactggttgccatcaaactcctcctgaggaaatccaaagtcatgtctgtccttcaggcag

SEQ ID NO: 93209 - DNA, 601 bp, Human
atagaatttgcaggtagaacacagagatggataagatgtggggagtgcaggaagaagaacaggatgatttctgcttttgacctggaaaaccaaaaagatgatgatactggtggatcatttcaaagtgggcgataaggggccacgagtgactccttggagccaaggagggtgagtgtaggattccttcctcccagatactgctggttagggggccagaggctgggatgctgaggggcctctttgctgtaggagcagagtgggtggcaggttgagggagggaggaagccacctggagtgagartaattcaagcaatcttttttgtggttcactgcagtgagagatggtccaggcagggagtgaggatattacctggggggtagccatggagagaggcagcaggagccagaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggag

SEQ ID NO: 93210 - DNA, 601 bp, Human
agaggctatgggattaacactgccattgtctgagaggacctcagggagacattgtcctccagcatcagccaagggcaggtggtattcctgacagagggccaaaccagtctttggcacccagatacagggcattctggagggctcctgcagtgtaccatggctcccctgggcagcctcccagctttcattctgggagattaaaaataagacttggccaggcgcggtggctcatgcctgtaatcccaacactttgggaggcccagctgggcagattacctgagctcagaagttcaagaccagmctgggcaacatggtgaaaccccatttctacaaaaaatacaaaaattagccaggcacggtgctgcacgcatgtaatcccagctactcaggaggccaaggtgggcgaatctcttgagcccaggaggcagaggttgcagtgagcagagactgcgccattgcactccagcctgggcgacagagtaagatcctgtctcaaaataataataataataacaacaacttgttaatcatggttgctgtgacaaggaggggatatggtcccattgtaggttggtagtgagctatcaacataatgatatta

SEQ ID NO: 93211 - DNA, 601 bp, Human
gggcccagcaatctaggttttgacaagccttagaatattcagatgtccaccgaagtttgacagccactgacctagagagctttggaaagggtggccatctacatttttaacaagttcttcccttagtgttatagtttcctgttgctgctataacaattttcacaaatggagtggcttaagacaacacacatgaggccgggcatggtggctcatgcctgtaatcatagcactttgggaggctgaggtggatagactgcttgagctcaggcgttcaagaccagcctgggcagcatggtgaaasctcatctctgcaaaaaaaaaaacaaaaaaattagccaggcgtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaaacacacacacacacacaaacgtattctcttacagttctggagtccacaaatccaaaatgagtcttacagggctaaaattaacatgtgtatcgggctggttcctct

SEQ ID NO: 93212 - DNA, 601 bp, Human
gtggcggtgcacgcttgtagttcagctccttgggggctgaggtaggagggtcacttgaacccaggaggttgaggctgcagtgagctgagatttcaccactgcactccagcagcctgggtgacaaagtgagactctgtttccaaaaaaaaaaaaaaacacacacacacacacaaacgtattctcttacagttctggagtccacaaatccaaaatgagtcttacagggctaaaattaacatgtgtatcgggctggttcctcttagaaaaaccatttccttgcctttttcagtcttctgaacckgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttt

SEQ ID NO: 93213 - DNA, 601 bp, Human
acacacacacaaacgtattctcttacagttctggagtccacaaatccaaaatgagtcttacagggctaaaattaacatgtgtatcgggctggttcctcttagaaaaaccatttccttgcctttttcagtcttctgaacctgtagaaccatgagctaaataagcctcttttctttataaattaccctatctcaggtattctgttatagcagcagaaaacagactaagaaaaatgttgtgcttgtaagagattgggacacggacacatacagagggaagaccatgtgaagacacatggagaaygctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcacttcttggcccatggccccacatcatgtccccttttctctccctctgcttctatcattatatcactttcttcctcatttgaccttcttgcctccttgtgatttcatttaggtcccacccaggtaatctaggataatctc

SEQ ID NO: 93214 - DNA, 601 bp, Human
tcttttctttataaattaccctatctcaggtattctgttatagcagcagaaaacagactaagaaaaatgttgtgcttgtaagagattgggacacggacacatacagagggaagaccatgtgaagacacatggagaacgctgccatctacaagccaaggagactgaccttagaagaaatcaatcccaatctcaccttaatgttggacttctagcctccagaactgtgagaagataagtttctcttgcttatggggaaaacctatttccttgcctttttcagcttctggaggcaccagcactwcttggcccatggccccacatcatgtccccttttctctccctctgcttctatcattatatcactttcttcctcatttgaccttcttgcctccttgtgatttcatttaggtcccacccaggtaatctaggataatctccccatctcaagatcctggatttaatcatatttgaggtaacattcccaggttctgggaattaggatgtagctaggatctcttgggacaggggcattgttcagcttgccacactcagcccatgttttaaaaatttatggtctaggggccgggcgcggtggctcatg

SEQ ID NO: 93215 - DNA, 601 bp, Human
tggcaatgttctccatttgtcttcacagggtcttccctctgtatgtggttatatcccaatctcttgtaaggacaacagttttcttagtctgttttctgttgctataacagaatacctgagacagggtaatttataaagagaagaggtttatttaaaagaaatgaaagggagacgagggagataggaaaaggaaacaaaaaagagacaaactttgcttcataacaacccactctcactggaactaatccaacccaatgagagcaagaacaccctcccctgggactgcatgaatcccttaatkggggtggattattaccatggctcatgactcaaactcctcttaaaggtactacctcccagcatcactatatttggggaccaagcctcaacatgagttttgaagatgaccacattcaaaccataacatgaggtatactgcattagggcccatcccagtgacctcatttgatctgaattacctctttaaaaacggcaaatacagtcacattctgaggtactgagagttggaacttcaacctatgaacttaggggagatacaattccatccataaccattacctacaagggtggcctacagagg

SEQ ID NO: 93216 - DNA, 601 bp, Human
atacagtcacattctgaggtactgagagttggaacttcaacctatgaacttaggggagatacaattccatccataaccattacctacaagggtggcctacagagggggtgtcttgtcagagatggagaccccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaaytgttatggcaaccagagctaaaggactgcagtgctcagatcgggctgtgccagctccagctctggctcgcttaccttatcgtgagcttgaggcactcagaggcagcccatctccctggcatgagctagtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttact

SEQ ID NO: 93217 - DNA, 601 bp, Human
accccagctatccctgtggaccctattgcaggtttttaacagtcctcacagcctgagacagttggttgctccctctcatacagctaggcttccaggattttgcaaggccctgacaggcctcaaagccatgtcagcctaataatgagggcctccgtctgctgtgcttgccaaaattgttatggcaaccagagctaaaggactgcagtgctcagatcgggctgtgccagctccagctctggctcgcttaccttatcgtgagcttgaggcactcagaggcagcccatctccctggcatgagctrgtctcaaccgcttggggtgatggtattttgaaaatgccattatagagtgctgggttccttacggcagtgtgcccaggcctcaaagtgatggtgaatggtttctgggacaaagaagggttggtaaaatctcctgtagccaggtactagaagaaatagacagagtaggggttactatgcaccctttccacattgctagaagtaactgttctgaccaggtgaactggtatttggataaatgctttcacagtctcagagaagtcagacccttggattgatttgctcttgaacaaaaaaattttt

SEQ ID NO: 93218 - DNA, 601 bp, Human
ccattacgtagcaaccatggcagaggttgcaggcagccatcatattcttggcatcaaagaactgccaagtgggctcacgcaccatgagggcccagtactgctggttgtcccagctggtcagcagggggaagccatacatgaagtgcaggtgggggaacaggaccatgtttgcggccagcttctgcaagtcagcattgagttggccagggaaatgcagacagatggtgaccccactcatggctgcagacaccaggtggttcaagtcactgtaggtaggtgtgggcagctttagggttctgargcagatgtcatagagagctttatttattatcattgcagaaggtctagttttgagaagtttggtttgatggtcagtccgtggaaaagtgtggcatgagccactagcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagg

SEQ ID NO: 93219 - DNA, 601 bp, Human
gcttttaaaatctgtcaaggaccttgattgactccctatttcagaactctatcttgtgtaataaagaagtcctggctgggcagaaattccatctcaggtcttgaacacatttcctacacagtctagaattaactggactgaggactgacgcttcctgcccaggaggcctggcaaggtcttgtcattgtttcctgagggtggatgaggtcattaagaaagagttttcctcccctctgagatgattcactcagatacctggagtcactgtttctgtgcttgttctgtgaccttcgtcatgaayttgacctctctgagcatgttgtctcataacatggagacaaataacttttctaataaggtataatgttatggaggactccaggggatattgggagagggcacatcatagtggttaagcctgaaagacctagatttgtatcccagctttgctccttatgattggcccctggacgaggtttttaatttttgtgcttctctttcttcgtttgtaaaacgggtaacattctatagggcccatcttatggtcctgatgatgaaataaggtaaggccactgaagcacttagcacagtgcctttaaca

SEQ ID NO: 93220 - DNA, 601 bp, Human
gagagtgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccagrtgaggatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcc

SEQ ID NO: 93221 - DNA, 601 bp, Human
tgagctcaggggctctgaaattcagcgggacacctggttagcatttctcaacaactgctacaatgctgggcaagttcacctaaactcagagggtggctccaaacaaagcccaactcgatttgtgtatttgatcccgagcatccagtgttgaatccagaatctgagatgccctggctcagggaacacccagaaacagccaggccaaagtggtgataagttaaaaagctagtagctgaatccccagggagctggctgagagtaatttcagagtcagcagttcatatctgtgtcccaggtgagkatatgggctggatggtttcttagcctcctcatgacctgtggtgcttcagaggtccacggaatgaaggataagatggagaagccaggctaaggaaggattgggatttcctaaaacagtatgaatttttgttattttctattgaagtgccgtaatttaaatgtattgacttaagtgaacacttctgttgatttgaaagctataatactggttactctttgttcgttgacataaaagtatgttaacctgctgtggttttaataatatacctccacaagatggcgccaacatcaaagcctggct

SEQ ID NO: 93222 - DNA, 601 bp, Human; identical to SEQ ID NO: 25046

SEQ ID NO: 93223 - DNA, 601 bp, Human; identical to SEQ ID NO: 25047

SEQ ID NO: 93224 - DNA, 601 bp, Human; identical to SEQ ID NO: 25048

SEQ ID NO: 93225 - DNA, 601 bp, Human; identical to SEQ ID NO: 25049

SEQ ID NO: 93226 - DNA, 601 bp, Human
tggagtgcagtggcatgaactcagctcactgaaacctccgcctcccaggttcaagcaatgcttctgtcttagcctcccgagtagctgggactacaggcacatgccacaatgcccagctaatttttgtatttttagtagagatggagtttcgtcatattggtcaggctggtcttgaatcaggagatcacccgcctccgcctcccaaagcgcaaagtgctgggattacaggcgtgagccactgcacccagcctgtgttaagcttttcattgtgagtttttgttttttaattttaattgacaartgataaatgtatatatgaggtataacattatattttgatatatgtatgcattgtacaatgattagcaaagctaattaacatattaccccacatatcatctttagtggtgagaacatttgatttttactttaacaattttgaaatacataatacgttgtcattagctataatcaccatgcagtataatctcaaaaacttattcctcctgtctaactgaaattttgtgctttgatcaacgtctccccaaaccccagcccctggtaacctttctactctttacttctatgagtttgacttagt

SEQ ID NO: 93227 - DNA, 601 bp, Human
agatctcaaactctgtgctgggagaaccactactctcttcaaagctgtcagacagggacatttaagtctgcagaggtttctgctgccttttgtttggctatgccctgcccccagagttggagtctacagaggcaggcaggcctccttgagctgtggtgggctccacccagttagagcttcccagccactttgtttacctactcaagcctcagcagtggtgggcgcccatcccccagccttgccgccgccttgcagtttgatctcaggctgctgtgctagcaataagcgaggctctgtgggygtgggaccctccgagctatgcacgggatataatctcctggtgtgccgtttgctaagacagttggaaaagcacagtattagggtggcagtgacccgattttccaggtgccgtctgtcaccccttccctttgctaggaaagggaattccttgaccccttacgcttcctaggtgaggcgatgcctcaccctgcttcggctcacactcgatgggctgcacccgctctccggcacccactgtccgacaagccccagtgagatgaacccggtacctaagttggaaatacagaaatcacctgtcttc

SEQ ID NO: 93228 - DNA, 601 bp, Human
attagtatttccttagtattagatatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggrtccttccttctgcatcctgtcggaaggcatgtgatgtccagttgtcccttcataatgcgatcgatcaggtgccagaggtgctggggttttgtttattattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaa

SEQ ID NO: 93229 - DNA, 601 bp, Human
atatctaggaagttctctctattgtctcatgaactttttttttaatagttggtttgttcaaataagggtccactcattacacacataagcttaataagccttctagtctggaagattccaccttcttttttccttttccttttactgcctatccacattctggatgttactaattgtatcaagtgtcatttagtgtcttctcccggcccctgtgtttgctataaactggatttagttctggtggcctgatcagaaccaggtttgaattcttggcaaggatccttccttctgcatcctgtcrgaaggcatgtgatgtccagttgtcccttcataatgcgatcgatcaggtgccagaggtgctggggttttgtttattattattattattattattattattattattattattatttaactgcacaagtaatatatattgttcctttacccccccaaaaaaacaacaataatagactgccaaatttttggaccttttctgcatttagaggtagttgaaatcacaagggaaagtggtggtctctaggtcagggatcccccacccctgtggcttgttaggaaccgggctgcacagaagaaggtg

SEQ ID NO: 93230 - DNA, 601 bp, Human
gtttcatcttgactctgtttggccctgtgcaaatcactttacccactacacgttggttctttcttcccaatggagggctgaattgcaccatctctctctctcattcttttgttgtttttttttttgtttgtttgtttttttgagacagtcccactctgttgcccaggctagactgcagtaatgcaatctcggctcactgcaagtgtgagccactgtgcctggccaggctccttttccctacactgcccgtgtattctctccagggacttacctagaaccacacacattggcctattgccgwaagtttgtcagcacgttgtctcagaaaaaaaaaaaaatcctcatcctaaagtgttcttcaaaggctagcgagattgtttaataatacggctattcttattttatagatggccaagctaaagcacatcattttcttttccttcagtgccagcatgagcagggcggggggaccaacctcagatttaagaaagacatgtggctgatttttagggttgtttttagaaacattagatttcttctctaataatgaaatatacttttgaaggactctgacaatgctggaagctcttttaagaaaaat

SEQ ID NO: 93231 - DNA, 601 bp, Human
atacttttgaaggactctgacaatgctggaagctcttttaagaaaaatgtcattcttatctgaaaatctttttttttcttctctctctcatgctacattacagctgatgaagttaaaaagcctgggcataagaaaaggggagccctgggtgtgactgccctggaaaaagaggtagagagtgcagtgggttcaagtatgtttgggtatgtgcagtcagtctttgtgtctttctcattcaagtaaattccatagcaattaaagtgaaaataatcatctttcatttgtgagtagagcatccatrgaaagcaacatatatcttggtctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagc

SEQ ID NO: 93232 - DNA, 601 bp, Human
ctagaacttaaattccaaaagaatgtgttatatttttcattttcccgtttttgttgcacagggacgagtttcctgatgcttccttgccataggccctgggctctgtgtgtagtgttcttcccaaaccaaaaattaaaaataggaaaatcagaatctataccaagaactttgtctaggaggcttgtctgcagtaggtttcttcagtgcctatgcctcctgctggattgtgtttgattaatccatttcttttaacttgtacaaggtccccattgttagagccacaagtcatttggccactgarggtaaaagatggttaggagtgggatttgttccacttctttgcagcgattaaacagtcagtttgaactggggaaagtatttgacctttagtctgtcctaaaagaatgtcatcaggctgtttatacattaaaaggctctcataagatatgtactcccagattcataattttggaacttctctcctatggtacacacccttgtatgtatgcacacctggctctcactgagtcacttatgggaaactgaagcaagtttttctattaataggggaaaaaagacctcataaaagagtcaaagtaaa

SEQ ID NO: 93233 - DNA, 601 bp, Human
ttctacagttgctcttctttctctttaccattaatcctgatgattgtaggaaatcagtacaccatatttattatgcaaatctaagaaaaacaactagatctataaactatttgaaaagatgcccacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaatttttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgag

SEQ ID NO: 93234 - DNA, 601 bp, Human
cacattgtatttttttgttgtttttttagataggatctttctctgttgcccggggtagagtgcagtggcctgatcgcagctcactgtagcctctacctcctgggcttaagcaatcctcagcccgtctagtagctaggattacaggaatctgccactgtgcttggtaatttttttttttaaggagatggggtctcactatgttgcccaggctggtttcaaactcctggcctcaagcagtcttcctgctttggcctccccaaagtgctgggattataggcatgagccactgcacccagctacrtattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggtta

SEQ ID NO: 93235 - DNA, 601 bp, Human
tttttttttaaggagatggggtctcactatgttgcccaggctggtttcaaactcctggcctcaagcagtcttcctgctttggcctccccaaagtgctgggattataggcatgagccactgcacccagctacatattttttagaaaaggatcagatgagtaggacttgctcaactgctatcactgtcagaaatatctcaaggtgaaacttgcaaacatatcagtaaggagaaggatgagatttcttttttaatagtcttctttatcaggaatgttttgcagatattgattttttttttttttacaatgagaaaaatatgaccaaaaactgaatattaaaggaagcagagtgtgattcccggtgctaaacagtttctataaaatgtggctaataacatattggcctgttgtgcctaaggcctgtgtttgggttatgccttctcaaagaatgcagtggaagaatctcagcttagaagtgaggacatccagaattctttcctggctgtgccgtgaaattcctttgtcacttagtgtcctcatctgctaaatgagggtgttgaattgattcctaaaagttctggtatcctcccctcttcagattat

SEQ ID NO: 93236 - DNA, 601 bp, Human
gtttttaacccttactgttcttacttcttcttactcatttccctcactctttagctgagaatgtcacctccacctttatagagaagacagaaacttaagcataaactcttcaccttccttcaccttccctttccccagttacttgcgtccctgttctttgtcatcctcttgtctgtagctgtccttgaagtggtgtccactattcccctggatgaggttcattcttacgttctgttccataacctagttgtgttattaacttcccatcatacatccttttattaaaaatcctacactaccrgtttttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtac

SEQ ID NO: 93237 - DNA, 601 bp, Human
tttgagttcctattaggtgtcacaatcagttaatcccacttacggcatacagcagtcattattccagtttatacttgaagaaacttaggcccttactatgtttctggcactgcttattatcacagctctagaagacatcttctatctaccttatccttcccttttacaaaaggtgagaaaactgaggcccaaagaggttgttgtcaccacctatgtagagtgaggatttttatttttgtgctattgtttagcatgatctcatgaaatataatagaaaataaggggaaactatggtacctgyttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccacacccagct

SEQ ID NO: 93238 - DNA, 601 bp, Human
ggtacctgcttattgagcagccttccttgactgggatataaacatccattggttttcctcctttttcatgccaccacaagcactcaggggcactcttgataccagaacagtgggaggatcttagtgatattggtccaaattcataagttttcacttctcttttttttgagacaagatctcactctcgcccaagctggagtacagtggcgccacagctcactgcagcctttacctcccaggctcaggtgatcttgccacctcagccccccaagtagctgggactacaagggtgtgacaccayacccagctaattttttgtatgtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccg

SEQ ID NO: 93239 - DNA, 601 bp, Human
gtttttgtagagacagggtttcactatgttgcctgggctgatcttgaacatctaaactcaagggttccacccaccttggcctcctaaagtgctgggattacatgtgtgagcctcacttccttctggttatagagacagaattgttccacttcttagtctgatgtttctgtcagaattttttctcatgactgcctattcacgctgctgtttgattcttgggatatattttaaatgatgggtagattcacttcccctaaaccgtcctccttatgagcagccgttattctgctctgccagtaarttaattgactcacgattctgcatgttggggcttgttgtggatacagaccgtattctgaaatgtcctcagaggtcgatgattgtgtttgcttctgccaggggatgggtgtttgccctcagcttgtttgcaacaccacatttcctcaaaggaaacgtattaactaacagctatcttcaagccaatgtaagagtcttgattcaagaaacaacctaccagtcagtctatttctaggcttttctccctctctttgaaagtgccagtgttcttcctttcactctcttgaactcatttttcctgcca

SEQ ID NO: 93240 - DNA, 601 bp, Human
aaagtgccagtgttcttcctttcactctcttgaactcatttttcctgccagcacacatcattttgtctcctttacttttccataggctgtttttttttatttgtctactagcttttcttatcacatatccctgcttgacaaccttaagcaatttgttggatacccttgatttgaggcccatcaatatgtcatactttgggattggcagaagaaatgtttagaagcatattttccataaatgatagtgacaagtgccaagcacttgcttcatgttgtctcattcagttttcacggggacttyataaggtaagtgggattactcccgtttaaggaaactgatataactgaggtgcagagagacgagagtgactttcccagaggcacacagctagtgagtggtaaagccagtagataagccagtccctgaaatccgtgttttccagtaggatcccaagctatggggagataaaaattagtccccttgcctagctagagggctttaaaggttaaagcaagaggaagaagcagaccttatcttttagttctgtaagtttggagtgtatcgtgggtctcactgaaactagaaaaattgtcagcacgg

SEQ ID NO: 93241 - DNA, 601 bp, Human
ataaatacctaaacacgttagttattcagataatgttaacacctgcatatagagagtagatgatttcttttagcatttatgttttatcctacataatcacagaaaacccatttccttatagttaacagcaagggcacctaaactgaggacacagggttgggagaaatatttctagtctcaaacaagaatttggaatctaaaaccgagtactgagggaagccatttcggagataccactgcgcattgattttctctgacttctaggaaagtacgtcttttacttggttttttttttttttttaaaaagtggcaggcgaagtttgtatatgtatgtatagcatgtttctggatagttatccacagaatgtatcagaatgctgctagtcttcctctgaagcacagatctgtccacataatagatttgctatcctgggggaaatgaagtatggataaaattcttgtccacttcaaaatgggggcagcttgggaagaaatagtctaaggagagaatatgcatgctcgtatgaatctgaggtcagttctcaggcaaaatacagtgacttggggaactaggagtagaggtagatggggaaagcacaat

SEQ ID NO: 93242 - DNA, 601 bp, Human
aaaaaaagctggtaacaggaaacagggaagatggcagataagagacagggctggccaccacggtggctcacgcctgtaatcccagcactttggaaggccaaggcaggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactscagcctgggtgacagagactccatgtcaaaaaaaaaaaaaagtaaagaaaagacagggctaacgtgcagcttccacaaggacggacagaatagcatatggagacgctatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatc

SEQ ID NO: 93243 - DNA, 601 bp, Human
ggcggatcatgaggtcaggagatcaagaacattctggctaacatggtgaaaccctgtctctactaaaaatacgaaaagttagccaggcatggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacrctatgatcttttgttccaagaaccactgtaggaacttaccgggaaaaccaaaagaattcaaagatcctttgaaagaagtggcacaccactgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccag

SEQ ID NO: 93244 - DNA, 601 bp, Human
tggtggcaggcacctatagtcccagctacttgggaggctgaggcaggagaatcgcttgaacctgggaggcagagcttgcagtgagccaagattgtgccactgcactccagcctgggtgacagagactccatgtcaaaaaaaaaaaaaagtaaagaaaagacagggctaacgtgcagcttccacaaggacggacagaatagcatatggagacgctatgatcttttgttccaagaaccactgtaggaacttaccgggaaaaccaaaagaattcaaagatcctttgaaagaagtggcacaccaytgcaaattctgcaaaacaggcaagaaactgagttcccaaagtgtgagtcggggagaacctacctctgaatacacatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggc

SEQ ID NO: 93245 - DNA, 601 bp, Human
acatccccactggggaaatctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccargggactaatgggagccgcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccaccc

SEQ ID NO: 93246 - DNA, 601 bp, Human
atctaaaaatccagatcatggaggaagaatttaaccttacctagaggtgaaacggatttagggggttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccrcagcagatacaagtgagtacaggagctgctgctgatggagtgggcaggtgggaaggggtgaggtccaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttccc

SEQ ID NO: 93247 - DNA, 601 bp, Human
ttatgtgaaatatgaaagtagaagtagcaacaggaagtgctttggatgtactcccagtctccagcttgagtccagggaagccagccctgactatatctcacagtggccctcaggtaaggcagccagtggaattggagagtgatggcagggcgaaggaagctcccaaatgaaatcagtagtggtttcagctggtcacaaattttctcaggcagagtccaagggactaatgggagccgcagcagatacaagtgagtacaggagctgctgctgatggagtgggcaggtgggaaggggtgaggtycaaaggccatgcttgctttcccagtggggtagctcacagcctggggcaaggtctgagcagggcactgcaggagtgagactagcctcaccaactgcatagtagctggatgaggcctcttgctgctggctctcccccactaccctggtaaagtttatgatacagcagaggcagtcaagatctcctctggaacataaacccagtggcctgacaaaccacccccatcccccaatttcccacagtgtctgcagcaagccctgcccaagaagagtctgagcccagaaccacctaaccctgccccaa

SEQ ID NO: 93248 - DNA, 601 bp, Human
ggaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaaraaaaagaattttaaaatgaaattttaaaagaaatttgggtttatgttaaatggccaaacctaagaataattggtgttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaagg

SEQ ID NO: 93249 - DNA, 601 bp, Human
taaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaagaaaaagaattttaaaatgaaattttaaaagaaatttgggtttatgttaaatggccaaacctaagaataattggtsttcctgcagaagaagagaaatctgaaagtttggaaaacttatttgaggaaaactttgctggccttgctacagatctagacatccaaatacaagaagctcaaagaacacctgggaaatttattgcaaaaagatgatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtccca

SEQ ID NO: 93250 - DNA, 601 bp, Human
gatcagctaggcacatatttatcaggctatctaaagtcaagatgaaagaatcttaagaactgtgagacaaaaacatcagataacctataaaggaaaacctatcagattaatagcagacttctcagcagaaatcttacaagccagaagccagaagggattggagtcccatttttaacctcttgaaacaaaattattctcagccaagaattttgtatccagtaaaactaagcttcataattgaaggagagatagtctttttcagacaaacaaatgctgagagaatttgccactattgagccarcactacaagaaatgcttaaaggagttctaaatcttgaaacaaaacctcaaaatacaccaaaatagaacctcattaaagcgtaaatctcacaagacctataaaacaataatacaatggtgaaagaacaacgtctttaggcaaaagctagcatgatgaatagaacagtacctcacatcccaatactgatgtcgaatgtaaatgacctaaatgccccacttaagaaaagatacgcaatggcagaatggataaaaatctaccaactaagtatctgcagtcttcaggagaatcacctagcacaca

SEQ ID NO: 93251 - DNA, 601 bp, Human
acagagaaagcaggaatccttcctaattcattctgtgaagccagtatccccctaattacaaaatcagaaaagaacataataaaaaaagacaactacagaccaatatccctgatgtacgtagatgcaaaaatcctcaacaaattactagctaaccaaatccaacagcatatgaaaaagataatacaccatggtcaagtgggtttcataccagtgatgaagggatggtttaacataggcaagtcaataaatgtgatacatcacataaacataatttaaaacaaaaatcacatggtcatctcartagatgcagaaaaagcatttgacacaatcctccatctagttataattaaaaccctcagcaaaattggcatagaagggacgtacctcaaggtaataaaagccatctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaat

SEQ ID NO: 93252 - DNA, 601 bp, Human
atctatgggctgggcacggtggctcacacctgtaatcccagcactttgggaggccaaggcgggcggatcacaaggtcagatcgagaccatcctggctaacacggtgaaaccccatctctactaaaaatacaaaaaaattagccgggcatggtagcgggcgcctgtagtcccagctactcgggaggccgaggcagtgaatggcgtgaacccgggaggtggagcttgcagtgagctgagatcacgccactgcactccagcctgggcaacagagcgagactccgtctcaaaaaaaaaaaaaaaagccatctatgacaaacccacagccagtgttatattgaacagggaaaagttgaaagcattccctctgagaactgaaacaagacaagattcccactttcaccacttctgttcaacataatacaggatgtcctagccagagcaatcagacaagagaaagaaataaagggtaaaaaatcagtaaagaggaagtcaaactgttgctgttcaccaatgatatgatcgtatacctagaaaaccctaaagactcatccaaaaagctcctagataaatgaattcagcaaagtttcaagatgcaaaatca

SEQ ID NO: 93253 - DNA, 601 bp, Human
gtgtaattatgaccttattattgtctttatttgaagattatgtatgatctcaggagatgtgtatggattcatgtggacttgtgatggttaacactgagtgttaacttgattggattgaaggatacaaagtattgatcctgggtgtgtctgtgagggtgttgccaaaggagattgacatttgagtcagtgggctgggaaaggctgacctagccttaatctgggtgggtacaatctaatcagctgccagcatggctaggatataagcaggcagaaaattgttaaaagagagactagcctagtmccccagtctacatctttctcccatgctggatgcttcctgccctccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcg

SEQ ID NO: 93254 - DNA, 601 bp, Human
tccaacatcaaactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgkgagctaagccatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagc

SEQ ID NO: 93255 - DNA, 601 bp, Human
aactccaagttcttcagttttggaacttggactgtctctccttgctcctcagcctgcagatggcccattgtgggaccttgtgatcatgtgagttaatacttaataaactcccctttattagttatgtccctctagagaactctgactaatacaatggaatactacttagccataaaaaagaacaaaatgatggcatttgcagcaacctggatggagttggagaccattattctcagtgaagtaactcgggaatggaaaactaaatatcgttatgtcctcatttgtaagtgtgagctaagcyatggggatgcaaaggcataagaatgatataatagggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgaca

SEQ ID NO: 93256 - DNA, 601 bp, Human
ggccgggcgcagtggctcatgcctataatcccagcactttgggaggccgaggtgggtggatcacaaggtcaggagttcaagaccagcctggccaagatggtgaaaggggtctctactaaaatacaaagaaaagaattagctggccgtggtggcgggtgcctgtaatcccagctaatcaggaggctgagccagagaactgcttgaacccgtgaggcagaggttgcagtgagccaagatcgcactaatgcattccagcgtgggcgacagagtgagactccatctcaaaaaaaaaaaaaaaaaatgatgtaatggactttggggcctctgggggaagtgggagaggagaatcagggataaaagactacacattgggtatagtgtacatttcttgggtgacaggtgcatcagaatcccagaaatcactactaaagaacttatatacatcacaataaaccacttgctccccaaaaactattgaaatgaaaaaaaaaaaaaagcctggtaataatggtttcccttgggaagggacagtggttttccttgtactatttaagttttgtaccatgtacaaatacgtgttccaaaagcagtgttacttcta

SEQ ID NO: 93257 - DNA, 601 bp, Human
cactaccacatccgtctgtttagtagttcagtgattacacgaggtaagaaaatgaaatcatcttaaactcagacctggaccttgaccctgtatttgatattttttgctgccttaagatagtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatayggttcagttattcaggatctttaaagacattattgaaccagcgggagtgggcttgttatgtcttaactttaggggggaaaagggggtggggtagagatttaggcttttgcatttataacatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaa

SEQ ID NO: 93258 - DNA, 601 bp, Human
agtgttagctgttcttgaaggaatgcaaaatgctggttcaggtggctgacatatattcatagcctccatttcttcctcctcctcataagcatggtacctatctcccaaagtgccagagtgacagtgaggacttgtcaagagccattcatctctagaagcactgtgaactttagccaagcatatggttcagttattcaggatctttaaagacattattgaaccagcgggagtgggcttgttatgtcttaactttaggggggaaaagggggtggggtagagatttaggcttttgcatttatarcatatactttttagggaaaagtgttaattaagcataattttattttcagcatttataagataaacatgatgtagcatcaactgttcattgtccatagcttgctaaattttgagttgccaagactcttgtgaaaattctgtttcccattgcagtggcatagtgtaagttattttttaaggaaataggttaatttgtttatgtgatgaacacatgtgcaggtgagactttgcccagattggagactttgactttgagtcactccactttatttatatagtatcccaggaaggttagccaaat

SEQ ID NO: 93259 - DNA, 601 bp, Human
ccgctcttttccacccagaaaagcagccactcaagttttaagaatggatgtatgccgcggacgttttcgattaggccgttttctctcaggcactggaggatattcgtggctgcaggaggcgcttccaccctttcctcaacctagcaaagaagtaactgaaactaacccaagggttacaaccgaaaagccccttccagcttcagaagcagaactggaagctcggatagacttctccgcctctacactcctggaaaacccgcagtggatttcaccaacttcaggatcggagcccaggcaggcraacgtaccttattgcgcatgctcgctagcccctcccgctcggagcggaagggggagcgctgggggcctgggcctggcctggccggggcgtcggcaccggcggccatcttggcttcccggggaaaggcggcgtgaggggaagaagttgtagggtgggggcaggagtgaggaggagggaagagagagggggaggaggccgcggcggggcagggcggggactgcctgcctgcctgggttgcggaagtgatagccgccgaccgagcctgctgctttcttgctactgcttcggcttcccggctac

SEQ ID NO: 93260 - DNA, 601 bp, Human
caagcgcgctgcaacttccttagttttgtcaaagccgcttcctgctttcagtcttttatacccttataaggtagtttttagtttccaacctgagcacatcttactagaacttttaagcaggttttaaagagactgaattaccggtgcttggtgtccatttatatgacttaaaaaaatgtacttatgtttcatggagtgggggaaaggaagcaccctggaaaataaactaatttaagttgtattcgttcattctgtgatggtatcttgaaggaagcaggaaggtatagaggtatataggagkgtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttttttttttgagggggaagtcagtaagaggtggactgtcaggctttttttt

SEQ ID NO: 93261 - DNA, 601 bp, Human
tgtacttatgtttcatggagtgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcasgatgacatataggaaagtggtttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaac

SEQ ID NO: 93262 - DNA, 601 bp, Human
tgggggaaaggaagcaccctggaaaataaactaatttaagttgtattcgttcattctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtgktttttttttctgtgctgatgacatctctccaattcccagaacactcccagttttttttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctat

SEQ ID NO: 93263 - DNA, 601 bp, Human
ctgtgatggtatcttgaaggaagcaggaaggtatagaggtatataggagggtgtttaagttgcaaatagttactcgtagatatgtagggtagtttgcgaaaatgtagagtggctttaaagtgtggtcgttcattttgtattaatagacgttttagagagttgtaccacactcataactgcatagagaatagactacccttatttttatgtagaatcactgcttcaggatgacatataggaaagtggtttttttttctgtgctgatgacatctctccaattcccagaacactcccagttttatttttttgagggggaagtcagtaagaggtggactgtcaggcttttttttttattattaattataattattgatttcattattgttacttaaaagattgtgtgtccttcactctttatgtgaaatttctttaatcttcattctcataactagctagtgtggcagtttctaaaatcccagttaggtagagagaaaccaccaacttcttaatattctcctaggaaaacactagccttggaacttctatgtatttttttgatgaacactttatttaaaagtttttccttaattcagtctcattt

SEQ ID NO: 93264 - DNA, 601 bp, Human
attaatgctttagaaattactgcgttttcaaaaaaatagtgtaaataattgtggccctgagaaataatatggtaacatctcaagtagtatgttacttttctaatctccattttcccccttttgaaatagtttcgaattagtatacaagatgtttcattgagataaactgtccttaagtgacctcctttcctaaagggcaaccttgaatttaaaacatgctgaatgaccagtaggatcgggaagaggggttcaatttaacctaggctatttctgttttaaaattacgattatcacaatagtrtatttttaagttattacattggtttctccaataaggagaggttattaactgcacattgatgatttgaatggaactgattaggagtccccttgccacctcactctcttttaccatttgtcacaatctgaaattccccctttagagtttcagttattttggttctcaaaagcctttttggtcttacaagtttccagtggtgcctcctgggaagttacaccttcagctttatttgcacatggaggataagtccttgaggttgaggaccctgagataaacatctctaagtatggccttaacagg

SEQ ID NO: 93265 - DNA, 601 bp, Human
gcacattgatgatttgaatggaactgattaggagtccccttgccacctcactctcttttaccatttgtcacaatctgaaattccccctttagagtttcagttattttggttctcaaaagcctttttggtcttacaagtttccagtggtgcctcctgggaagttacaccttcagctttatttgcacatggaggataagtccttgaggttgaggaccctgagataaacatctctaagtatggccttaacagggagcttttacatttcaaaattctgtggtccccgaatgcaaattgtgcacckgtaatttgtctaattttttttatgctttagagaatgcattcagctctgaggtctctaaattacaattactcacttagtttaagtaaaaagttataacctgaatcaggttgctcatttcattcattatataaattaggggaaaggtggctgaaaaaaagtggccatctgtaaaacttgatcgtcttagataggaaagctgttaagagttaggaaacttgaaacttaagcccaaaacttttagggatcgtccagcaaaactcaacatatgaatcacctagattcaggtcataaaagagaata

SEQ ID NO: 93266 - DNA, 601 bp, Human
atagattcccattggtggcttgaaaactaaataacagaactcaaacctgctattagtggtgagaaaagcattttctttaaaaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccasgttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcgctccttattaactccttgttatatcgtagct

SEQ ID NO: 93267 - DNA, 601 bp, Human
aaggcattcacaaacattttttaaaaaaacattgtaacacttgtatgatcatcctaaggtttttttttttctgggcggtggaagggatcgttttttaaatgtgttttttgctttttgtttttttgtttgtttgtttgtttgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttctmtttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcgctccttattaactccttgttatatcgtagcttggttacagagctgcattgtgaatttccttttcccttttatgtctttttttttcccctggtaaataaaatattggtaaat

SEQ ID NO: 93268 - DNA, 601 bp, Human
tgttttgagatggagtcttgccctgtcgctgggctggagtgcagtggcacgatctcggctcactgcaacctccacctcccaggttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttraatgcatgtttttactcaagtttctccatcattcaagccaaatgagggcgctccttattaactccttgttatatcgtagcttggttacagagctgcattgtgaatttccttttcccttttatgtctttttttttcccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatat

SEQ ID NO: 93269 - DNA, 601 bp, Human
gatctcggctcactgcaacctccacctcccaggttcaagctattctcctgcctcagcctcccgagtagctgggactacaggcacatgccaccacacccagttaatttttctctttttagtagagatggggtttcaccatgttgaccaggatggtctccatctcctgacctcgtgatccacccgcctcaacctcccaaagtgctgggattacaggtgtgagccaccgcgcccagccttaaaggttttttttaaatgcatgtttttactcaagtttctccatcattcaagccaaatgagggcrctccttattaactccttgttatatcgtagcttggttacagagctgcattgtgaatttccttttcccttttatgtctttttttttcccctggtaaataaaatattggtaaattagttccactgattatgatagcagaggttaatatagccctatggtcaaagtcttggatatattcatatctggagcagattaaggaattttgctaactgacttcaacttcttagcaatcttaaaatgtaagcttaaatatcttgtaggtgtcagtgaaagaggagtatgttcatcttgtggccacaattc

SEQ ID NO: 93270 - DNA, 601 bp, Human
tgtgcgtattgtttaataataatgctgtttctttttttttttttgagatggagttttgctctcatcgcccaggctggagtgcagtggcatgatcttggctcactgcaacctccttctgcctcctgggttcaggtgattttctgcctcagcctcccaagtagctgggattataggcgcccactaccacgcccagctaaattttgtatttttagtagagacagagtttcaccatgttggccaggctgttgttgaactcctgacctcaggtgatccacccacctcatcctcccagagtgctggrattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggctta

SEQ ID NO: 93271 - DNA, 601 bp, Human
ccagctaaattttgtatttttagtagagacagagtttcaccatgttggccaggctgttgttgaactcctgacctcaggtgatccacccacctcatcctcccagagtgctgggattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcytacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgag

SEQ ID NO: 93272 - DNA, 601 bp, Human
gaattttaggcacagaacggaaaggtcctgtggaggacctgctggccatgctttctgtgacagctattttttaacctaattttataagtgaaaaaacagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaatctcagccttatgaatttgattcacctaattagagaaaaccctctgtgtaatctttacttggtttaggttccccccccccacccccctgccgatatgtgaatgcctagactatttccttgttactttgcttaaatttaatctctagaaaaaaattactctctaggttgtgtttctcaggaaataataatagctagcatttatcgagaattgtatgtcagcccctgtgctaaatgctttatattatctcattaactttcacaacaacctggaaagtattatctttgttttata

SEQ ID NO: 93273 - DNA, 601 bp, Human
cagaatgagagaatttaaattacctttttgatgccgtctacctggcaggtggttcgatctgctatttggacctgagttctgtatttaagtcctgtgttctttctgttaacactccggggactcctgactgccttttcagaactttatgtgttgcttcattgttgttagtaaagttaactgtatttctgtttaaagaactcttacaaaaaaaaatctcagccttatgaatttgattcacctaattagagaaaaccctctgtgtaatctttacttggtttaggttccccccccccaccccccygccgatatgtgaatgcctagactatttccttgttactttgcttaaatttaatctctagaaaaaaattactctctaggttgtgtttctcaggaaataataatagctagcatttatcgagaattgtatgtcagcccctgtgctaaatgctttatattatctcattaactttcacaacaacctggaaagtattatctttgttttataggctagaaaatttagtcttaagagaggttaagctacttacccaagatactgtagcaagtaagtatggcagagccactacactagatcttccttccg

SEQ ID NO: 93274 - DNA, 601 bp, Human
agaattgtatgtcagcccctgtgctaaatgctttatattatctcattaactttcacaacaacctggaaagtattatctttgttttataggctagaaaatttagtcttaagagaggttaagctacttacccaagatactgtagcaagtaagtatggcagagccactacactagatcttccttccgtagaagatgaacgtttgacatggcttggtgcatagtaggaattcaaatctttgttgtatgaatgaatgaacaagaattaggagtatggtttttaaaaaaactgtgcatcagaaacaccccatacccagtgactcagaatctcaagggttggactatgaatattcatttacataggcttcctagatgattcttcagcagcccattcaagggctaactttgcagaaattctgaaacctggtattggcggtggagttggagcagaagagataagttaggaaaagattggttttttcctttctttttacgtttcttctggcagttatatttcgtgttattttatttacgggtagcaaaggctttgtagttatctgttgttgagttcaagctctatcacttaatagctatatgactttatac

SEQ ID NO: 93275 - DNA, 601 bp, Human
atggcttggtgcatagtaggaattcaaatctttgttgtatgaatgaatgaacaagaattaggagtatggtttttaaaaaaactgtgcatcagaaacaccccatacccagtgactcagaatctcaagggttggactatgaatattcatttacataggcttcctagatgattcttcagcagcccattcaagggctaactttgcagaaattctgaaacctggtattggcggtggagttggagcagaagagataagttaggaaaagattggttttttcctttctttttacgtttcttctggcagwtatatttcgtgttattttatttacgggtagcaaaggctttgtagttatctgttgttgagttcaagctctatcacttaatagctatatgactttatacacttcaacctctgcaggtcttatttcttcccatctgtaatttggagatgatagtgtataccttataggttttttttgtttgtttttgagactgggtctctgttgcccaaactggagttcaatggcaagatcatggctcactgcatcctcaaactcctatgttcaagctgtcttcctgcctcagtcccccgagtagctgggact

SEQ ID NO: 93276 - DNA, 601 bp, Human
agtgagccaccatgcccagttttgttttgttttgttctgttttttgataatgtgtgaaaatggttcagcacagtgcctggcacacagtaagggcacaatatattttaaatataataattggttggctttcttttttttttgagtttcagttcttaaagaaaggaatacagtgtgttatgcttattttcttatctcctgcaggccttggcctgcctaccacacacagttctctgcacagtcaaaatgtttttgctgatttgagagattgaaggaggtatagctaggacttggcagttgattscagtggattgtaaataggcatcaatgaatagttcaagattgtaagcctgagtgattgggacaataagggagttagttttaagaaactgagtaaaattggaatttgttgttgaatttggaatgatgatttataattggaaacattctagaggaaattaaaaatacaggacctttgggaatgaaggtggatatttgggaatcataatttgttaactgaagctaataagatgagagcattcagagagaaaagaacggaaagattgaatatcagtttcccttctttaaaaaaattgtggatatg

SEQ ID NO: 93277 - DNA, 601 bp, Human
aactgaagctaataagatgagagcattcagagagaaaagaacggaaagattgaatatcagtttcccttctttaaaaaaattgtggatatgtgatctagcttcttgagcatcacagtgactgattggctcgtggtaattgatcgctatgctgacaatcttatctccacctatgtcattcaattttctaagaggcaaaatccttaatcaggaggagagtttagctctagctaaatttcccttgtccagcatgctcctgctcccccaacttgtggaaacagctaaaggattggactaggagcaraagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtg

SEQ ID NO: 93278 - DNA, 601 bp, Human
ctctagctaaatttcccttgtccagcatgctcctgctcccccaacttgtggaaacagctaaaggattggactaggagcagaagtttggaatggttaaaatgtagcaacatgtgtttcctgaaacaaaattccactataataaaaaaagcatttgaatgctcccttgtaattctgttggagcttgttgccttttttatgacacaaccataatcagtgatagacagtagcataaagaagcaagagcaaagcaattaagtaataatagcactacaaaaatgtgtgctgtagcttaccaaacacracatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaaaaaaaagaaaaaaaattctagtttttttaaaggacgattttgcagaattttaataataattttgtttcagaattttcaaaattctttccaaactgtcgatttaaactcaagccattcttacatactc

SEQ ID NO: 93279 - DNA, 601 bp, Human
aaccataatcagtgatagacagtagcataaagaagcaagagcaaagcaattaagtaataatagcactacaaaaatgtgtgctgtagcttaccaaacacgacatttatgaattattagataggagataaggtgatgttattggattgttttaaatttagttctttgaaataggatagtgactaatattagtttgtgtgctgattttataactttatatgggcctttatatcaggaaacaacgtaacctacataattgactaataccagagcaaaaaaaagaaaaaaaattctagtttttttraaggacgattttgcagaattttaataataattttgtttcagaattttcaaaattctttccaaactgtcgatttaaactcaagccattcttacatactccttggaaccaggaaaggaatagcttgaatttgtgtggccagatgttatttttttttttttttttttttttttgaggcagagtgttgctctgtcacccaggctagagtgcagtggcgtgatcttggcttgctgaaacctccgtctccagggttcaagctattcttctgcctcagcctcccgagtagctggaattataggcacc

SEQ ID NO: 93280 - DNA, 601 bp, Human
atgtgtatttgtgaaacttgctttagtaaattaagggaaatgcctaatgactcacacagaattatagagctgaaaagggattttgagagataatttaatccagtcttcatttacaaatgaaacagaggctcagagttgagaaatgtcttttgggagtgttcctaattattaattgatagtattgttgagttctcttaaattttcttgtgagttcacatttatgagttaatagttgaaattaagtaattggaataacataatgtattttatttatagttaaagtagttttagttgaagcctrcatcagaattcttcagtgtttcgttgtaatgcagaggcatactgtatggcacacatgagaaactaattttatgtttcccaataataatgttttaaaccaagtttagagatattttaaaagttgtgctctgtaggtgccaggacagatgactttcataaaatgaatgctctctttaaaaaaatttttctttatggtttcagagatttatatctttggattttaattattaaagatgtattaaatgggatgtgtaccaatcagccatttcaaggccctttgcacgttttgttttggatgtta

SEQ ID NO: 93281 - DNA, 601 bp, Human
gaggcatactgtatggcacacatgagaaactaattttatgtttcccaataataatgttttaaaccaagtttagagatattttaaaagttgtgctctgtaggtgccaggacagatgactttcataaaatgaatgctctctttaaaaaaatttttctttatggtttcagagatttatatctttggattttaattattaaagatgtattaaatgggatgtgtaccaatcagccatttcaaggccctttgcacgttttgttttggatgttattaccttttcagaagccctgtgaggtagttactrttataaataatcccatttcaaagataagtagtagatttagaattttagtcctggggtagtctcattccagagctcactgctctactgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgc

SEQ ID NO: 93282 - DNA, 601 bp, Human
ctgttccctaattgagatacatccaaggagagtggtcaaattattagtccagtttttaagagtgtccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatayttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgg

SEQ ID NO: 93283 - DNA, 601 bp, Human
tccattttatacatacttaaacccaaagctactaatttttagtacaaatatgaaacatatagggaggtcttagtgaccagttcactgatttgattaacctataacacattaaagtgaaatatggatttgcttactgcttatttgagtattgcaaggactgataattgctgataaattcagggcagctcaaggaaatgatgctaattacatatatcttcaaaaggaaggcatacatatttctgaagctgcaatttgaaaatgaataatctccactgatgcattacttactgtaattattttrctcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaagatgaaactaatatgtgtgaaataattatggatggcttactagcatttaattgtttgggcagattaataagggctgtagtatttggaggatgatttatgaagaagctgaacttgatcagatc

SEQ ID NO: 93284 - DNA, 601 bp, Human
gggcagctcaaggaaatgatgctaattacatatatcttcaaaaggaaggcatacatatttctgaagctgcaatttgaaaatgaataatctccactgatgcattacttactgtaattattttactcactatgtattatgtgctcattaatgactgcacaaaacacatatgaaagtaaaaaaatagaagaacttaaagtaatcaagtatttatttcagtctcagttctgtgctgaacactatggtatatacaagaaaactaaggcatgattttatacttgaggtttacagtttagtttcaaakatgaaactaatatgtgtgaaataattatggatggcttactagcatttaattgtttgggcagattaataagggctgtagtatttggaggatgatttatgaagaagctgaacttgatcagatccttggaaaagcataaataggatgtgatagatatatgggaagaaggacttcaaatctaggatgtgagctaaattgaaagctccatagtggcagggattatttcttttttgtgcattctctattcaagtgatagcgtcctgcatgatatttaataatgcccagcaaatattttactgataa

SEQ ID NO: 93285 - DNA, 601 bp, Human
tgcactattagtctgggtctagtattttactttatacagctttattgagttataattcacatactgtaaagtttactcttttaaagtgtgtaattgagtagtttttagtatagtcacaaggttgtgcaactatttccagtcaatttcatttttttttaatgcctggatgccacttattggaatccaatcaattttagaacattttcatgaccccaaaaaaccctacacccagtagcagtcactctccgttacctctaccctcaacccttagcaaacactaatttactttctgtctttatgratttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagagggataaaggaaggcctatggataaaggaaaatcatcttgggaaggaaatgtttaccaaatacttagtgagttttattcactgttaggtcctttaatccttatgacaacctcatga

SEQ ID NO: 93286 - DNA, 601 bp, Human
aatcaattttagaacattttcatgaccccaaaaaaccctacacccagtagcagtcactctccgttacctctaccctcaacccttagcaaacactaatttactttctgtctttatggatttgcctattttggccatttcatgtaaatggaatcatacaatttgtggctttttgtgactgatttctttcatggggcaagtgctgactgctgtagtcgttgtcttcagtggtgatggacgtatagcaaagggactgggaaaacgttgagaatctttgaaagcaaaattaaaggaatgggtagarggataaaggaaggcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgaca

SEQ ID NO: 93287 - DNA, 601 bp, Human
gcctatggataaaggaaaatcatcttgggaaggaaatgtttaccaaatacttagtgagttttattcactgttaggtcctttaatccttatgacaacctcatgaatttagttttattcccgatgcattagggatagtctatgatcacaggatcacaggctagtaaatggtggaacaagcattcagtcatgtcttctttatttcaaggttcatgttctccccactagtgaaaaggagttaagattttaaggtttaggcttgaagggaccaggagaatgtttctgttgacacacagagtaggcrtccaggttcttcactcaacagtccatcagtatttttgtgtcaggttaaacattgacttgcatgtcatgagaaaaatgttggagggaattggaaaagttttttaaaccattgctgtttatctttatagctaatattgtcttactctacttgacaaatttccctgtgaatcagccactgcattcttgttttaaaagtttctggctgggcacggtggctcatgcctgtaatcccagcactttgggaggccgaggccgcagatcacctgaggtcgggagtttgagaccagcctgaccaacacgg

SEQ ID NO: 93288 - DNA, 601 bp, Human
ttctggctgggcacggtggctcatgcctgtaatcccagcactttgggaggccgaggccgcagatcacctgaggtcgggagtttgagaccagcctgaccaacacggagaaaccccatctctactaaaaacacaaaattagctgggcgtggtggcgtgtgcctgtaatcccagctacttgggaggctgaggcaggagaattgcttgaatccagctactcgggaggctgagtcaggagaatcgcttgaacctgggaggcagaggttgtggtgggccaagatcgcgctgtcgcacttcagcctgrgcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggaa

SEQ ID NO: 93289 - DNA, 601 bp, Human
accagcctgaccaacacggagaaaccccatctctactaaaaacacaaaattagctgggcgtggtggcgtgtgcctgtaatcccagctacttgggaggctgaggcaggagaattgcttgaatccagctactcgggaggctgagtcaggagaatcgcttgaacctgggaggcagaggttgtggtgggccaagatcgcgctgtcgcacttcagcctgggcaataagagcgaaactctgtttcagcaacaacaaagtttctaacaccaaattacctttttgggctttggtattgtatgacgaaamctgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggaaagagttgtgctagatcattaaagtctcttctatccttaagctctggggtcttatatttattttgttatatcatttcatttgttgaa

SEQ ID NO: 93290 - DNA, 601 bp, Human
acttgggaggctgaggcaggagaattgcttgaatccagctactcgggaggctgagtcaggagaatcgcttgaacctgggaggcagaggttgtggtgggccaagatcgcgctgtcgcacttcagcctgggcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtartcatatcttacataaaattatataagatgtactttatttttatgatatggtaagagtataagcaagtcattcatattaagatagaattatttgaactttagtggttgtcagtgttaaggttttggaaagagttgtgctagatcattaaagtctcttctatccttaagctctggggtcttatatttattttgttatatcatttcatttgttgaactattgaaagttaaaacttgttccgtatgtagaggcacaggcagagtagatttagcatcattcttaagggccctataattttcagaa

SEQ ID NO: 93291 - DNA, 601 bp, Human
gggcaataagagcgaaactctgtttcagcaacaacaaagtttctaacaccaaattacctttttgggctttggtattgtatgacgaaaactgggtaagctgagaattaagatattatgggagtaggcattgggatcaattagtaaactctgttttcatttgggatttatttggtaatcatatcttacataaaattatataagatgtactttatttttatgatatggtaagagtataagcaagtcattcatattaagatagaattatttgaactttagtggttgtcagtgttaaggttttggraagagttgtgctagatcattaaagtctcttctatccttaagctctggggtcttatatttattttgttatatcatttcatttgttgaactattgaaagttaaaacttgttccgtatgtagaggcacaggcagagtagatttagcatcattcttaagggccctataattttcagaattgtaatggaacattggcttcaaagtcaccactatattagcccctagcaagagagtgtaattgtacatgttttaatgtacaagcatttgcaatttgtaaaattaaaaataatatccaaggcaaagg

SEQ ID NO: 93292 - DNA, 601 bp, Human
gatagcttcaaaagtgcttttgaattcttttctctatattcctttctctaagcaagttgtttttctttttttttttatgtaaaatgatgtattatatattttatacaagcaaattgagtacagctaaacctcagctacaggattttagagtacaatagcaagttgttttttaagtcccttaccatctccctttcgcagccaaaatcagcattgtagatttttttcattactgccatagtaagagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctcctgcctcagcctcctgagtagctgaaattacaggtgcccgtcaccacgcctggctagtttttgtatttttagtagagatggggtttcgccgtgttggccagggtggcctcaaactcctgacctcaggtgatcgcccgcctgggcctcccaaagtgctgggattacagggatgagccactgcttctggccac

SEQ ID NO: 93293 - DNA, 601 bp, Human
caaattgagtacagctaaacctcagctacaggattttagagtacaatagcaagttgttttttaagtcccttaccatctccctttcgcagccaaaatcagcattgtagatttttttcattactgccatagtaagagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctyctgcctcagcctcctgagtagctgaaattacaggtgcccgtcaccacgcctggctagtttttgtatttttagtagagatggggtttcgccgtgttggccagggtggcctcaaactcctgacctcaggtgatcgcccgcctgggcctcccaaagtgctgggattacagggatgagccactgcttctggccacaacatggtgttttgatataagtaaaccttgtgtcatgagtcttacaatcaagctaattaatgtatttgttacctgacatagttaccttttttgtgtgatgacacttaag

SEQ ID NO: 93294 - DNA, 601 bp, Human
gagcttttctatatatttaacttgtttctctagatcacaaagagacatttttggtttagtttttttttttctttttggagacagagtctcgctctgtcactcaggctggagtgcagtgacgtgatcttggctccctgcaacctctttctcccgggttcaagtgattctcctgcctcagcctcctgagtagctgaaattacaggtgcccgtcaccacgcctggctagtttttgtatttttagtagagatggggtttcgccgtgttggccagggtggcctcaaactcctgacctcaggtgatygcccgcctgggcctcccaaagtgctgggattacagggatgagccactgcttctggccacaacatggtgttttgatataagtaaaccttgtgtcatgagtcttacaatcaagctaattaatgtatttgttacctgacatagttaccttttttgtgtgatgacacttaagatcgcctttaggcaaatttcaactgtaaaatactgtatgttattaactgtggttactatgctatagcttagatcactagtacttattcatcttataactggaaacttgtatacattgatcaacagctctcca

SEQ ID NO: 93295 - DNA, 601 bp, Human
tggcgcagccttggcccactgcaacctctgtctcccaggttcagcaattcttgtgcctcagcttcctgagtagctgggattacaggcttacaccaccatgctctgctaattgtctttttttttttttttttgagacggagtctcgctccgttgctgggctagagtgcagtagcgcgatctcggctcactgaaacctctgcctcctgggttaaagcaattctcctgcctcagcctcccataatttatttttagtagagatggagtctcgccgtgtgggccatgctggtcttgaactcctggsctcaagtgatctacccacttcggcctccctaagtgctgggattacaggcgtgagccaccccgtctggcctgtcactatttctttttaaaaatatttttactacactctcttctccttctgggacctaagtgtgtcactttttttttttttgagacagagtcttactctgttgccaaggctggagtgcagtggtttgatctcagctcactgcaagttctgcctcctgggttcatgccattctcccgcctcagcctcctgagtagctgggaccacaggtgcctggcactgcgcccggctaat

SEQ ID NO: 93296 - DNA, 601 bp, Human
tcccataatttatttttagtagagatggagtctcgccgtgtgggccatgctggtcttgaactcctggcctcaagtgatctacccacttcggcctccctaagtgctgggattacaggcgtgagccaccccgtctggcctgtcactatttctttttaaaaatatttttactacactctcttctccttctgggacctaagtgtgtcactttttttttttttgagacagagtcttactctgttgccaaggctggagtgcagtggtttgatctcagctcactgcaagttctgcctcctgggttcaygccattctcccgcctcagcctcctgagtagctgggaccacaggtgcctggcactgcgcccggctaattttattattgtgtttttagtagagacggggtttctccttgttagccaggatggtctcgatctcctgacctcgtgatccgcccacctcggcctcccagagtgctgggattacaggtgtgagccactgcacctggccacgtgtatcacctttttgatattgtccttgatgagtccctgaagctctttcctttttccttgttttctttccccccaatttcagaatgaataatttct

SEQ ID NO: 93297 - DNA, 601 bp, Human
ctgtccttccctcccttgtcattaacatctaggtaccctttatatgttaaagagattatatctgtctagataatttgtgtagataatttttctctgttactcatttttcttttggctactttgggtgtgtttttgtaaagaagtttttaatttttacatagttgaaataaccttttatagtgtatgggttttaagttatagttagaaagtctcctgcactccagggttataaactatatcacattttcttttaaactttatatttgatacatttagatttatcctgctttaacatgtgcgrtaggtatccagtattattttcttggtggtaactgctgaggctggcaggtcacgaggtcaggagttcaaggccagcctggccaacatggtgaaaccctgtctctactaaaaatacaaaaattagctgggcatggtggtggatgcctgtagtcttagctacttgggaggctgaggcaggagaatcgcttgaacccaggaggcagaggttgcagtgagccgagatggcgccacgggactccagcctaggcgacagaacaagactccgtctcaaaaaaaaaaaaaaattttttttttgtggtat

SEQ ID NO: 93298 - DNA, 601 bp, Human
tgaagcttttcaccttatgttttttttctaagagttctatagttttagctcttgtgtttaggtctgtgatcaactttgagttaacttttgtgtatggtgtaaggtaaaggtacaacttcattcttttgcatgtggatatccagttttccagcaccatttgttcaaaagactgtcctttcttcatcttagtagttatggcatccttgttaaaaatcatttaattatatatgtgagagtttatttctgggctcctgattctgttagttcttatgccagtaccatactgttttggtcactatarctttgtagtaacttttaaaatgaggaagtgtgagatctccaactttgttctttttcaggattattttggctattcaggatcctttgagatccatatgaatgttaggatggatttttctatttctgcaaaaatgttattaggattttgatgggaaatgcttgaatctgtggatcgatttgggtaaatagctttcagatatgaaagtttgtcccaagtctgaattctgtactaaatgcaattatccagatggcaaatttaagaaaaaatgaagccatttaaacttatttttaaagcttatta

SEQ ID NO: 93299 - DNA, 601 bp, Human
ttttttttttgtcaaagaaaaagcgagagaaacttctaccatctacttgtacaaaatttcttctttatggtgactatcgaatttttagagttcataaaaatatcttaaggataatatgtagttatttcatgtgtaaaactcaatagaattggtaggttaatggaggctagtttacatttgaaaagcttttattttggagttttaaataaatttaatatttaatatactttctaatttttttctttttctaataacaattttcaaacctcttcctctccttaaatgtttctcatctcacatrtaagcattaaagtatttttatatgagcattaaaaagtatttttttagtctgagatttctacggttctgttcttatttttaaaattattgcaatgtattttctgtacgcttattctctgaactttgacttgttttttttaattttcaaatcttaatttttaaagtttgctagtagtataaagcgagtggttttaaagagtgattttttttgtcattcagcactttactccctgcgggagaaaatgtgactttttgaaggttgagccttcaaaaccttttttaaagtttagtagataacttt

SEQ ID NO: 93300 - DNA, 601 bp, Human
atttaatatactttctaatttttttctttttctaataacaattttcaaacctcttcctctccttaaatgtttctcatctcacatataagcattaaagtatttttatatgagcattaaaaagtatttttttagtctgagatttctacggttctgttcttatttttaaaattattgcaatgtattttctgtacgcttattctctgaactttgacttgttttttttaattttcaaatcttaatttttaaagtttgctagtagtataaagcgagtggttttaaagagtgattttttttgtcattyagcactttactccctgcgggagaaaatgtgactttttgaaggttgagccttcaaaaccttttttaaagtttagtagataactttacttttttagattgtgtcctgtaccacattttttttgagacaggaaccaaattagcttttagagtctaagcaacttatgaagttaagtaaactgtgatatttcccctcatattttttaagaattggtgaaaatattgttgtctatgattattatcaaatgctgtaatttagcagtctgcctaactaatgtagacagactttacatgatttagttct

SEQ ID NO: 93301 - DNA, 601 bp, Human
attttttttgagacaggaaccaaattagcttttagagtctaagcaacttatgaagttaagtaaactgtgatatttcccctcatattttttaagaattggtgaaaatattgttgtctatgattattatcaaatgctgtaatttagcagtctgcctaactaatgtagacagactttacatgatttagttcttttgggatatttaaaatttaaatctaaggtagtagaacattagttactgctccccaaaatgtagtagattattttgctgtggcatttaaaatacattagaagtgattaaatraattatggtatatccatacaattggatactgtatgcatttattcttgtgttttgagaagagcatttttgttttgattacatattgactgttttgtattaggttcatttgatccttttggtgtttattttgaaagtaattcattgatgaatatactcagcctaggaaatttgattttggccaagaatggggtcttgatcagtctggtaagctggttaaatgaatgtttcttaagggaatttctactgtaatgtggtctgtacttcaaatattactgtaatatttaggagacgatatttaca

SEQ ID NO: 93302 - DNA, 601 bp, Human
tattttgaaagtaattcattgatgaatatactcagcctaggaaatttgattttggccaagaatggggtcttgatcagtctggtaagctggttaaatgaatgtttcttaagggaatttctactgtaatgtggtctgtacttcaaatattactgtaatatttaggagacgatatttacacacataaaaatatgtgtggcttatggttgaaatgaagattagtcaaaagaaaggatgcctgatagttaaaatgatcaggaaagacttcctggagaagttttaagttgtgataaaagtttttttgttgttgttgttgtttttttttttttgggagggtgcagtgtgagcgtagataatatgtgaggggggaatagggaatagacaagatataagggaaaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaat

SEQ ID NO: 93303 - DNA, 601 bp, Human
tgttgtttttttttttttgggagggtgcagtgtgagcgtagataatatgtgaggggggaatagggaatagacaagatataagggaaaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaatcttgtagscagtagagcatcatttgaagatttttgagttaggccgtttgaaattgggaaatatgtatttggtcttcaactccatattcggacatacaactcctataattcttagaaactccaaagtgacgtctgtttgagtgctaatgggatgactgttggctggcagcccctaggtaacttcaagatggggctggtcacttgaaagaccaaggcatgattagtgagttgggacttccagccccaccctccaaccactggggctgaaggttaagttgatcaccagtggccaatggtttaatcaatcct

SEQ ID NO: 93304 - DNA, 601 bp, Human
agggagtatgggaaactcatcttcaagcaggtgagtcagaagttccagagtctggggcttgtgactggtgtctgaagaaggggggcagtcttggggactgagccttcaacctgtggattctgatgttatctccaggtagatagtattggaattgaattacagaacacccagctagtgtccactgcagaattgattgcttttttgttgttgggagaaaccctccacacatttggtcccagaagtcttctgtgttgattgctgtggtggtggtgtgtaagcagaggaaaaaacaattagagcwttgtttttaggtatattattctcttgtcctttgtaggagttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgt

SEQ ID NO: 93305 - DNA, 601 bp, Human
agaaggggggcagtcttggggactgagccttcaacctgtggattctgatgttatctccaggtagatagtattggaattgaattacagaacacccagctagtgtccactgcagaattgattgcttttttgttgttgggagaaaccctccacacatttggtcccagaagtcttctgtgttgattgctgtggtggtggtgtgtaagcagaggaaaaaacaattagagcattgtttttaggtatattattctcttgtcctttgtaggagttctagaattggaaatactgttttgtcctgttttarggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggc

SEQ ID NO: 93306 - DNA, 601 bp, Human
aggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttatttggcacacttttttttttttttttttgagacgaagtcttgctttatcacccaggctggaatacagtggcatgatattgcctcactgcaacctctgtctcacaggttcaggcaattctcctgcctcactctcctgagtagctgggattacaggcgcccaccaccacaccctgctaatttttgtattttaatagagatggggtttcaccatgttggtcaggctggtctcgaattcctcacctcaagtgatcctctctcctcggccttggcacactcagttcttgaacttaatttggaggctaaaacattcc

SEQ ID NO: 93307 - DNA, 601 bp, Human
taagttcaagcgattctcttgcctcagcctcccaagtagctggtattacaggtgcccaccaccatgcctggctaattttgtatttttagtagagttgggggtttcaccatgttggttaggctggtctcgaactcctgtcctggtcccgtaatccacctgcctcagcctcccaaagtgctgggattataggcatgagccactgctcccagcctaatttctatagttttagtagcgagggtgtttcaccgtgttggtcaggctggtcttgaactcctgacctcaggtgatccacccacctcascttcccaaagtgctagtgttacaggtgtgagccaccacgtcaggcccccagcagatttttttttttcattttatcttagaaaaaagattcttcagatattagagtccaagaatgtcacagcaattacctgtctgctatttatcagtgagtttgaatatggaataatataaaatgttacattctctttaaagcctgcttatagttaatagcttttcccacatagctaaaaaatgccccactatctcctaagtagcccccacatactgcttgtcagagctcagcttttataatttctaatcc

SEQ ID NO: 93308 - DNA, 601 bp, Human
ttgcctcagcctcccaagtagctggtattacaggtgcccaccaccatgcctggctaattttgtatttttagtagagttgggggtttcaccatgttggttaggctggtctcgaactcctgtcctggtcccgtaatccacctgcctcagcctcccaaagtgctgggattataggcatgagccactgctcccagcctaatttctatagttttagtagcgagggtgtttcaccgtgttggtcaggctggtcttgaactcctgacctcaggtgatccacccacctcagcttcccaaagtgctagtrttacaggtgtgagccaccacgtcaggcccccagcagatttttttttttcattttatcttagaaaaaagattcttcagatattagagtccaagaatgtcacagcaattacctgtctgctatttatcagtgagtttgaatatggaataatataaaatgttacattctctttaaagcctgcttatagttaatagcttttcccacatagctaaaaaatgccccactatctcctaagtagcccccacatactgcttgtcagagctcagcttttataatttctaatccttatttatgttgttattt

SEQ ID NO: 93309 - DNA, 601 bp, Human
tctgttgacgtcctcactaagtgcccatgtttcaaaatatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacrttttttgtacataatatagtaacacttctgatctatttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaac

SEQ ID NO: 93310 - DNA, 601 bp, Human
aatatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctrtttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggaca

SEQ ID NO: 93311 - DNA, 601 bp, Human
atatggatggaaggacaatatctcactatctcacctttagagatgttgacctcagctgttttctaatatcccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctakttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacac

SEQ ID NO: 93312 - DNA, 601 bp, Human
ccataaccatactgttgtatgtctttagagtatttttgttttatcctatttttgttaatcttgcttaagctgaccattaactttcagtagtttttaaaaaatattctgacattggtttgttagtgctcgtttgttagcataggtctgttccttgattaacgtacttttacacttttgacttgcaaacagttcacgttttttgtacataatatagtaacacttctgatctatttgtcttacagccaaattaaaacttttgcataccaagtgacaaaccttttgagccgttgcttagtggttytcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacacaagaggtcaactgttttgtcatttgtgtagtaagaacaaaattaagtgtgtggcattaaagaaataacac

SEQ ID NO: 93313 - DNA, 601 bp, Human
tttgtcttacagccaaattaaaacttttgcataccaagtgacaaaccttttgagccgttgcttagtggttctcctagacattttaattttgagagtgtcactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacasaagaggtcaactgttttgtcatttgtgtagtaagaacaaaattaagtgtgtggcattaaagaaataacactgtctggccgggatcggtggctcacgcctgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctcgaacccgggaggtggaggttgcagtg

SEQ ID NO: 93314 - DNA, 601 bp, Human
cactgatttttcacaatcttatttatgtgactgaattttttgtatttcattgttattcatttatgaaaataagaaaatggaaaaatgaatatgtagagagtaatgaaagcagtgtatgtttcagaatcaatgaagttgagaataagatgttaggctttgccaaaaactggatctttagtatcacttgagcactcattggacacaagaggtcaactgttttgtcatttgtgtagtaagaacaaaattaagtgtgtggcattaaagaaataacactgtctggccgggatcggtggctcacgcytgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctcgaacccgggaggtggaggttgcagtgagctgagatggcgccactgcattccaggcctggggggtgacagagcaagactcagtctcaaaaaaaaaaaaaaaaaaagaaagaaaaagaaaagaaat

SEQ ID NO: 93315 - DNA, 601 bp, Human
agtatcacttgagcactcattggacacaagaggtcaactgttttgtcatttgtgtagtaagaacaaaattaagtgtgtggcattaaagaaataacactgtctggccgggatcggtggctcacgcctgtaatcccagcactttgggaggccgaggcgggcagatcacgaggtcaggagttcgagaccagcctgaccaacatgatgaaaccctgtctctactaaaaatacaaaaattagccaggcatggtggtgcacacctgtagtcccagctgctcaggaggctgaggcaggagaatcgctygaacccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaaacttatttgacttgtgtgtttctcctattttgatacacttttctaggaatcaattatgtaagaacttaggctactgcctaaatctaatacttctttaaaaccc

SEQ ID NO: 93316 - DNA, 601 bp, Human
atgatgaaaccctgtctctactaaaaatacaaaaattagccaggcatggtggtgcacacctgtagtcccagctgctcaggaggctgaggcaggagaatcgctcgaacccgggaggtggaggttgcagtgagctgagatggcgccactgcattccaggcctggggggtgacagagcaagactcagtctcaaaaaaaaaaaaaaaaaaagaaagaaaaagaaaagaaatacactttcaaaattgcacctaaaaggggaaatggttttagggtttttatctactcctcactttctagaaacaarcttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttattaagaattcggtg

SEQ ID NO: 93317 - DNA, 601 bp, Human
ctttctagaaacaaacttatttgacttgtgtgtttctcctattttgatacacttttctaggaatcaattatgtaagaacttaggctactgcctaaatctaatacttctttaaaacccagaatggattttagttgatattgatgaaacagctcattcgtgtgtctagtggcctttattattaccttttaaatattttattcatgcatgtttgttatctactgaacatgaagaataggtttgcttttctttgtagtttttctcacatttatatgtcaatacgttgattgttttttgtctgttwttaagaattcggtgatacatgttggctttattgctgactaatgtagaggtacttctttgggctagtacttgactttagtcgtatttcagtttagtgttagaccatcgtgtatgtacttactggtttctttaagctaccgtacgtaacacagtaccaaaaattgggtggctgaaaacaacaaacacttagaattctggagtccagaagtacaaaatcaatgcgtcagcagggtcatgctcttgctggtgtcttctggcttctgatgtttcctcaggatccttggctgatagatgcgtcact

SEQ ID NO: 93318 - DNA, 601 bp, Human
attcatttgcctgctgtaagaaggtttttgatttttgagtgttttttctcacccacccagttttaatgctgcaggtacagtgtttataattagcagatagagacattgccactgtcttttactaatgagtattgatatttgatctggaaagcctgtgcaagtggttcaaggttttttttatatacatgcatatttatttttaggaaatttatagtgagccacctggatgtctatgtacactgtaagtaaattgctggagagaatttctagcatttagaaggactagatggtggattaaaawtttttttcttccagttattttctgcccactttcttaaggatatagctgttactaaatgaaagtaacagttgaatgccagatcagtttaagtgcattcagacaattattttgaatgaagaactgaacttgatggattcgtacatttataacttaatctaaaaatacataacaagttttagctttcaaactgtatgctggatttctgcaattatttaaggatattgttgtgggtttcacctaaatgaattgagatttccttttatatatgtagtttaacagatctgtattacatttaaatta

SEQ ID NO: 93319 - DNA, 601 bp, Human
tgctgttctctttctccctctttttctttttccctttttcttttctacccttttccctccctcttttaattgaggtgtaagtatgtaagtgttaattatacagttcgaagaatttttatgactgtaatcataacaggtaaagaaacagaacaaatctagtaaccctgaagctttccttgtgcttgttcacacagtcactactccattcccaccaaaaaataaatgctattctgacctttatcatcttattttttgacactgactttgtctgatttgcaaatatcctcctttgtacttcttyccttctcataatttattcattaatgaacaactaccatgtgtaaaatactttgccatgtatcgtgagtaaaatggtgtataaaaaaatttccccgactgcaaggctattataatgtggtggaaaggaagacattgaagaaataattacaagtgtgttgggggttagaagaagggaaacacacacacagtgctctgtgcatgtatcacaggagtagctaacctagtgtggggaatcaggaatgtcctcgaggagtaaatctttaagctgaggcttgaagaataaaataggagttagctgctg

SEQ ID NO: 93320 - DNA, 601 bp, Human
cccaagtagcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacrtagacaatgaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattat

SEQ ID NO: 93321 - DNA, 601 bp, Human
gcttggaatacagatgcatgccactatgcccagctaattttttgtatttttggtagagatggagtttcatcatgttgcccaggctggtcttgaactcctgggctcaagcaatttgtccccttggcctgccaaagtgctggggttatagatgtgagttaccacgcctgggccaggattgttataaggcttaaggagatgtgtataaagaaattgttatactctagtgctttgaacataatggttactcaatatatgttggcttattttacttagaaaagattactcaggccacatagacaaygaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattattttaaagt

SEQ ID NO: 93322 - DNA, 601 bp, Human
aggccacatagacaatgaagagaaattatttgggtaaggtaagcatgattctgggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctscaattattttaaagtaaattgtacatactatttcacttaacaaatacttaactcttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccattta

SEQ ID NO: 93323 - DNA, 601 bp, Human
ggaaaaccagataattgactattgctatagtctaagcaagagatattagtgacggcagtggggatagaaatggaaattgtgtaagtgcaatcacacacacagacatttaacttttattgtggaaaacttcacatgtcaaagaacagaaaataatataatgaacccccatgtgcctatcatacaactttggtggttataatctatggacaatctcattttgtctatataatctttccaccctcaacctgcaattattttaaagtaaattgtacatactatttcacttaacaaatacttaacycttaaatatgaaggcttttaaaaaaggtaaatatgacaccttaatttagtatgcagtttctttatctgatatctagtcattgcttaaatttctttgattatttactatattggttattctgtttgaatcaacattaaaatgtggtctactcattggatttagttgataaatctcttaagtctctttttatctataggttattttccctgtgtgttatgtttcttttcttttttgttcttgccatttatttatggaaaaaaacttgagatgtcttgtaaaatttcctatattctagggatt

SEQ ID NO: 93324 - DNA, 601 bp, Human
acctaggttgcagtgcagtggcacaatcacagctcactcactgcagcctcaaacttctggactcaagagattttcacacttcagtctcctgagtagctggaaccacaggcgtgtgccaccatgcttcgctaatttattttatttttatttttatttttgagatggaatcttgctctgtctcccaggctggagtgcagtggcgtgatctcacctcactgcatcctccacctcctgggttcaggcgattctcctgcttcagcctcctgagtagctgggattacaggcatgtgccaccacgccsgactaatttttgtgtttttagtagagatggggtttcaccatttggccagcctggccttgaactcctgacttcaggtgatctgcccaccttggcctcccaaagtgctgggattacaggtgtgagccactgcgtccggccttttattttattttttatagagacagggtctccttctgttgcccatgctcgtctcaaactcctgggctcaagtgaccctcccatgttggcctctctcaaagtgtgggattacaggcatgagccactgtgccaggcttttaaaaaaattttacttgacatata

SEQ ID NO: 93325 - DNA, 601 bp, Human
taccttctgtcctcagcaatttagctatttttctctttccttttaaaacgacacttcttagtgagtctcaagatatttgatatgctctttgttaaatccaattatatgtaacagttttcatccttcttgatttgtctttcttttgcaggattactctaatggttatcttcctaacatggaatatttgtttgtttgtttgtttgtttgtttgtttgtttttgagacggagcctggctctgtcgcccaggctagagtgcagtggcgcgatctcagctcactgcagcctcgacttcgggttcaygccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccggcctgttttgtttgtttttatttgttgtttctattgtcactgatttctcctttacccactactcaaacgttggtttctctaggcactgctttcagttctcctttt

SEQ ID NO: 93326 - DNA, 601 bp, Human
gtttgtttgtttgtttgtttgtttgtttttgagacggagcctggctctgtcgcccaggctagagtgcagtggcgcgatctcagctcactgcagcctcgacttcgggttcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgygcccggcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgt

SEQ ID NO: 93327 - DNA, 601 bp, Human
tttgtttgtttgtttgtttgtttttgagacggagcctggctctgtcgcccaggctagagtgcagtggcgcgatctcagctcactgcagcctcgacttcgggttcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccrgcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattat

SEQ ID NO: 93328 - DNA, 601 bp, Human
tcatgccattctcctgcctcagcctcccaagtagttgggactacaggcgcccaccaccgtgcccggctaattttttatatttttagtagagatggggtttcaccgtgttagccaggatggtctcaatctcctgacctcgtgatctgcctgcctcggcctcccaaagtgctgggattacaggcatgagccactgtgcccggcctgttttgtttgtttttatttgttgtttctattgtcactgatttctcctttacccactactcaaacgttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattatatatactccactcttgtttattccaagatcagacaaaacacaatttttatgttttgattaatggatctggtccatcctaacttcaaagctggaaacctgttg

SEQ ID NO: 93329 - DNA, 601 bp, Human
ttggtttctctaggcactgctttcagttctccttttttttttttttctcttctcataaaatggggtgactcaatgttttattctttcattaaagactttctctaggtgatctcctccattcctttgtctgcaaccacagaccagatctctactttcagttccttgactacatcttcacctacctatttcctggctcttgagttttagtatatctaaaacaaaacgtattatatatactccactcttgtttattccaagatcagacaaaacacaatttttatgttttgattaatggatctgrtccatcctaacttcaaagctggaaacctgttggcatcttctgacttttttctctttttttttttttttttgagacaggtgtcttgccctgttgcccatgttggaatgcagtggtgagatcttggctcactgcaagaccctccacaatcactttgaccctctgggctcaagtgattcttccacctcagcctcctgagtagcggggactacaggtgtgtgccaccacacctggctaattaaaaattttttttttttttgtagagacagggtctcactacgttgcctaggctggtctcaaact

SEQ ID NO: 93330 - DNA, 601 bp, Human
gttttagtatatctaaaacaaaacgtattatatatactccactcttgtttattccaagatcagacaaaacacaatttttatgttttgattaatggatctggtccatcctaacttcaaagctggaaacctgttggcatcttctgacttttttctctttttttttttttttttgagacaggtgtcttgccctgttgcccatgttggaatgcagtggtgagatcttggctcactgcaagaccctccacaatcactttgaccctctgggctcaagtgattcttccacctcagcctcctgagtagyggggactacaggtgtgtgccaccacacctggctaattaaaaattttttttttttttgtagagacagggtctcactacgttgcctaggctggtctcaaactcctgggctcaagccatcctctcaccttggcctcccaaagtgctgggattataggtatgagccaccatgcccagccctttcttattcttattgactgagaaatcttcaatgtggccccttgtcgtccataccactattggtactcttgttctcacttggttctgttaagcttcatttgagctttcccaatgctgctataat

SEQ ID NO: 93331 - DNA, 601 bp, Human
atgacctcctcagcgaaaccttttctctcacaaaacaaggtggtcatcttattcaaggaactatttatttatttatttatttatttatttgacagagtgttactctgttgcccaggctggagtggagtgatgtgatcttggcctactgcaacctctgactcctgggttcaagagattctcctgcctcagcctccccagtagctgggattataggtgcctgccaccatgcctgactgatttttgtattttcagtggagatggggcttcaccatattggccaggctggtcttgaactcctgayctcaaatgatccacccacctcaacctcccaaagtgctgggattacaggcgtgagccatcgtgccaccttttttttttttttttttggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacc

SEQ ID NO: 93332 - DNA, 601 bp, Human
ttatttatttatttatttatttgacagagtgttactctgttgcccaggctggagtggagtgatgtgatcttggcctactgcaacctctgactcctgggttcaagagattctcctgcctcagcctccccagtagctgggattataggtgcctgccaccatgcctgactgatttttgtattttcagtggagatggggcttcaccatattggccaggctggtcttgaactcctgacctcaaatgatccacccacctcaacctcccaaagtgctgggattacaggcgtgagccatcgtgccaccytttttttttttttttttggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtc

SEQ ID NO: 93333 - DNA, 601 bp, Human
ggagacagagtcttactctatcgcccaggctggagtgcaatggagtgatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtcggaactttattttttttwaaaacctgtagtgtaatatttgttcgtatatatttcttttgctagactgagttttttgtatgctggatgtctgtgtccttagcatttgtgccagtggcttacagtaggtacacagtaataattgatgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgtt

SEQ ID NO: 93334 - DNA, 601 bp, Human
gatcttggctcactgcaacctccgcctcctgggttcaagtgattctcttgtctcagcctcccgagtagctgggattataggcatgcaccaccacgcctggctaatttttgtatttttagtggagacggggtttcaccatgttggccaggctggtctcaaactcctgacctcaggtgatctgcctgccttggcctcccaaagtgctgggattacaggcatgagccaccacgcccagtcggaactttattttttttaaaaacctgtagtgtaatatttgttcgtatatatttcttttgctagwctgagttttttgtatgctggatgtctgtgtccttagcatttgtgccagtggcttacagtaggtacacagtaataattgatgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgt

SEQ ID NO: 93335 - DNA, 601 bp, Human
ttttagtggagacggggtttcaccatgttggccaggctggtctcaaactcctgacctcaggtgatctgcctgccttggcctcccaaagtgctgggattacaggcatgagccaccacgcccagtcggaactttattttttttaaaaacctgtagtgtaatatttgttcgtatatatttcttttgctagactgagttttttgtatgctggatgtctgtgtccttagcatttgtgccagtggcttacagtaggtacacagtaataattgatgaataaataatacttaaaacatttgaatttgtraacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgtttaactttaggtattgaatgtgtattatgttcatggaattatattctgttgcagaggttcacaaactttctcagtgccgttagggtctcagtaacgtttttcactgtgccacc

SEQ ID NO: 93336 - DNA, 601 bp, Human
atgaataaataatacttaaaacatttgaatttgtaaacttctaataatgttaaaaattgaatgataaagtaaactgcaattttttccttccttaaagcaaactggggagtagaagtccttttataagtataatgccttaaaaagtagtgtggaaactagagtaagaagtagatgttagggattgatactgcaaggtatttatttctttgttcattaatttgtttaactttaggtattgaatgtgtattatgttcatggaattatattctgttgcagaggttcacaaactttctcagtgccrttagggtctcagtaacgtttttcactgtgccacctagatcgaaagaaatgtctgatagttctgtttattaaatacctaggtccaggcaacttagtagccacttgaaaaaaataagacacttaaattggaaacgttatttcactgctgagtaatcacatttctgttaggatgcttaggcatcgctcagcttctcaaacctggaatcagatgggacattgccaccctgatttcttgttttatatcgatgttattttatgtgataacttggtttttatgccagcaactgctgacaaaccaact

SEQ ID NO: 93337 - DNA, 601 bp, Human
aaagaaaagaggtttattttggcttgtggttctggaggtgaggaagtccaagatgagttggccacatctgatcaacctctggtaaggacctcatgctgcttcataacatgttggggaatggaagaggaaagggacaaaatacaagggacaacttcactttgtaacagcctgccttcaaccctctggagaattaactcagtcctgctgagaactgcattaattcctctaatgacctgatgacctcttaaaggccctaccacctctcgatactataacactgggaattaaattttaacatgakttttggtgggaacacaccacatccaaatcatagtaggtatcttagcacacagttttggaagcatgactcttaaacatttataaaacttttcttataacattttatgtgcttgattcttacaattattctaggtatgtacttacaggtgcactttttatattcggcatacaacaaatacttgttaatggcctaatgcattaaaaattaaggaaattgtgataaagtatagttttttaggcttaatttttgtaggctaacttatccttttattacaaaacttttaaaatctagaaagactag

SEQ ID NO: 93338 - DNA, 601 bp, Human
tttattttggcttgtggttctggaggtgaggaagtccaagatgagttggccacatctgatcaacctctggtaaggacctcatgctgcttcataacatgttggggaatggaagaggaaagggacaaaatacaagggacaacttcactttgtaacagcctgccttcaaccctctggagaattaactcagtcctgctgagaactgcattaattcctctaatgacctgatgacctcttaaaggccctaccacctctcgatactataacactgggaattaaattttaacatgagttttggtgggarcacaccacatccaaatcatagtaggtatcttagcacacagttttggaagcatgactcttaaacatttataaaacttttcttataacattttatgtgcttgattcttacaattattctaggtatgtacttacaggtgcactttttatattcggcatacaacaaatacttgttaatggcctaatgcattaaaaattaaggaaattgtgataaagtatagttttttaggcttaatttttgtaggctaacttatccttttattacaaaacttttaaaatctagaaagactagtacaatggtctt

SEQ ID NO: 93339 - DNA, 601 bp, Human
agcatgttagcagccatagacaatacttaaattcataggtatgtctgtgttccaataaatttttttttttaccaaaacaggtggtgggctgtatttgacctgcaggatgcatgatgtgatttgtccaatctttgtcagttacatacatctgtgtaacctaaactcttaccaagatatagagaaattactatcagcgtggaaagttttctcatgcccttttgtaattaatctctgcccccgtgccctagtgacaaccactgtttctttttcatctgagattagctttgcccatgtttgagtrtcaaataatggaatcatgcaatatgtgcattttggtgaaacacttttacttagcataatctggagattgaattatgttgcatatactggtgatttgttgctttttgttgctgggtagtattccattgtataaatttgcctcactttatccattttcctgttgatgaatacctgggctatttttgtttttttttttgtttttgtttttgtttttttaagacagggttttgctctgttgctcaggctggaatgcagtggatcaatcatggctcattgcagtgttgacctcccagctcaaaca

SEQ ID NO: 93340 - DNA, 601 bp, Human
caaacagttctcccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattkcagcgtcatagggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctg

SEQ ID NO: 93341 - DNA, 601 bp, Human
aaacagttctcccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattgyagcgtcatagggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctgg

SEQ ID NO: 93342 - DNA, 601 bp, Human
cccagctcagattcctgagtagctaggacacacaggcccgggccaccacacctgggtaatgtgttctggtttagagatggagtctcactttgtcacccaggctggtcttgaactcctgggctccaagtgatcctcccgccatggcctctcaaagtgctgccaccatgcctggcttagttctagtttttggttataataaaataatttgaccattgtgaaccttcttctacaagactttttgtggacatatgttttcatttctcttgtctaaatacgtaagtatggaattgcagcgtcatasggtaggtacctgattggttttttagggaaactcatgggaacttttcccaagatggtgaacctttttgcacaccccccagtgatgcattagtaatctgcttgctctattcaagatttggcttatcaatcttttatactttttttttgagacagtcttgctctgtcacccaggctggagtgcagtggtgtgatcttggctcactgaaacctccccgcctcccaggtttaagggattcttgtgcctcagcctcctgagtagctgggattacaggcatgcaccaccacacctggctaacttttg

SEQ ID NO: 93343 - DNA, 601 bp, Human
aattttgtatgtattcatcagtaaattatctccagacttttaaacatagctccagaactcttctaaagaagtttaaacaccacagggagtttagcttataaaggttttatgtaaggtaacagtatacttagttgttttgctttatatttcttttgaaataataattttaaaaatatttaatttttaatggattcaagttttatcactttttccctttgtgatttgtacttcagaaatttaaggagttattcctaccttaaggtcaaaaagagaattctgtgtcttttttaaatttaaaaatttttcttttacatttaagtatttgagatacctattagattgccagtcagactcacaagaatcagaggtcttacccagtgttaatctttaaaaattgaaacagtttaagtgatcatgaggcataggtgaaatatgaagtccaagactgccagatctctgagtccttccttgcctctttagagtgtgttctgtcccagacttaacctgtgaggtttctaagtgatgtatacagtcacataaacagaagagtgctctgcaaacatcttgattctatgctcttaacaggtaaattaatataaca

SEQ ID NO: 93344 - DNA, 601 bp, Human
ttatccttataaatctttttgtcctttattgtagtcttttttgattgacttatctttaggtatatttgacaccctaatatttcacttctcttaatttgtacgtttatctgtatggaacagcttctctcccacccctcaggatcagagctgacctcattttttttttttttcccttgtagcagaggtaatccctgacataacacaaatgctttatatgtgtattaattcattatttctattaaatgtagatatttttgtttctgttttttgtggaggaagaaaactaaagctggaaggcacyttattcataattaaatggttagctgtgataccaggcagctgaggtctgtctgactttgctctttcttgggatcacactggtttttgtaactccacggtacacagaatcaataagtgataattatggatgaatattttaacttggatagcaaagaactttttaatgtttaatgcaatccataaatttaatgaactgccttttaaattctctgctgctaaaaatatttaaggagtcacttaaacctgtcatgaactttatagaagaattcagtcttgagtgggaggcccttttttagttctt

SEQ ID NO: 93345 - DNA, 601 bp, Human
tttttcagtgatttccttagtggcctctgagtgctcttaatttcattatttaatctctgttctgttttgttgatgttcagtagtcaataacatttctgtaacatgatgtgctgatacatatctattctagtttgggaccgtaactgtttacaaaagacttgtaaaagtgatcagagataattcttggttgtagatgatagttttgaacttacttatagaggaaggatatctcataatgaagtctaaacagtatatatatatataactagtattaggatggaatttttcattttaagattgkcaaaaaataatgtatagttctgttagcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcat

SEQ ID NO: 93346 - DNA, 601 bp, Human
ctgagtgctcttaatttcattatttaatctctgttctgttttgttgatgttcagtagtcaataacatttctgtaacatgatgtgctgatacatatctattctagtttgggaccgtaactgtttacaaaagacttgtaaaagtgatcagagataattcttggttgtagatgatagttttgaacttacttatagaggaaggatatctcataatgaagtctaaacagtatatatatatataactagtattaggatggaatttttcattttaagattgtcaaaaaataatgtatagttctgttarcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcatagaaaaattttatcaacgttgctcca

SEQ ID NO: 93347 - DNA, 601 bp, Human
taggatggaatttttcattttaagattgtcaaaaaataatgtatagttctgttagcctatagtgattatgtggtgattgtgttaatatgatcttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtrttgtattgtctgtaccaaggtttttcatagaaaaattttatcaacgttgctccataattaaatcatagtagtatttggaggtgtgcgatggcgttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgg

SEQ ID NO: 93348 - DNA, 601 bp, Human
ttgtgttcagataggagggtgacctagatagctttctaggtcccttttagctattacagtccaggtaggtaaaataagtccagtataagtttagttgtttttaattactagtcatatactttgtttgaggcttggattgtaagaaatttagttttttaaaaaatgaactatgttaatttcttaattctcacacttaaaaaagaattgtgttgtattgtctgtaccaaggtttttcatagaaaaattttatcaacgttgctccataattaaatcatagtagtatttggaggtgtgcgatggygttttctgtatgtcatatagtcctaaacacatgttaccttaaaaaaatttgaaggtaggcctggcacagtggctcatgcctataatcccagcactttggcaggctgaggcaggtgaatcacaaggtcaggagttcaagatcagcctggctgagatggtgaaaccccgtctctactgaaaatacaaaaattagccgggtgtggtggtgggcacctgtaatcccagctactccggaggctgaggcagagaattgcttgaacccaagaggcggagattgcggtgagccgagatcgtgccactg

SEQ ID NO: 93349 - DNA, 601 bp, Human
tggtgtacagggtaactgtataacagttagttttaagtacctgaactttagtagatgctttatggtttgtacttaataaagcatattaagaaaaatgcatcaaattagattgtcagaaataacatttttcttccaaggccgttgtgcttcagttcttaatgatacatcaagttttaaaaaaattatgcctaatgaattcaaaatgactactagaattcatactgtttattattaaatgggtatatagagaaaggtttatcttttaaagtaatttttatattataatgaatatcacttaagratttacattattttgaacttttttttttttttattctcactccagtgtttaatgcatcaggcaatgtctgttaaagattacatcctcagggtgactacctttggattagactcctggtcctccaccactttcaccctcatgatatgtcataatggttttagtaataactgccattgtttaacgatagcttaagataaaattcatataccatacaattcacttctttagagtgtacagttcattgatttttagtatattcacaaagtccatccgtccccacaattttagaacattttcatc

SEQ ID NO: 93350 - DNA, 601 bp, Human
ttttagtatattcacaaagtccatccgtccccacaattttagaacattttcatcaccctacaaaggaaccctgtaactattaacagtcaccacccatttccccttgattccttcagcccctggcaaccacgaatctactttttgtctgtgttagatttgcctgtcctggccattttatgtaaatggagttaaacactgtggtcttttgtaactgggtgctttcacttagccgaacattttcaagattcatccatgttttagcacgtatagtatttcatttctttttattgccaaataatayttcattatgtggatatatgagattttatgtagcctttgggaggattttagtaagcttggaaattaggacgtgtccagcatttgatagctttttttagtttacttggcagtttatttttctttcttagtggtacataaaataatttttcatcttaaaattattgtttaaatctgaaaatcagtctgtgataaatattatatttttctttgagtacctcagtttactcattaataaaatgcaaataattgacttgcctaaggtcaccaaataataggtagtgaggctaggatttgacctggt

SEQ ID NO: 93351 - DNA, 601 bp, Human
gagttaaacactgtggtcttttgtaactgggtgctttcacttagccgaacattttcaagattcatccatgttttagcacgtatagtatttcatttctttttattgccaaataatatttcattatgtggatatatgagattttatgtagcctttgggaggattttagtaagcttggaaattaggacgtgtccagcatttgatagctttttttagtttacttggcagtttatttttctttcttagtggtacataaaataatttttcatcttaaaattattgtttaaatctgaaaatcagtctrtgataaatattatatttttctttgagtacctcagtttactcattaataaaatgcaaataattgacttgcctaaggtcaccaaataataggtagtgaggctaggatttgacctggttctgcctttcttcagtcttttcttaacagctgcacatctgagcagtactatcagcatgttgataattagaataggtaatttgcagaatagaagttatcaatatgtaaaagaatgagttttagtaaggacattaagagtgggtattctggctggtatggtggctcatgcctgtaatcccagcactt

SEQ ID NO: 93352 - DNA, 601 bp, Human
ttgggaggccaaggtgggcagactgcttgagcctaggagttcaagaccaacagggcaacatgctgaaaccctgtctctacaaaaaatgcaaaaattaattgaacgtggtggttcatgactgtagtcccagctactccagaggctgaggagggaagataacctgaccctggagaggttgaggctgcagtgagccatgatctcaccactgcactctagcttctctagcttgagcaacagagtgagaccctgtctccaaaaaaaaaaaaaaaaaaaaaaggttggtgggggggtgctattcctktttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgttt

SEQ ID NO: 93353 - DNA, 601 bp, Human
gggggggtgctattcctttttattgtttacttttcccgccttctttagaattagtagagtattttttattattctgttttctctttattgacttattagctatgctatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataayacattgttaacttgtttcattttgagtggtgtattagtttgctagaactaccgtaataaagtactacagactgggtacctaaagaataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacacc

SEQ ID NO: 93354 - DNA, 601 bp, Human
tatatctgttgtcatttgtttgtttttggtggtggttgttgtatgggttgtagtaaacatctttaacttaccactgtctaattacaaataacattctactacttcataaataataattatacaacagctttgaccttctagtctttgttcttatattgtcattcattttacttttatatgttgtgaactcaataatacattgttaacttgtttcattttgagtggtgtattagtttgctagaactaccgtaataaagtactacagactgggtacctaaagaataatgtatttcctcacagktctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtcctccccatacatgtctgtgtcttaatctcctcttcttaaggacaccacttatattggattagagaaagcaaccctaatgaattcattttaactagataccactttgaataccctatctccaaaaaacagtcacgttctgagatagagctta

SEQ ID NO: 93355 - DNA, 601 bp, Human
agcaaccctaatgaattcattttaactagataccactttgaataccctatctccaaaaaacagtcacgttctgagatagagcttaggacttcagcatgggaatttggtggggaggaaaaacacaatttacccagtagcaaaaagttatctttaaaagataacttttttggagacagagtcttgctctgtcgccgaggctggagtgcagtggtgcgatctcagctcgcttcaacctctgcctcctgggtttaagcgattcttgtgtctcagcctcccgagtagctgggattacagatgtgcrccaccacacccagctaatttttttgtatttttagtagagacggggtttcaccatgttgctcaggctggtcttgaactcctgccctcaagtgatccacctgccttggcctcccaaagtcctgggattacaggcatgagccactgtgcccagccttgaaattgagttcttttattcacgtaccatatctagtgctctctattcctttgtgaaggtccagatttccacctagtatcattttccttctgtcaaaatgacatccttcaacatttcttatagtgctgatctgctggctttgaattc

SEQ ID NO: 93356 - DNA, 601 bp, Human
tttcttatagtgctgatctgctggctttgaattctttcaacttttgtacatcctttgaaaaagtctttattctcctttagttttgaaagatgatttttgcttggtatagaaggttgacagttttcccctgtagatgtcactccactgtcttctggcttaccttgtttctgaaaataagtcagctgttattcttgtgtgtgtttctttgaatgtaatgtttatttgggtggctgtcttcaagattttctttttattcctgattcattggtttttagcaatttgattgtgatgtacctaagtraagttttctttatgtctcttctccttggggttcattgagcttcttgtatatatagtttgtaattttcatcatatttggaaagtttttgtctgttactgattacatattttttctcttcctcttttctctcctttaggtactctaatcacatgtatattaggctgcttcacagtgtctcaaagatcatgatgctctgtacatttatttttttataatctttttcttttttttggatagtttttattgctctgtcttcaaattcactattttttcttcactgtgtagtccactgtaatctca

SEQ ID NO: 93357 - DNA, 601 bp, Human
aaataagtcagctgttattcttgtgtgtgtttctttgaatgtaatgtttatttgggtggctgtcttcaagattttctttttattcctgattcattggtttttagcaatttgattgtgatgtacctaagtaaagttttctttatgtctcttctccttggggttcattgagcttcttgtatatatagtttgtaattttcatcatatttggaaagtttttgtctgttactgattacatattttttctcttcctcttttctctcctttaggtactctaatcacatgtatattaggctgcttcacrgtgtctcaaagatcatgatgctctgtacatttatttttttataatctttttcttttttttggatagtttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtca

SEQ ID NO: 93358 - DNA, 601 bp, Human
tttttattgctctgtcttcaaattcactattttttcttcactgtgtagtccactgtaatctcatctagtgtttttcttttcatctggtagatttttaaattttagatactgtatttttttcttcagaagttccatttgggtctttttatatcttccatttctctcttcctcatcctcattgttgaccttcttcattatatggagtatatagttgctgttttattgtccttgtcattcctctgtattgtttggtttttctcctcgttaagtgttgtgtttttccgcttccttgcatgcttayaatttttgatttggcactctatacattgttgtgtattgtatttttggagttctttataagtatttaggattttttcctgggacatagttaagataccaggaactagtttgatcctctcaggggctccttttaaatgttattaagcaggtccgtaacaggtttttgtccagggctggtttgtccccattcttgaggcaatattcttctgaggactctacttcatgtcttgtgtttgaaaacatctttcaactttggctagtgggatcaggaactatttctggctatgtgtgagctctggtg

SEQ ID NO: 93359 - DNA, 601 bp, Human
attctatatccctaacttaatgagaccagtttgagttctctttcctattgttgtggcctagtaactctccctaggcagtaggatagagtgtaacattcacgttatttgtttcccttttcttagaaagtatctctgccctactctgccgattgtcaaatgtctgaaaacctttctttctttcttttttttttttgagacggagtttcgctctgtcgcccaggctggagtgcagtggtgcgatctcgactcactgcaagctccgcctcccgggttcacgccattctcctgcctcagcctcccrtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgaaaacctttatttcttataaattgtcctgttttctctttaaattgagagggtaagttcaatccctaatattctgtcatgccagatgaaggcatccttaatattctttcctaatgaaatttaattttg

SEQ ID NO: 93360 - DNA, 601 bp, Human
gagggtaagttcaatccctaatattctgtcatgccagatgaaggcatccttaatattctttcctaatgaaatttaattttgccacactatttgttatacttctgacacatcagtaaatttgtgaatcagttctacagaatttagttatttggcattatgatggtgtgtggaaagcttcaggtttgtgaaatggatacatacttgattaggaaaatgataagcactttgtcacatttcttatgaagcaatctaaattttttactgaaattataaatgatttaaaaatagtaccatctgatayaaagtctgctatctaaaccatttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtatcttttttcccctctctaggctgaagggta

SEQ ID NO: 93361 - DNA, 601 bp, Human
taaatgatttaaaaatagtaccatctgatataaagtctgctatctaaaccatttgatatttatattttgaaatttattatttctatattgttgagttattttagtcatagttataaactgtcagtgggaaaataaatctaagttgctggccattcttagttatagtttctgaggaataaaggtaagttctgagataaagcagtacttgagactataaatacactaacttaataaattggtctttattggttcatatttttgggttatattaattttcaaaacattgaaagtaaatttggtrtcttttttcccctctctaggctgaagggtatgtgattggcagctgtattaaacacattccaatcgcaggacgagatataacatattttattcagcaactgctgagagaccgagaagtaggaatccctccagaacaatccttggaaactgctaaggcagtaaaggtaaaaagtgtgataggagtgtaatttagttaaaaattaaaatcacatttataacattaacgtgagaaatttttaatagaagaagagtacttgaaataatcttgttaaccagttataaattattacccttaaatata

SEQ ID NO: 93362 - DNA, 601 bp, Human
ttttttttttaattacctgtaaatttttaaaatttttaatttcttatttttattgatttttttttttttttgtagagatgggatcttgttctgctacccaagctggagcgcagtggcacactcgtggctcactgcagcctcaaactcctgggctcacgtgatcctcccgcgtcagcctcctgagtagctaggactgcagatgcatatcaccatgtctggctaagtttttgtagagatggaggtcttgctatgttgcccaggctggtcttgaactcctggccttaagcaatcctcctgcttyggaatctcaaagtgctggatgtgagtcaccatgcctgggcctctttgcttgtttatgggattttccttgctcgtcagagcttaagaatgaaaatttatcaactacttcctaggtagtaaattagtaaatgactaccaaaagttaccccaagttggtggcataagaattaaatatataaaaagttaatgtgaatactactgattcaacatctttgggaaatctgtgaaattaaagcaaaacgagaaaacaccagagatttaaatctattccagagaagattgatggtcattctgaatgtct

SEQ ID NO: 93363 - DNA, 601 bp, Human
atataactagtagcaaaatagtcttctgtctatgaagttttagcaacataaaggctttattaaattaagaaatacatacttttaataatggaaaattcttctggtaacttagtatcagaattgtaactttattaatagaattactaatattacgtacttactctgcttatttaatgttaagaatagttatttttaaaattttgtttattcactcagcaaatgttaaatggtttgaattttcatgatctcagcttaagcactgggtattcaaagatgaaaaattattttatcttgctcttaytgagctcaaagaataaaagagatgagtatttaaacacgtaaggttatagttgctttaatgagtgtatgtatctgctgagggcacaggaacaaagagcatgtaagtctgcttgggagaacatctcaggggagataatggttgaactgagacttaaaggatgaatgggtgtttgtcagtcatgtgtggtaggggagtatatgtatttttgtcagaaggttagctaggcagaggtcttagacatgagagtgctggaaagaaaagtatagaggacagattggtaggagagggatccagataggt

SEQ ID NO: 93364 - DNA, 601 bp, Human
gcagcattggtttggacgggttggaacagaggtgtgaattgtgttggaaataggtgattttactatagtattttagatgaaagatgaatagtatttgtgggtcagtgagaatgaggaaggaggtgagagaaaaatagaatcaacataatcagtaattgcttagatatgaggggagtaagaatatgaggaatctgtgataattcacaggtttgtaacttgggcaacccagtgtgccatccactgaaatttgtaatactgaaggggaggagtaggtgaaatagacaaagatgagtttattatrtgcatcttttaaaaggttcaaaaacaaacacttgggtgttgtaaagtcatcaccctttgtggggcacaaaggaagaggttggctgagaaggggctgtggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaa

SEQ ID NO: 93365 - DNA, 601 bp, Human
ggagtagaaaggtgaagaatagggccttcgtgaacacagacacgtggacaggctgagtaagtagagcctgcaaagaatactgaagatgacagagaggtagaagccaagctaaaggattatggtcataaaattgagagaagtgaatgtttcaagaagggagggtaaatagtgccagttgctgcagtgaagtaacattagaggaaaccttagaagtacttggagtttttcagcatctaggttattgatgatcataggggaggcgtttcaatggagtgatacgttagagcagcttgttacttayctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactgga

SEQ ID NO: 93366 - DNA, 601 bp, Human
tgctgcagtgaagtaacattagaggaaaccttagaagtacttggagtttttcagcatctaggttattgatgatcataggggaggcgtttcaatggagtgatacgttagagcagcttgttacttatctcagtgagaggtgaaggtttggaaatcagcagtctggacattctgagagatggctatgaaagaaaaagacagtggacgagtaagaattcagttgcaagaataaggctcaagatagttttaaatttttaagagggcttactccagttacaggagggaaggaattaagtataggtayaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatg

SEQ ID NO: 93367 - DNA, 601 bp, Human
gaattcagttgcaagaataaggctcaagatagttttaaatttttaagagggcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcagg

SEQ ID NO: 93368 - DNA, 601 bp, Human
gcttactccagttacaggagggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcrcctgtagtcccagctactcgcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctccccc

SEQ ID NO: 93369 - DNA, 601 bp, Human
ggaaggaattaagtataggtacaggaaaatgaactaggaagggcagaagcacaggtaggtagttgaagaagttcatcatcatagttcatagttttaatttttttatgaggtggaatcaagcttatgttttgggagaagggactggactaaaattgaggccgaagcgggcagatcacgaggtcaggagatcgagaccatcctggctaatatggtgaaaccccgtctctactaaaaaaaaaaaaaaaaaaaaaaaaaaaattagctgggcgtggtggtgggcgcctgtagtcccagctactcrcgaggctgaggcaggagaatggcgtgaacccaggaggtggagcttgcagtgagccgagatcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggag

SEQ ID NO: 93370 - DNA, 601 bp, Human
atcacgccactgcactccagcctgggcgacagagcgagacttcatttcaaaaaaaattgagggcttgtgaagaataatgactttcatatttactgttgaggggaattgagagggtgactagtgagtacatattaatagtatggggcatccattctttactcaaggtagcaggttagatacccaaaacttttagttgtgcaatagtgtcctctcgcctcccccagacagttgtgggaaaggaggaaaaggttttgataaagcagagattaaagtattacagcatagaggagagagcaagtcstgaaagctgaattacctagggatagtgagggtacaggtattggagatcatgatgaaatgacacataataattgtgaattggtagcagaggagtgagcatgagaaggataaggaattgtggtcagactagtatactggagtgtgaaggtttttggtggtacattttctttgcactttatcaaaacataaagattaagaggatgtatacacacaattttaaaggtcaaataacactgacagacttaaaattagcagctcttcaccctcctgctgccattgtgttctatagagcatccactag

SEQ ID NO: 93371 - DNA, 601 bp, Human
acagttgtgggaaaggaggaaaaggttttgataaagcagagattaaagtattacagcatagaggagagagcaagtcctgaaagctgaattacctagggatagtgagggtacaggtattggagatcatgatgaaatgacacataataattgtgaattggtagcagaggagtgagcatgagaaggataaggaattgtggtcagactagtatactggagtgtgaaggtttttggtggtacattttctttgcactttatcaaaacataaagattaagaggatgtatacacacaattttaaaggtsaaataacactgacagacttaaaattagcagctcttcaccctcctgctgccattgtgttctatagagcatccactagcttttagttattgctcttggtagtaacccccagatttctaaatactgtgatggtattgcaggaacatggatggagctgtttcttgatatgtcactgttagtggtttaaatgctagcctcctttcagattagttctttctagactctcttttcttccagcctgccaacatgttaggttattgttattaggtaaatcaatagtattgtaatatttatagtattata

SEQ ID NO: 93372 - DNA, 601 bp, Human
ttgctcttggtagtaacccccagatttctaaatactgtgatggtattgcaggaacatggatggagctgtttcttgatatgtcactgttagtggtttaaatgctagcctcctttcagattagttctttctagactctcttttcttccagcctgccaacatgttaggttattgttattaggtaaatcaatagtattgtaatatttatagtattatacctgagactgttgttcacttttgaggcaagtagtgtaatgtgattcttttcccttaaaattcagcttttcctacactttcaccttgkttattcatttgcttcattttctttttttttaactttaagttcaggggtacatgtacaggtttttatataggtaaacttttgtcatggaggttgtacagattgttttgtccccaggtattattaagtctagtatccgttagctatgtttcctgatcctctccctcttcccactctccaccctccgataggccccagtgtctgttgtttccctccgtatgtacatgtttacttatcatttagcttccacttaaaagtgagaacatgcagtaattggttttctgttcttgcactggtttgctg

SEQ ID NO: 93373 - DNA, 601 bp, Human
ttccctccgtatgtacatgtttacttatcatttagcttccacttaaaagtgagaacatgcagtaattggttttctgttcttgcactggtttgctgaggataatggcccccagctccatgcatgttcctgcaaagaacatgacctcattcttttttatagctgcatagtattccatggtgtatatgtaccacattttctttatccagtctaccattgatgggcatttaggttgattccatgtctttatttttgtgaagtgctgcagtgaacatacatatgcatgtgcctttatgatagaacratttatactcctttgggtatgtgggattgctgggttgaatatttatgttttaggttcttgaggaattgccacactgttttccacaatggttgaactaatttacacctaatatacaccaagagagtataagcgtttctttttctttccagctttgccagcacctttttttttctttttaaattgtatttattttttaaaaatattttctctttccttcattttttaggagggatggtgtgagaatattttttgagtttttaataatagccattctgactggtatgagatggtatctcattg

SEQ ID NO: 93374 - DNA, 601 bp, Human
ccatgtctttatttttgtgaagtgctgcagtgaacatacatatgcatgtgcctttatgatagaacaatttatactcctttgggtatgtgggattgctgggttgaatatttatgttttaggttcttgaggaattgccacactgttttccacaatggttgaactaatttacacctaatatacaccaagagagtataagcgtttctttttctttccagctttgccagcacctttttttttctttttaaattgtatttattttttaaaaatattttctctttccttcattttttaggagggatgktgtgagaatattttttgagtttttaataatagccattctgactggtatgagatggtatctcattgtgggtttgatttacatttctctaatgatcagtgacgttgagctttttttcttaagatttttggccacatatatgtcttcttttgaaaattgttcatgtcctttgcccactttttaatggagttgttttttccttgtatatttatttaagttccttatagatgctggatattagacctttgtcagatgtgtaatttgcaaagattttctcccattctgtaggttgtctgtttactc

SEQ ID NO: 93375 - DNA, 601 bp, Human
ctgttttccacaatggttgaactaatttacacctaatatacaccaagagagtataagcgtttctttttctttccagctttgccagcacctttttttttctttttaaattgtatttattttttaaaaatattttctctttccttcattttttaggagggatggtgtgagaatattttttgagtttttaataatagccattctgactggtatgagatggtatctcattgtgggtttgatttacatttctctaatgatcagtgacgttgagctttttttcttaagatttttggccacatatatrtcttcttttgaaaattgttcatgtcctttgcccactttttaatggagttgttttttccttgtatatttatttaagttccttatagatgctggatattagacctttgtcagatgtgtaatttgcaaagattttctcccattctgtaggttgtctgtttactctgctgatagtttcttttgctgtgcagaagctctttaattagatcccatttgtcattttttgcttttgccatcttcatcatggaatctttgcccatacccgtgtccagaatggtataatttgcttcattttgtttgtaca

SEQ ID NO: 93376 - DNA, 601 bp, Human
cttttttttaaaggctgtttttaaaaatcagttatatatatgcacatggtttaaaagtcttggtctgcgtatcctaacaaaaactaggggtgccctgcatgtttctttctcttgttttgtatttctagaggtaaccacttcaaactcttcttagttgcttcttttgctgattacctccttagctatgaattgcttggttatattgcaacttcaaattttttttcagtgttaggcttttcttgttttcttttggaaacagggtcttgctctgtcacccagtgcagtggctgagtcatggctygctgcagtctccccaggctcaggtgatcctctcacctcagactcccaagtagctgggactacaggtatgtgccaccacttccagctaatttttgtatttttcgtagaaacagggttttgccatgttgcccaggctggtcttgaactcctgggctcgagcaattcacccatcttgccctcccaaagcgctgggattataggaatgagccactgtgcccagccctgtgttaggcgttgtctgtcgaattccaactatggaagaggaagattgtcttttttatccttcttctgtcatcacaga

SEQ ID NO: 93377 - DNA, 601 bp, Human
gttatagagccagctgagttgagctctattctgttttccctgaccctagtctgtaggttgggttctaaaggctcagtatgagccacattttcatacctagtgtatattcctcttagaattccgtatgtacactcctcagcatgcttcaaaaagagattttggctgccaggttcttttcttttattatgataataaaggtcagtagaatctttcttagtgatgtttttacatgatctaaatgaaaagattttgtattagtatgtgtcactttgataacattaaatctcttttcattgtatgygcagcctgtaaataatttagaactaatcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcc

SEQ ID NO: 93378 - DNA, 601 bp, Human
tcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctcaaaaaaaaaaaaaaaaagaaaaaaaaaaagaaaaaattgacacatgcctaataattatcaatacagttatagactcagtttaataaataaaggaatattgtctctcaactaggacaacctaatgataaaaatgaatggctgaggagatatacaatacttgtttgtttttcactaattagagctagattttgattatttatttagagacagagtctctctctgtcacccaggctggagtgcagtggtgtgatcataactcagtgtaacctcgaattcctagggtcaagcaatcctttttcct

SEQ ID NO: 93379 - DNA, 601 bp, Human
cgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctcaaaaaaaaaaaaaaaaagaaaaaaaaaaagaaaaaattgacacatgcctaataattatcaatacagttatagactcagtttaataaataaaggaatawtgtctctcaactaggacaacctaatgataaaaatgaatggctgaggagatatacaatacttgtttgtttttcactaattagagctagattttgattatttatttagagacagagtctctctctgtcacccaggctggagtgcagtggtgtgatcataactcagtgtaacctcgaattcctagggtcaagcaatcctttttcctcagccctctcaagtagctggaactacaggtgtgtgccaccatgcctagctagtttttaaattttttgtagagacagggtctcgctatgttgcccagg

SEQ ID NO: 93380 - DNA, 601 bp, Human
tatattcatttatattcaatagcactagaacacatgtctgaacaaagctatctaacttgctttttctctgtaagacacatcacagcctccttgtgtttactagccagcacttgagcagtatgcttgggggccattttaaataatgaaatcactaacaaaaatatgaaaaccgtgccactaaatagaactgtgaaaaggacacttgtttatagtatgagagctgaaactagatagcagagtatcatcttgttcaacctcaatggggaatgtgcacatcagtggactcaaatttttgttgctytacacgtgcatgtccatgaataaccatattttgatttggggagtaacaaatatgttttagcgattaggtaaattcacaaatatggaatcatgaataatgagattagactacatttatttatttcatcccctattgatggacttaacgggtttttcctcttagaaacaaggctatagtaaatatgcatatgtaatagcatacatgtttggggagtttcttcagagtttgttgtaagaagtggagttactggtatgtgcatttaaaattttattagctatttgtattagtccgttttcatac

SEQ ID NO: 93381 - DNA, 601 bp, Human
aaagaactgtagatgcccggctgaaattaagtgaggaattgagtggtggtagattgaaggttggttttcccaattattggtgagaaggttgagggtgccttccttgattaggatgagaaatatttgccagcattcactctgatttagaaaaataagaggaacctgtcaggtattctaatggaaatggttaatgttatagatttatgtctgtgatattctggatcatttgattcttctaggatattgtctgtatttctggaaaataattcttagtaatacctgtggaaagactttttttttwaatacctctctcatagataattaatatagtagatttctttgcatacaccaacaatcaaattaattatggatccacaaaatgttttatactatagaaggacagcaaagctgagttgagattgatgccattgttgagtagtcaagcctgctctcaaaaactgactttagctcccacatagcaacctcaaagtgtgcagtcaaatcggtggtttaataaagtaacctttgtattacatgtcctggacctttaggcttgaggttaaaaaaaatcaaaattaatttaaaattcttagatgtctac

SEQ ID NO: 93382 - DNA, 601 bp, Human
caagaatgaggactttatctgagacttccataatcattcagaattacttaaaagtaaagcacagcactctagggtttgctgattgttgagaaattgcatgatggctgactgttgtcagtgcctatattttgattatcttgagtaaacctatccctaggaatgcagtaaaaagtatatgttttgggtggaaggcaaaatattgaactctgtccctataatgtcatgacttcacacttcaggaagtctactcaatagacttttaaaatgttgtgtttgcttttgcatccccttcccaaccaascaaaccaccagcccacccccattcatccattcatttgcccatccgtctactccccttacccacatatctatctaccctacctcctacctaaaaaagaagtcattgggttttgcaagtataaattctctgtactgagaatcctactaaccacattgattatgtgaatgaacatagtgcatgttctggtttttttgttagaatacttaaaagattgaagttgattgtcctaatggtatggttatggatgtattaaagtagctgtttagtttttaataactcattacagatatataagtacaa

SEQ ID NO: 93383 - DNA, 601 bp, Human
tgttctgtttaagtatttaaaaacattaaggtaaaagttaagcttcattgcatagaaagtatgatgttttacactgaataaagggaattattctaagaatcctgtccccaaattaaaatgtctttaaagccccctaaaaaggtgttctagtgttctaataccattaacctaggaagtattggtgctttgttctggtagtgcatgcaatattaaaatgaaggagcttttatctgaattattgaataactgtacaactttggatttaaaaccatttccaacataagaggtgaaagttattttyttcctcaattttagtcttcttcaattgggccatataacctagttgagtttgtgactttgccttgagaaatgaggtaacacagcatggaacagtctatcttttccagaccttgaatgaggaaggcaaatgatctagacatttcttagaactagacgaaaaatagtcatagcatgactaggagtagttttatctgtagttaggcgaatgccgcttctttacattattggtgcaatgaaagtatgggaaagtctcaacagaacagactggacatttgagaaccttccatttttcaaaatttca

SEQ ID NO: 93384 - DNA, 601 bp, Human
tgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgcyacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaactatctcagatttactgaggtttatcttctgg

SEQ ID NO: 93385 - DNA, 601 bp, Human
tctcgatctcctgacctcaaatgatccgcccacctcggcctcccaaagtgctgggatgacagttgtgagccaccacactcagcctgctctttctaatatttgaaacttgttagacaatttgccacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatatkctagtgtctcatttcaaaggctgctttttccagcttacattttatatacttactcacttgaagtttctaaatattcttgtaattttaaaactatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtcca

SEQ ID NO: 93386 - DNA, 601 bp, Human
gacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagkgatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatag

SEQ ID NO: 93387 - DNA, 601 bp, Human
ctaaaatcattttaagacaaaattggtctgataaactttcttgcaattttggtgttcttctggtatttcagcctcatattagctaagcacgacttcaaggaagatcaaacgatggaggacctaaaaactaagtctacctgaggaaacttttcctattacttcatataaactttctggtttattttcaacgaaaggacagatgagattgtttggggaggtggggggcatgtgtagctggttcggggtttttgtgtttggttttgtttttgttagtttattcttagagcactcttttactaamgtcaccaatataattcacattcttttaataatgaaaaactgcttgtgctagttttatctcatgagaaaaaacactgttcctaaatcaaaagcaaaatgttgtatgttcagagctatatgaagacagccaagttataaaagcccattttcagatctggaacaacttctgaaaacaaagagggtatttgggataccttatgctaaagaaaaaaaaaatcctgctttcattatttcctgattctggagatccaataaaaactttatggaataaaaagtcttgcaaaaatccttcagtgaaaac

SEQ ID NO: 93388 - DNA, 601 bp, Human
taaggtggcttacttgaggtacacccaatatataatcctactggttcccagaggtgttgccacactacatgcataagtcaacacacaaaatagcacaagcacctataaaacctacaaaaaggaaagtagcatgttaagtccatgttattcccggtaagaaagttctgcttaatgatactagaaaggccccaaaagtttatatcataaaatttgcaaaaactgccctagcatttaacatgtcttcgtcatattaccagcagagaattccccacaaaactaccagccttcctgaactccaaartaagacattagtttggaactgacttagaagcaaaaatctgaattctagattgctatgttttccttggattttacccattctaggattagtcaagggattgagattgggaaatcttaaagatcatagtccaaagaatgtagacacacaaaataataaagcaagtcaaagctaatttccaaagattaccatccaatcaatcacacatttcctaaaagtagcagtggagtttttaattattaaaggtaaaaagagattcatgtctaagtcccaaaattaatggtttaccctcatttggtccac

SEQ ID NO: 93389 - DNA, 601 bp, Human
ttgaactagttttcctaataattatttggtttgtttctattagttttatgacaaccttctgttggctttgatttcagtatctataaaataacattggagagagagctatctcaaaatttttatgacttaaagaatttcttttttttttttttttttttgagatggagtctcgctctgttgtccaggatggctggagtgcagtggtgcgatctcggctaactgcaagctccgcctcccaggttcacgccactctcctgcctcagcctccccagcagctgagactacaggcgcccgccaccaygcccggctaatttttttgtatttttagtagagacggggtttcaccatgttagccagaatggtctcgatctcctgacctcgtgatccactcgcctcggcctcccaaagtgctaggattacaggcgtaagacaccacgcccagccagcgacttaaagaatttcttaagtgcaagataagcacatagctatcattaatagataatccttctttgatttactcagttatttatttagtgtcatccttgctccagagaggatataaggtggcttacttgaggtacacccaatatataatcctact

SEQ ID NO: 93390 - DNA, 601 bp, Human
aaacgtggtatgaggtcctcaaggacctatgcgaatttatctgcctttatgtacagattaaaaagtactaagtttgtcctaaattctaagatctgaaaaatcaagcaaatatcggctctagtgatctcaacagatgaacaaatgacaatgaatactgaagattttgaactagttttcctaataattatttggtttgtttctattagttttatgacaaccttctgttggctttgatttcagtatctataaaataacattggagagagagctatctcaaaatttttatgacttaaagaatttyttttttttttttttttttttgagatggagtctcgctctgttgtccaggatggctggagtgcagtggtgcgatctcggctaactgcaagctccgcctcccaggttcacgccactctcctgcctcagcctccccagcagctgagactacaggcgcccgccaccatgcccggctaatttttttgtatttttagtagagacggggtttcaccatgttagccagaatggtctcgatctcctgacctcgtgatccactcgcctcggcctcccaaagtgctaggattacaggcgtaagacaccacgc

SEQ ID NO: 93391 - DNA, 601 bp, Human
aagaccagcctggacaacatagcgaaaccctacatctactaaaaatacatagcatggtggtacgcgcctctagtgccagctgctcaggaggctgaggcatgagaattgcttgaacctgggaggcaggggttgcaatgagccaagatcacaccactgcactccagaccgggcaacagagtgagatgctgtctcaacaaaacaaaacaaacaaacacatatgtcaaaactcatctaactgtacactatatatatgcaacttattgtatgctattatacctcaataaagttagcaagtgacctrtaaagagtggtttccaaattttcaaaaagtgctatttccacagcacaaaaagaatcacaagtgaatcagaaacattcagtgtaatcaggaatatttttgaaggtatgaattacaacagtcaggtatttttttgcagcttctagaatgttatcttaccaggttcctcattcatggtcaagtgaactctaagaacactgtagtatactccctagtaaacaaaagcacaaaagcagcaaacaggacttctctataatttgtcaaactgggagaagagaaactctatccacctgagattagtat

SEQ ID NO: 93392 - DNA, 601 bp, Human
tatgcatgaaattgcatatagctcctaggctacaaacctgtatagcatactactgtactgataccgtaggggattttaagacaatggtatgtgtgtatctaaacatatctgaacatagcaaaggtaccataaaaatattataatcttatgggaccactgccatatgtaatctgtcttcgactgacctatcatgatgtggtacatgacatacaaatataaaaagaagacataaccatagaaatcaaatacattaaaacaattatgagagaataatacatacaacttattgactacaactttsaaaacttaaatgggcaagtattagtaaactaaaagtaaccaaaattgagcagagaagtgtaaaacctgagtggaccgattatcctagtgtagtggttgccaaatttgctgaacactggaaccatctgggattcttgaaagcagtttatgtttggcttccaaccccagctattctgatttaattgatatggggtgagacctggacatgagaactcttttaaaagttcccccaagtgattcaaatgtacagcaaagtttgggaatcactatgacaccacattcagaatgtggttccagagcc

SEQ ID NO: 93393 - DNA, 601 bp, Human
ttaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgattctctaaaaagaccaacaagacagaaaaaccacttccatgcctgattaagggaaaaagagaaagtaaaaatayacaagtatagtcatgaatggcttaacggcagggacacattctgagaaatgtgttaataggcaatttcatggttgtatgaacatcacagagtgtacttacacaaacctagatggtataacctactacacacctaggctatatgcatgaaattgcatatagctcctaggctacaaacctgtatagcatactactgtactgataccgtaggggattttaagacaatggtatgtgtgtatctaaacatatctgaacatagcaaaggtaccataaaaatattataatcttatgggaccactgcca

SEQ ID NO: 93394 - DNA, 601 bp, Human
aggccatactgtctcatctttggcaaataaaagtaaataacaaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaakgattctctaaaaagaccaacaagacagaaaaaccacttccatgcctgattaagggaaaaagagaaagtaaaaatatacaagtatagtcatgaatggcttaacggcagggacacattctgagaaatgtgttaataggcaatttcatggttgtatgaacatcacagagtgtacttacacaaacctagatggtataacctactacacacctaggctatatgcatgaaattgcatatagctcctaggctacaaacctgtatagcatactactgtactgataccgtaggggattttaagacaatg

SEQ ID NO: 93395 - DNA, 601 bp, Human
ttgaccaaagaggcaactttaacaaatccctaaaagtacagacttttaaggccatactgtctcatctttggcaaataaaagtaaataacaaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaaytaacagaatagaaaaaaagaaatatttaaaaaaataaataaaacaaatgattctctaaaaagaccaacaagacagaaaaaccacttccatgcctgattaagggaaaaagagaaagtaaaaatatacaagtatagtcatgaatggcttaacggcagggacacattctgagaaatgtgttaataggcaatttcatggttgtatgaacatcacagagtgtacttacacaaacctagatggtataacctactacacacctaggctatatgcatgaaattgcatatagctcctaggctacaaacc

SEQ ID NO: 93396 - DNA, 601 bp, Human
aaataaagtcacagtgagaatttttactattaatgtatctttttaagaattgaacatgactgttagacaaagactaacttcatatcattcaaatacaaattatattttactgatatgttcatggaacttctaaaaacatcgatcatgtttttgaccaaagaggcaactttaacaaatccctaaaagtacagacttttaaggccatactgtctcatctttggcaaataaaagtaaataacaaaaaaatgactgaattatctcaactacctagaaattaagaaaataaaccatgaaccaaagrgaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgattctctaaaaagaccaacaagacagaaaaaccacttccatgcctgattaagggaaaaagagaaagtaaaaatatacaagtatagtcatgaatggcttaac

SEQ ID NO: 93397 - DNA, 601 bp, Human
accccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattatattttactgatatgttcatggaacttctaaaaacatcgatcatgtttttgaccaaagaggcaactttaacaaatccctaaaagtacagacttttaaggccatactgtctcatctttggcaaataaaagtaaataayaaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgattctctaaaaagaccaacaagacagaaaaaccacttcc

SEQ ID NO: 93398 - DNA, 601 bp, Human
caaagagaaatcaggcaaattcaaacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattataytttactgatatgttcatggaacttctaaaaacatcgatcatgtttttgaccaaagaggcaactttaacaaatccctaaaagtacagacttttaaggccatactgtctcatctttggcaaataaaagtaaataacaaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaa

SEQ ID NO: 93399 - DNA, 601 bp, Human
tccaaattagcaaagagaaaagaaaacacaataaataagaatgcaatcaaggcagcaaaaataagaaaataggatgtaaaaatatataataatatgaagtaaaatataagggataaaataaaatacataaatcactacaataaatgtatacggactgaattttcccataaagggagtttaggtcaactgaaaaatacaaaatccaactgttttcaagaaacacacctaacacaaaatgataataaagagaacaaaaagttgtaaataaatgggtaggcaaagagaaatcaggcaaattcawacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattatattttactgatatgttcatggaact

SEQ ID NO: 93400 - DNA, 601 bp, Human
aagctgtctaactcttctacacctcacatttctcttccctaaaatataggtaataatcatactacctatgagtagatgcaaaaattgcataatcttttcaagtaatagtaaagcagacatctcaagagcaggaaaagaaaaagtagaatttccaaattagcaaagagaaaagaaaacacaataaataagaatgcaatcaaggcagcaaaaataagaaaataggatgtaaaaatatataataatatgaagtaaaatataagggataaaataaaatacataaatcactacaataaatgtatayggactgaattttcccataaagggagtttaggtcaactgaaaaatacaaaatccaactgttttcaagaaacacacctaacacaaaatgataataaagagaacaaaaagttgtaaataaatgggtaggcaaagagaaatcaggcaaattcaaacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctatt

SEQ ID NO: 93401 - DNA, 601 bp, Human
ggatttgtttttaattgtggcaagttgatagagaaaaaaggtcattacattaatgttacaactttcatttatttcattttaataaaatggactcatttcagatatatgagcatatttctttcaccagaacattaagaaacaaaacattttaaaaatcagaacattcataaatacacaaacattaaaaatatataaaatagaaattgtgctagcaggaaatttttttcctaatatcaatgagattgcatctacagtttcacaatgaaaatgttggctatgaatttatcactgatttttttttctcattatctgaaaaagtactcacttattcctagttttctcagatttttaaaaagttttctgacgagaatggctattgaatattatcaaattcttttttggcattagtagagattctccggtttttttctaacagcatttattggtgttatatattactgaattcgtagatttaattatctttgctcatccatggaagacagttcttaaatttactgttgaactggttggctcagtttcttctaatatttctacaggtagctggaaagcttttatggaaatttttgtattttatttgtca

SEQ ID NO: 93402 - DNA, 601 bp, Human
tatatattgcatggctgtatcatactttatattaaccattccactgtttggcattttaggttatttcccaatttttaaaatataataaacaaatagcactgtaattaacatcctcatacacaaatctttgtcagccattctcatgatttccttaggctggagttcccagaattagaattacagggtcaaaggacataaactcttttaaaactcttggtaaaaactgtcaagcagctttccacaaagttgttttgccaacttacactccttagggcaagctgtgagcatgtccatctcacartcctgctgccagacttacatattagtagggatttgtttttaattgtggcaagttgatagagaaaaaaggtcattacattaatgttacaactttcatttatttcattttaataaaatggactcatttcagatatatgagcatatttctttcaccagaacattaagaaacaaaacattttaaaaatcagaacattcataaatacacaaacattaaaaatatataaaatagaaattgtgctagcaggaaatttttttcctaatatcaatgagattgcatctacagtttcacaatgaaaatgtt

SEQ ID NO: 93403 - DNA, 601 bp, Human
aatatgaaacgtaaacccacgaggatgatttaggtgatcttggagggagtcagaaatttcccaactttaacacgccctgatagcattatatttttttcaatatttccttccagtcctttaaactttttccgcatatatatatatatttatttataaaatcaatatcaaatttaaatatagttgtatccagcttttttcctattaacattgtatctgtccttttagataaagtttttcaaaagcatgatctttatgactatatattgcatggctgtatcatactttatattaaccattccaytgtttggcattttaggttatttcccaatttttaaaatataataaacaaatagcactgtaattaacatcctcatacacaaatctttgtcagccattctcatgatttccttaggctggagttcccagaattagaattacagggtcaaaggacataaactcttttaaaactcttggtaaaaactgtcaagcagctttccacaaagttgttttgccaacttacactccttagggcaagctgtgagcatgtccatctcacagtcctgctgccagacttacatattagtagggatttgtttttaat

SEQ ID NO: 93404 - DNA, 601 bp, Human
ggcagtcaaacacagacaatacaatgactattgcagctattcacagaaaaaaagaagacaattcagaatgtagcagggtgtttctccactccccacccccaacttcccaggttctaagaaattggaatctacggaaacaatggaaagaggtagtttaccgaaaccatgaaaagcattggaaatatatcagaacttctttggaacctactggataaaatgcaaaaaaccacagaggtcccactgggctctactcctgcatggagcccagtgagactttagtggaggaaggtttcctgaggaygagtgatgatgcctattaaccatgtacctatgggaacagggacaggtgagaatcagccaagtggggtagcctgggagaagcaccggaagcagatggctgccaccttcatgcatctctgcaggcagcatagcctttgtaacggacaggcattaaccaagacgtggcagagtgaaaaagaaatcatggatgaaatagtactcagatacttaaaatagtacttggatacctactagtgcttactcattagcatacagaagacaatacttgagggctgtagcaaaataactgagaggattttga

SEQ ID NO: 93405 - DNA, 601 bp, Human
tatcagatcctttatttacagaagtgactgggttttgttcatctctatatcttccttaatgactaactcgttgcctatatatagagtaagtactaaataaacacagaacaaaattttaaaattcaactttacaaacagggtcacacattaacatcttagtcattttattacaatgtagatacagatggtttaagatttatggataattatactaacctctgttattccctagaacttgtttgctgaagagtgtatttaggcttttgggtcacatgagaaagagtaatgattagggtcggaytgtatctcttactttgttgtgtactaatgtgtaatgtcaagcatttaatacaaagtaacaaccaaagaactggaagtgtttaaatagtaagagcccaaaaatatttgtgaaacacatcgatgaataagtgatgaacatttcaatgtatttacataaactatatcagaggtaatacaaaataacattacaatatctatgtgtaatctgaagttcatttccttattactccaatgagaagtcagagatccatctgctcctaagtcatgaccattaagatggagtggggtgtgagcctgttgg

SEQ ID NO: 93406 - DNA, 601 bp, Human
aagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctggtcggggaaagagatgttttgactcttctggaccactgtaacttactatcatatagaaagatttttgttgcttttgttattgtttatagttcattatactttattttatatagggtaaacttaataaagtaaatatattaagtacaaaaccttctttatsttgggaggccgaggtgggtggatcacaagatcaggagtttgagaccagcctggccaatatggtgaaaccccatctccactaaaaatacaaaaattagccgggcatggtggcgggcacctgtagtctcagctactcgggaggccgaggcaggagaatcacttgaacccggaaggcagaggttgtagtgagccgagatggagccattgcattccagtctgggcgacagaacaagactccatctcaaaaaaaaaaaaaaaacaaaacaaaacaaaaaaacaaaacaacctcctttatcatgac

SEQ ID NO: 93407 - DNA, 601 bp, Human
acaaattaagatcttagggccagtggaacctgcgatcagctatataccgaattacgcacactggcctccagacagtccaaaatgatccgcaaatctttattcagaaaatttaccagaacaaaaggcaccacactgcttttcaaccatacatagcatgaaaagacagaaaatcattcaattagcatatgtgtttcactgctgtgaactgaggagccactgatgtttgacatccacccacccaccttctttagaaacagaatgaaagaaggagtgagaggaagttgtaagatctcagtagggrataaaacaggtgccacattaagtcattattctgaaaaatatatatacatttttaagagtattataacaaaatgtcccaatttaatgcacttctattttaagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctggtcggggaaagagatgttttgactcttctggaccactgtaacttactatcatatagaaaga

SEQ ID NO: 93408 - DNA, 601 bp, Human
atcttatagagttgttactactggagataaaaatataaaccccatgataagcatgttaccaacaaattaagatcttagggccagtggaacctgcgatcagctatataccgaattacgcacactggcctccagacagtccaaaatgatccgcaaatctttattcagaaaatttaccagaacaaaaggcaccacactgcttttcaaccatacatagcatgaaaagacagaaaatcattcaattagcatatgtgtttcactgctgtgaactgaggagccactgatgtttgacatccacccaccmaccttctttagaaacagaatgaaagaaggagtgagaggaagttgtaagatctcagtagggaataaaacaggtgccacattaagtcattattctgaaaaatatatatacatttttaagagtattataacaaaatgtcccaatttaatgcacttctattttaagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctg

SEQ ID NO: 93409 - DNA, 601 bp, Human
tttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtccacagtggccatggagcctgcttgctagctggtctatgtccaaaactagagatgagaactcccacaaacaacagtaaccctgcacccagcccaccccattctcatctatgttaagkgggtgtaatgagtgtgaggaataccttagcaggggaggttatggcctacttgcttctgtcctagggtgagaataagtttgaaaatcctcagaattgaaatacatctgagaaacaaacaaacaaaactagattctaagaactggcaatttgactggattttacataaagcttcagggctgaccaaggaattagatgcagttcagagatgtgaagcatgggtagtgcagcaacatggagcactgaaatcaaagagctgggatttgaatcctagccacagatgaccagttatgaaatcttggc

SEQ ID NO: 93410 - DNA, 601 bp, Human
gtaaacccttctctgatgaaagaaaagtgaactgctgttaccagcaccccgacccttgttccagggtcactaataacataaaaagcagaacttgtatatacagcaaatacagaactttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtcsacagtggccatggagcctgcttgctagctggtctatgtccaaaactagagatgagaactcccacaaacaacagtaaccctgcacccagcccaccccattctcatctatgttaagggggtgtaatgagtgtgaggaataccttagcaggggaggttatggcctacttgcttctgtcctagggtgagaataagtttgaaaatcctcagaattgaaatacatctgagaaacaaacaaacaaaactagattctaagaactggcaatttgactggattttacataaagcttcagggctgaccaag

SEQ ID NO: 93411 - DNA, 601 bp, Human
tacaggtttattgatgcggtttgatttgccatggcccatgcatacagaatggtctgtgggctctcagtgaatgcttttgactcggtagcacctggtagactaaagcgaaaaatgaaagaaagaaaaaggaaaccacaaccacaattagcaccttgctggaataatgtcaaagatctcttaaagccaccgttcttttgtaaacccttctctgatgaaagaaaagtgaactgctgttaccagcaccccgacccttgttccagggtcactaataacataaaaagcagaacttgtatatacagcmaatacagaactttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtccacagtggccatggagcctgcttgctagctggtctatgtccaaaactagagatgagaactcccacaaacaacagtaaccctgcacccagcccaccccattctcat

SEQ ID NO: 93412 - DNA, 601 bp, Human
tgcaaacattttagaaaatcaagcaaaatatattgttatttcatcaaaggttttaagattttaattcaaattttcctaatatgtggtcactctttatactacatttaaggttcaaaatacaaagtattttaaatcatactgcatgcttaagtagtaacaaaacaatttacttacttctggatactcttacaagttctgatacattgaagactccagattttacaaaactatcctcaaggtaacctgaaaataaatattaaaggaaaaatgatcaatataagcagaaagtaaaataaatgaytatacactagaatttaagtgttttaaagccaatggtttgaacaaaaaccaaatatgcttacaataaggactttaaaaaatgactcttaggaatgcaaattaggtttgtttaaacaaaaataaaaagtttagataccaaataatctcttaggaaaattttttcttccctttctaaaagtacaggtttattgatgcggtttgatttgccatggcccatgcatacagaatggtctgtgggctctcagtgaatgcttttgactcggtagcacctggtagactaaagcgaaaaatgaaagaaaga

SEQ ID NO: 93413 - DNA, 601 bp, Human; identical to SEQ ID NO: 32887

SEQ ID NO: 93414 - DNA, 601 bp, Human; identical to SEQ ID NO: 32888

SEQ ID NO: 93415 - DNA, 601 bp, Human; identical to SEQ ID NO: 32889

SEQ ID NO: 93416 - DNA, 601 bp, Human; identical to SEQ ID NO: 32890

SEQ ID NO: 93417 - DNA, 601 bp, Human; identical to SEQ ID NO: 32891

SEQ ID NO: 93418 - DNA, 601 bp, Human
gaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaratttgcctccccacctaacacagggttatgcttttgtctcagttcccaccaccaccctcttcagcccctcacttctttactagttaaaatctcaaggagatttagatgagatttaggaatcgagctttgagtcagttgtgctaaaggaggtacacttgactcaaaggccaatgtctccatgaagatttttcactattctttaaactccatggcactcggtataaaaaatttgagcagcaaagaaggagcactgaataaagaactgactttggccttaactgttaaggcccagagttatgt

SEQ ID NO: 93419 - DNA, 601 bp, Human
gtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctcagttcccaccaccaccctcttcagcccctcacttctttactagttaaaatctcaaggagatttagatgagatttaggaatcgagctttgagtcagttgtgctaaaggaggtacacttgactcaaaggccaatgtctcca

SEQ ID NO: 93420 - DNA, 601 bp, Human
gaaatttctcagtttaagctgggctctgaaggatggcaaagagtttgccagatgaagagttagcagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttrcctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctcagttcccaccaccaccctcttcagcccctcacttctttactagttaaaatctcaaggagat

SEQ ID NO: 93421 - DNA, 601 bp, Human
tacaatgaaagaacagtactgggtgttgacagagaaaactaggaagacagaatttagactgaaatttctcagtttaagctgggctctgaaggatggcaaagagtttgccagatgaagagttagcagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgacwaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctca

SEQ ID NO: 93422 - DNA, 601 bp, Human
tgttctgcctatcaatggttcatttatacaactacttattgtactcctactacgcaccaagtgtgtgttaagtgctggttacagtaatagtcaaaatagacaaggtcccttctctcacagtgtagacagatttagacaactaatcccataaatagctatatgattacatattatgagtacaatgaaagaacagtactgggtgttgacagagaaaactaggaagacagaatttagactgaaatttctcagtttaagctgggctctgaaggatggcaaagagtttgccagatgaagagttagmagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattc

SEQ ID NO: 93423 - DNA, 601 bp, Human
ttagacaactccctccatcacagggaagtgtgtctaaagaacattagaagatggacaagaacaaccattgggcattttattttgcaaatttttaaaaagcaattttctaagaacaaaaggactgcattgggcttagcaaatttataaagatagtactgtactgcccgcatttcttcattgtagttgagtcttcttcccacaatggcttattgtgcacattacgaagtcttcagggtcttcagaattaaagtgacagagtgtgtgtgtgtgtgtgtgtgtgtgtgtgtgtgtgtgtgtgtggtaaaatgcacatttgagaatggaatattcttccttcctctaaacataatatgcctttacagactcctccaataagtctagtcatcttgacaaaagaaaatcaccaagacaatacaatgttttcacaaagaaaaagaatgacagtttcccttctacttttcaaaaatgtttcataatatgatttgagattggctttattcagtaggcttaaagaggaatcaattcttacaaagtgacactctctataataaagaacacctacacttctgaataacgcatccattcccacacattcacaagg

SEQ ID NO: 93424 - DNA, 601 bp, Human
catcaactagaaattgagtctctgaattgactcagatggaaaaaaaaataagaaagacaagatcttaatggaattttttatggaggaagtattggaataaaagaaatgttcaacttgcctgttgacagtctaatctggttctattcattaatcattaaaatcttaaatgaagaaaagcaatatccaaaaaagaaagtttttaatagagagagaagcagtcaggagtttaagaccaggatttacagaagagactaagcaaggagaaatattctgaaacataggaaagaaatataacagttgytggatacccctttgctagtgactcagtattattttccttttcattttgttctgtatatataaaataatacaaagtaaaaatataaatactacataatatagatgctgacaaatttaattttcatcactattcatcagaagaagcaaattatatagccccctaccaaatgcttaacactattaaattatggttagttttaaaatattcatgtctatatttgcagaagtataaattacaattctcttataatcaggaagttgtaactttttgttttgaaaagaaattacataaggacataat

SEQ ID NO: 93425 - DNA, 601 bp, Human
tcaaccatctatgacagctgcttattcactcagctcccacagctctagagaaatcttgagattatatcatttgtcagactgtggtttggactagagcactgtgttccaaagtttgggcctaggattaatgctccctatggattctttgatagaaataaaaggttctgaagtcacaaacttaataaacatgttcagtcaagagccactcctggatattcacagcacacagtagcatattaaatattctgcatattcatttatgaatgaaaatagttgaaatttttgttacaaaaaaactttscaaatttagctgaccactcttttgtatgtagcatatcttttcacattcctaaactcacattaggaaatgctggggagcctggtgtggtgcctcacacctgcaatcccatcactttgggaggcccaggtaggaggatcagttgagcccaggagttccagaacagcatgggtaacatagtgagaccccagctctacacaaaatttaaaaattagctgggcatggtggcaagtgcctgtagtcccagctacctgtgaagctgaggtgggaggatcacttgaacctgggggggtcagggctaca

SEQ ID NO: 93426 - DNA, 601 bp, Human
aataacgagcatgggtttcttcagcaagagagccaggggttcccattctacctctgctacttatgatctgcatgatctatgatgagtttcttaagcatgatcagtttagtaagctgtaaaatggggtttctgtcaggtttaaaagaaaaatagatataaacttagccaagcacctgacagaaaggaagggctcaataaataaatgacaaccacaaatggcaatagaatcttgttttccatgtttcatttacatgtgcttgttgaagacaatttttaaatttacatgctttcttcaataaayaaataacacagaaaaaggaggcgaataatcagtgtaggctaaaaagaaggtgaaaatacaaatataatctatggactaaatttgagtcctgattcaaacaagacaacctttgagatattctagggaatttgaacatggattatatgttagattatattaagaaattaatgttatatttgttaaattgataatagtactgtgattatgtaaaaaaaaaaagttcattgttcgaaatattcagatctatttacatgcaaaatgacagatatctgggatttgctttaaaatacttttaaaaac

SEQ ID NO: 93427 - DNA, 601 bp, Human
acggggcctccaagcacataagcagcccaattattgttattcaatgagagtgtttaaaatgaacattcaaaaaataatttaagaaacagaaaactttctgaattttccaaaagatccatgttaatgacggctttggaaagactcaagtactgaagatcttcaaattcttggactccaatagattcaaaatctaaaatattagaacacaaatcttagtatacaactttgttattttacagatgggaaaactcaagagttactgaagttaagtgatttgtctaagaccacaccagtatttagwgtttcctaatcacaattacagtgcactaggcttaaggcaaaaagactagaacagaactaaaagaaaacatatgtatgataataaatatatactttatttttatattttgacaaatatagctcattttaaactggccatatatcacacacttctactaaagacattctagaacttaggattatttattactatcttattaaatggaaaagtgattttaacctgatttcagagcaaggactacatgcatgaatctctaaggagtctacgaacccctgtgaagttatgtgcattcatctgtat

SEQ ID NO: 93428 - DNA, 601 bp, Human
tgcttttgtccactaagcaatttcattttaacagacagacaatgataaagggtcttgagtaatgtgtgtaaacctaatttgaaagagagaaaaaacatcaaacaattatgcaggacttggagcatattttcgtcacttattaaacactggcataggtaaatagctgctattcaccatgcctctcgggaaaacctcttggctatggagtcttattaatgttaagcatctgagagccatgggctataaaataaaatcaataccataaccttaactgtaaaagtcagaaagatactggaagggytctaatttaacaagattacagatgagttttcagaggagaacatttggggaaaagccatacatttaaaaacatttatgctacaagacatctcaaggtttttgttgttactaatgctgttattatccacgctggtaatggttagagttgatttaactgatgtgttactttagtggatttacaggaaagtcctataaatgatctggaacttacttcaaataaaatcattacactgaggtagtaaactaattgcttgagaacaattatgatttgatgtgatttagtgtggtagaaaaagaatta

SEQ ID NO: 93429 - DNA, 601 bp, Human
ctgagttatttaatcttaattacacttgagcatattattgtattcctcagtaaagtaaaatcttttctaatagtttaagtctctcttgccatatattttagcccaagcacggttaagtagcatgttcctacaagtctcaattttatcacttcgctataaaaaaggtctcgaggctacacctacacccaataccaagttaaagcaaacctctttgaagctcacaaatgtcttccagagacacttaaaaaaatcctttgaataatgaagaacagtgctaaaacagtgaatatggaataaatgraaactactttttaaaaacacttcaaaatgcttttgtccactaagcaatttcattttaacagacagacaatgataaagggtcttgagtaatgtgtgtaaacctaatttgaaagagagaaaaaacatcaaacaattatgcaggacttggagcatattttcgtcacttattaaacactggcataggtaaatagctgctattcaccatgcctctcgggaaaacctcttggctatggagtcttattaatgttaagcatctgagagccatgggctataaaataaaatcaataccataaccttaact

SEQ ID NO: 93430 - DNA, 601 bp, Human
gtggcaaatgtgaacaagtccttcccacacactccaagttaacaaaaagctctgaatgttatgacaagacatatggatgtaatcccactacagtagtttgatgatgatgccagatgattcaaaaaataattagctgccatgttaagaaagtatctccttatatatatatatttacatttatcacactctaaaataacactggaaaaaatggcaagctacgttaagaggagataagatgtcatcttcaattagatttctcaaccattttttttaaatttatgaaatcagttccttttcaaaygagaaagtatggtggtctttgtgttaaataaatgaaattcttactttaattactgagttatttaatcttaattacacttgagcatattattgtattcctcagtaaagtaaaatcttttctaatagtttaagtctctcttgccatatattttagcccaagcacggttaagtagcatgttcctacaagtctcaattttatcacttcgctataaaaaaggtctcgaggctacacctacacccaataccaagttaaagcaaacctctttgaagctcacaaatgtcttccagagacacttaaaaa

SEQ ID NO: 93431 - DNA, 601 bp, Human
cagcaaagtagatatttaaaattctatggtgtagccaaagtgtggcatattatgtactcattacaaagtggaaggctggatggggtggctcatgcctgtaatcccagcactttgggaggccgaggcgggtggatcaagtcacctgaggtcaggagttcgagaccagcctggccaacatggcgaatccccatctctactaaaactacaaaaattagctggccatggtggcgtgcatctgtaataccagctactggggaggttagggcaggaagagttgcttgaaccagggaggtggaggtgkcagtgagccaagatcacgccactgctctccagcctgggtgacagggcgagactctgtctcaaaaaaaaaaaaaaaaaaaaaaggaaattgaaggatatggtaaaatgccattagattataaagacaaaaaaacttacaaaatagcatatatcatataagctcaatttactgcaaaaatacattcatagaaatagaacgcaccgaaatgcagaaaaatacatagaaaaacaggctagcatatatacaatgaaatactaacagaagttatctttatgtgatgagattacaggtgatttttat

SEQ ID NO: 93432 - DNA, 601 bp, Human
tccttactttaacaggttttacctaataaataaaggactgatgatgggtgagggtgtgtgtcctgaaggaggaagaaaggagagagagaccaagcaggctctgcctttacttgaaagctttgtacaatcctttgtacaataccctctcaatttctccattttcttcacaaatggagctatcctggctcatggggagaagacacatggtgtgttccttgatggtttaaataaaattcaaatgataaaaaagaggtgcatgggtaaagtcacagggccataaagaatgttctataaatttctrtcagaggacatgctttgaaattgcttatagagccatgtgctacattgaaattattacggcttataacaatggagttaagccactcaggcactgctctagggaatgtaaattgataagatctatgccaatatttaccaaaagccttagaaatggacataagatttaacttagtaattctacagtaggaatgtatttattcccgtagcaaaatttcactgaacttctacttggtgacttcatgccaggcagtatgctagggacttgggacagtgaaaagaactagacaagaatcacccaatc

SEQ ID NO: 93433 - DNA, 601 bp, Human
acaatttctctgcctctgtttttgccctgggataaacagtgttgaagagaggaaagtgtccaggttatttataagtgtatgagtgttatgtagaataagacaactattaaggccagattggggcagcatctagcctgccagatacttaagatcccagtccaaagctttgaggtatttatttctaaggatctccatgtagagaatgacagcaatccttactttaacaggttttacctaataaataaaggactgatgatgggtgagggtgtgtgtcctgaaggaggaagaaaggagagagagaccaagcaggctctgcctttacttgaaagctttgtacaatcctttgtacaataccctctcaatttctccattttcttcacaaatggagctatcctggctcatggggagaagacacatggtgtgttccttgatggtttaaataaaattcaaatgataaaaaagaggtgcatgggtaaagtcacagggccataaagaatgttctataaatttctgtcagaggacatgctttgaaattgcttatagagccatgtgctacattgaaattattacggcttataacaatggagttaagccactcagg

SEQ ID NO: 93434 - DNA, 601 bp, Human
tgcccaggctgcagtggcacaatcatggctcactgcagcctcaaactcctgggttcaagcgatcctcccatctcagcctcccaagtagctaggactatgggcacacgatcacacccagctaatttgtaaatttttagtagggacaaagtctggctatattgcccaggctggtctggaactcctagtctcacgagatctcctgccttggcctttgaaagtgttgagattataggcttgattcattgcatacggtcttcttttttcctttcttcctttttttcttcatcttctttttttgttrttttttggcagaagaaaactcaaagtgtaatgaaaacagttgcaaaacttctgttaactttgaccctctggtatgatactgaccagaggagtttgatacagaccagagaaggaaagaacatacataagcacacttagcttagagacagtccaatggctgggatttgacaagattatattatattgacaagttttatcaagttgatacaccctcataattttcaaagttcttcattttttggacttttgaaagtattagactttcatagatttttttaaaaagagttttctagataaacaa

SEQ ID NO: 93435 - DNA, 601 bp, Human
taggagcaggagaaatatgtttttaactctgtgccatccctgatctatgacattcccttgaactagaaaatgaggcatttccactctccttattccacgcatagaacaatgttttatccactgaacaaacttgttttctccttaagtaatctctcttggaaatccctgagatctagatttcattaatgatcttttgtttgtatcttatattgcttgatgaatttttcattgttatttacttgtatccactgcgtatgctttttttaaaaaggtgactaatggcttacctcctaaggaacaygcttttaccaaaaacacaaaaagatgtagaggctggaagaatatgctacttgggaagagaatgaaaaaaaaaagtagaaatgaaagaaagaagaggtaaagcaggcaccgtgtctaggcagcttattttagaatctctggcatgtgaaagaaactgtattatgaagtgatgactagtagtgcaggatgagaaaaataaccatagccagtatatcttaaaattcatgttccatgaataaatatcaccagatgagaagtagctgactgtaaagcaaagagaaaagaaaatcaatcactgaga

SEQ ID NO: 93436 - DNA, 601 bp, Human
ctggtagttgaagagaaacaagtagaggccagtgatggcttaaaatcagacagaacaatttaaatttgatttagaaagtaataatttataaatgaattgattttagaagaaaaaactttccaaaaatttgactttttttttctgttctcaccgcccttttcacttgtacctggctgaaccaaaaattttcttcctagtctcctccaggccttcctctccatggcactttataaaaaccagcagctggcatcgtatccttcaaacagtatctttctcattgcaagatctaccacagtatcayatttttaaatagctctttttctttgttattccattttgtttaaacttcagtgaagctaattttcttatggcttccattaggagcaggagaaatatgtttttaactctgtgccatccctgatctatgacattcccttgaactagaaaatgaggcatttccactctccttattccacgcatagaacaatgttttatccactgaacaaacttgttttctccttaagtaatctctcttggaaatccctgagatctagatttcattaatgatcttttgtttgtatcttatattgcttgatgaatt

SEQ ID NO: 93437 - DNA, 601 bp, Human
tgtcatttctggagaagaggatcaattaaggcaactgcaactactgtaactatatcagacttttcattaaactcaggcaaattcatgggtctccttttgtaaagggcacataaatcaagggtgtttatatagaagttgaagatgattatgtaatttttaatgtaaattatataaattttaagaagcaaagcatttgtattttcttagccaaaatgacacacttgcttttactgagtaattattatgggtccatttattttttcaattcttttttgggcatgcacctaataataacggtacsttcatagaggattatacagaccaacacagaagaaacagaatacaatttgctgttcaagttgcaaaaggaaccacaaactctttccttaaacaacaaaagtaacttataatagtaaacataagaatgggaaggttcactgaccaaactgaaaggatttgctttagagacaggtgaagaacggtagtatcagaatataggtttaattgcctttgttttctcattaaatgaaattaattcttggcccattaataaaaatacactgctacacagcatgcagaaggcactatgctaagaacttag

SEQ ID NO: 93438 - DNA, 601 bp, Human
taactgggtaaatcagtttctaaaaattccatagaataaataataaagcataattatacctcattttaaaataatttaggccgggtgcagtggctcacgcctgtaatcccaacactttgggaggctgaggcgggtggatcgcctgaggtgaggagttcgagaccagcctggccaacatggtgaaaccccgtctgtactaaaaatacaaaaattagctgggcgtggtggtgggcacctataatcctagctacttgggaggctgaggcaggagaatcgcttgaaccttggaggcaggggttgyagtgagccaagatagtgtcattgcactccagccgcgacaagaacaaaactctgtctcaaaaaaaaaaaaaaaaaaattaatgtgaccacagcttgagaaacagaacagtgtcgttctgggtatgtcatttctggagaagaggatcaattaaggcaactgcaactactgtaactatatcagacttttcattaaactcaggcaaattcatgggtctccttttgtaaagggcacataaatcaagggtgtttatatagaagttgaagatgattatgtaatttttaatgtaaattatataaattt

SEQ ID NO: 93439 - DNA, 601 bp, Human
gactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatgtcgcataagagctatgtgatttcaaaaggtaatactacaaatataggcctctaactaatggatgtaaaatcatagacatacwgattattaagaggtggaaagaacctctattctgtctttcttgttatagatgatgcaatcacttgccattccaaatttttaatttaaaattaactgtttgaaaaagaaactgggaactttttattgatactcttctgctttacctatgtttaaatataaatttcaagtaaaatgtaactgggtaaatcagtttctaaaaattccatagaataaataataaagcataattatacctcattttaaaataatttaggccgggtgcagtggctcacgcctgtaatcccaacactttgggaggctg

SEQ ID NO: 93440 - DNA, 601 bp, Human
tgaatatgctactgtaaaggcagtagacatcacagtctacaaaaaatgccaggcggatttgtagctgtaagctacaatttgtgactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatktcgcataagagctatgtgatttcaaaaggtaatactacaaatataggcctctaactaatggatgtaaaatcatagacatacagattattaagaggtggaaagaacctctattctgtctttcttgttatagatgatgcaatcacttgccattccaaatttttaatttaaaattaactgtttgaaaaagaaactgggaactttttattgatactcttctgctttacctatgtttaaatataaatttcaagtaaaatgtaactgggtaaatcagtttctaaaaattccatagaataaataata

SEQ ID NO: 93441 - DNA, 601 bp, Human
aaaagaccttatggtgctattaatatgagaaactaattatcattacattttaccatttgaaaaattacctaagctctggtaaaggcattcataaaattaaatatgcattttcagcatggtggcatttaaaggatgaatatgctactgtaaaggcagtagacatcacagtctacaaaaaatgccaggcggatttgtagctgtaagctacaatttgtgactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatgtcgcataagagctatgtgatttcaaaaggtaatactacaaatataggcctctaactaatggatgtaaaatcatagacatacagattattaagaggtggaaagaacctctattctgtctttcttgttatagatgatgcaatcacttgccattccaaatttttaattta

SEQ ID NO: 93442 - DNA, 601 bp, Human
acaggacagatatcgtctcagtctccccaggatgaggaaggcatttctcattggtgccattttcaaaatgtgaatgaggatgacattctcagagaggaaatactcagaaaaaaagatggcacagaatacacaagtaaacagtgtgtggagtggtgaaagatgaagaagaggagcaagcctcttgcaggtcccacaggatgacgggtctccagcttcctgtacaaacgtctgaatgcttaccctcataggagaaacgccatagatgggcaaaacatgatcacaatgacagtttaaaacaatycccccagaaactaaatggagggcggactggccaaaacagagacagaaatcatgaagaccacttcagaagacagattcatcaatacattcattccataaatacttgttcaagaccgaatgtatgccacatgctgcactagcctgggacacactggtgaactggactcactttcggctcctttaaagcttaaaatctagtgaggcgatgtggacaagtaagaaggaattgcaaaggtgctgtgataggaaaagaattcagagatttcgggcttcattcactcattcatttcataaatattta

SEQ ID NO: 93443 - DNA, 601 bp, Human; identical to SEQ ID NO: 32892

SEQ ID NO: 93444 - DNA, 601 bp, Human; identical to SEQ ID NO: 32893

SEQ ID NO: 93445 - DNA, 601 bp, Human; identical to SEQ ID NO: 32894

SEQ ID NO: 93446 - DNA, 601 bp, Human
gaaaattctccaaaatattaaaaggtataataagtggacaggagtcttagaggtaaagcagcaaagctaaatatcagatcctaatatcaaaattacattacatgttttagatattacaattattgatagccccaggtctggcacaaagactgtctacttgattgtggaaaatgctcatataccaaattcctatgaagtaacctcttggtagaagaaaccatatgtctaggggagtgagaaatgctcatgagtcactacacttacaaaatgaatccccaaaaccactgcacaatgtttccaraaaaaagaaagacgcttctagtaatgtcactcattattaaatgtaagtcatgtctctgcaaagaatattcaagtagtcatcaaacactgagaatgtttacattaccaaagcttattttaatacctaatagttggtctataaatacaactgtaagttcttttgtgtgtgtttattttagcacataccttactcctgcctgaaataagcacattgtctctgtgtcaaaccaggtatttaagaggtgtgaactccagcccagagctttcctgtcaatgtactttctgcataaactttcccttc

SEQ ID NO: 93447 - DNA, 601 bp, Human
aagggtcctggatgcgttgttattctaaattaaaagttcagaaaggaccattttgtttcattttaacaaattaagaccaaagggatttttttctcacctttctttgctaatttaaattgatagacacacactatttactagcatttcaggaatgttccaccgtagtaatgacggaatgtttgtgaaaattctccaaaatattaaaaggtataataagtggacaggagtcttagaggtaaagcagcaaagctaaatatcagatcctaatatcaaaattacattacatgttttagatattacmattattgatagccccaggtctggcacaaagactgtctacttgattgtggaaaatgctcatataccaaattcctatgaagtaacctcttggtagaagaaaccatatgtctaggggagtgagaaatgctcatgagtcactacacttacaaaatgaatccccaaaaccactgcacaatgtttccaaaaaaaagaaagacgcttctagtaatgtcactcattattaaatgtaagtcatgtctctgcaaagaatattcaagtagtcatcaaacactgagaatgtttacattaccaaagcttattt

SEQ ID NO: 93448 - DNA, 601 bp, Human
actggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagycaatgcagacaactttcctaaaactcagggtgagaagaattgagggctattttctcctcagttttctactggttcaaacagatgaagctacactaaaaatttctatcttttaaggctgttaatagatgaactttcatactgtagatagaaaagagagatgtcttgtctgaaggtgaagctaacagcattaggaaaggattattctactttatacacggttcctattatacaaaatcctgagagtttttttgttgctagtttttctttttcttttttttttttttttgagatgagagtaat

SEQ ID NO: 93449 - DNA, 601 bp, Human
aatggtaaataccaagaattctaatttgaaatgcaaattaattggttttgagttggagttaaaaatcaaagcagatacactgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtytgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagccaatgcagacaactttcctaaaactcagggtgagaagaattgagggctattttctcctcagttttctactggttcaaacagatgaagctacactaaaaatttctatctttt

SEQ ID NO: 93450 - DNA, 601 bp, Human
attgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacactgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacagstctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagccaatgcagacaactttcctaaaactcagggtgagaagaatt

SEQ ID NO: 93451 - DNA, 601 bp, Human
ctgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacactgttccttaaaaaaaaaatctgcagttaactataragacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactgg

SEQ ID NO: 93452 - DNA, 601 bp, Human
taattttattcaaaatattccattgaatagcatgactgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacastgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattat

SEQ ID NO: 93453 - DNA, 601 bp, Human
ttatttttgattatacccatgttggaattctccactgcacggtgttcatcgcaatttgctgggaggctattctcggcaagtatatagtctttataatctgaactgttaaaggcaaaaaaaaaatgaagcagaatatttttctaaatatctgcacataaattacaagtagacatttatttagagaaaaagatgaacagctaataacacttaaatattgtgacttagagacatgaactaagtcttcggttaggctcctcagaggccacattatttattctataaagaaaatggacttcctgartatcctgattattcatcatgggtaattttaagtatttaacttgatgtcaggaaaattgaccagagttttccaatatggaaacctatgggagagttacatctttaaactaattttattcaaaatattccattgaatagcatgactgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaat

SEQ ID NO: 93454 - DNA, 601 bp, Human
gtgctgagatgcacacattaggcaatttagattccgagatctatggtcaacttttgatgatttactaatacaagaagatagaataagatgtaaagcatctaaaatttcagaggtcatacaatgatataaaatgctgagctacgtttgtccttacacctacaaataaaagatttccaaagtaaattaaactgtactgaggggaagcagaggacaagcaaatgagcattgttatttgagttactcttacatccatggtggtgcatggagagttacacaaaacatttcttgttgacatttgtgrgaattaactgagaaaatcccctgggcaatgatagaaaagatgttactatctgagttttagctcctgggtacaaaaatagtttccgtggtaggaaacaaaatcctaaggatacactctttgaagaaatagtggaatatatttttctagactgagaatgttatttttgattatacccatgttggaattctccactgcacggtgttcatcgcaatttgctgggaggctattctcggcaagtatatagtctttataatctgaactgttaaaggcaaaaaaaaaatgaagcagaatatttttcta

SEQ ID NO: 93455 - DNA, 601 bp, Human
tgctgtaggtgaagctgcctcaccttcagtggatgtagtgatgggtttagtatctgtcatgctcagggtcacaggtcgcactgcactgggatggggagagggtgccaagacaggagtgaaatggccaggcactttccctactacttgaccactgccgttaggctacaaaacaaaaacagaatgccgggtgaagcaatccaaaaggcagtcatcttgttcaacaagtccactcagcacacacgactgtgtggatccagcacactgcgcataggcgccacacaggccctctcgagtcggagtyggagaggccagtcaatggttggtagtaataaggagcagcagcatttcaaagaaggttttcatcttcaaagcacgtcatggtataggtgaattcctctttacagcacccctgagagccaggtagacttgatcctttcatgtagtaggccaagaaactcaagtgcagacttaaatgcttagcccaaaggctaaaatggaattccttactgaactagctacagttggaacccaatgcttccttattctctgctcttcattttctataatgagtcagttttggcttttagaacacaattttcac

SEQ ID NO: 93456 - DNA, 601 bp, Human
tctgtgcattcagggaagtattctaagcattaagaattactgatgggtattacaagcctataggaacttattaattgacggggctcatgaattttgagaaagaaatgctgaattcactgtacaaagtattgtccatttttcttatagggttccttcctagtctttcagaaaccataaaaaaaaaagagcatctttccaatggctgagaaagaatgagtggtgcatgcctctgattgtctctgattcacatggaaatttcaagatcatggggattttcttgctctaagaaagaaaaaaaaaaggtttgaattgaagatatctgtataattggtgaggtgcatgctaattccaccaattcgatagctttatccattctacttcaccaatttgtacattccagctccagtactaagaagctgacagttgggtgaaaccacctcaaaattaatttcttctatacttctaagtattttacatgaaaaaacaaaggaatgatgcggcttattggtacgtgttaggaaggttcactggctaaatctctgacatttaaatgttatggccacactaaaaagcacagtatttgatgtaccaatgataagca

SEQ ID NO: 93457 - DNA, 601 bp, Human
cccagaactaggcaatcccactgctccatattaccatatattacctttattgttctgaagaaagctacactgtttggtttaaaaccaccagattaatgaggaatccaggcttcattttaaatgaactggctttctaaaaccaatatattaattctgccttgttcacttaaaggactgcagaatttgatccatggaagcttttttaggtcaactttttaaaaacagtgaagatgctcacaattcatattttaattgctcctgaataaggggacatgcaaggcagccatcagcaaccagtgamccctactcaatctccaagcctctggaattcaccacacctcacagacagccggagatgagcctcacccttacagaagagcaccaaatctatgctgctttttcttttcaactatgagaaagagccttccttggcttctgtgttttctttgaccatagtactatatcaattcaatgaccagttttttattactggtggtgcctaagaagctggagctacaagcttgtttataggaaagaaaaactactcactatgtttcttttatgtaggagtggaaaatggactgatgcagccatctttata

SEQ ID NO: 93458 - DNA, 601 bp, Human
ctatcatgaaggagaagcctgtatcatgtagaatgaatcagctcggtattttacctgtgaaaatggcctcaagtctgataggaatgtttttgaaaaaaagtacttcccataagcacacatacaaaaatcaattacttgtaactgatccaggaagaaagctgatgcacctttaaatagttggccactaggtagtaagtatatatggtgactattccttacattgttatagtctcatttgcaagtactttttgtacaactgctttttgctttttggtatagagtaaatttttcacacacacamaaaaaaaatgaatagggagctactcctaaagacttttgttacttttcacaaggaaaggactgaggtatcttcccagaactaggcaatcccactgctccatattaccatatattacctttattgttctgaagaaagctacactgtttggtttaaaaccaccagattaatgaggaatccaggcttcattttaaatgaactggctttctaaaaccaatatattaattctgccttgttcacttaaaggactgcagaatttgatccatggaagcttttttaggtcaactttttaaaaacagtgaa

SEQ ID NO: 93459 - DNA, 601 bp, Human
ttcctttaaatgtgtttcctttcaagccagcatacatgaaaagtgacctcttatccacttacatacctacccagaagtcatgtgatagcgttttacgtcaagctgtcaattatgataacagacacaataagaacagcccaagtgttgatagcctgcttcctgactgtattgaaaagtttgttcatagtccacttgtgtccttttaattgcttgcctctaataaatgactacctttccaatggtagtaccaagctttggctttgccatttgccaggacaaatattataagaagatttaaacyaatatcttagtttaaaaaaatcctacagaagtaatttcttaaaaaggccattttgtgtaacagaaattttcagtgtaatgagaagtactttcaaattctagttttaaaaacaaaagtgttataagaaaagtgttgaaacaatttaaatatacactagaccagtaattgaaattcaaataatagcattatatagtcatgcaagagatgtaacatgctgaagcccaagcaccaataaaatccatgcaactgtgagaagtaatgcaaagacctgaattgatcaggccactgattcattagctc

SEQ ID NO: 93460 - DNA, 601 bp, Human
gttttcttgtgtttcttcatttctccagaccctcaatgaaacagatttttaaggggtgaaggttctttttgcggtggaaaacagatgcttaaaaggattaacactccaatattcatactttggattaggagaattttattttattgctaatattaattacctacatggagcaaattaaatggtctctggatgaatagcatgtaacctctgaaggaatggtatgaacaagaaaaatggtcagaataaaattgtgttgtatgtttcacatacaacacatgcaaaaaaaaacaaacaaacaaamaaaaaagatactcaagatcatcctcatatcttaaaagtcacttctagtgccaatttctgaaacccatgtttcttgatatttaatttaattagcagaagtagaattaacttaaatgagtatgcatagtccatgagcagaataaacattattaaccataaatcataagataagtattagaaaatgaaagattttgtttttaaattagaggctactacaacttgtaaattttaaggtttcaagggactttggagcttatgtagttcaacctcttcattttcctttccaaggtttaaggacttg

SEQ ID NO: 93461 - DNA, 601 bp, Human
cacagcaattagctttgggaacaaaagaaagaaggtaagcaaaatgttctattttgctagactcagcaaacaggctgaggtactaacagttcctacgatgacaacaaatctcaactgaaccaataaaccattaaactgtgaacagaacaatcaacacaggcaaatttaccttctcacttttttttctttttacgtttacaatggccctcaggagaacatcttgaaaggtatgttttatgttttcttgtgtttcttcatttctccagaccctcaatgaaacagatttttaaggggtgaaggytctttttgcggtggaaaacagatgcttaaaaggattaacactccaatattcatactttggattaggagaattttattttattgctaatattaattacctacatggagcaaattaaatggtctctggatgaatagcatgtaacctctgaaggaatggtatgaacaagaaaaatggtcagaataaaattgtgttgtatgtttcacatacaacacatgcaaaaaaaaacaaacaaacaaaaaaaaaagatactcaagatcatcctcatatcttaaaagtcacttctagtgccaatttctgaaa

SEQ ID NO: 93462 - DNA, 601 bp, Human
taagaaagtaaacttatctgggttggggggggggaaacacagtagaaaatcatcgtttttaaccttcagatggccacactgtaaattaacagcatcttacattgaaaagatgacttcttcacagtaatccactaaaccttgtttgctgcttttcagtgagaatttccagatgatgactggaaccaaagtaccataaattatcataaacttaaaatttatgataaactattttaaacatttctgataatgttgtggccaaagaaataggctattaagaatctttactttcccttttagactmtcgagcttctgcacacactaagtaatagtgattcaggagttttagaaagatagtttttgctcatttttctatcgatctatgaggctctaaaaatactagctaaaatttccaaaccacgtgttttagttatttgcatatttcaggatttcaagtaaaagtgattttatgatttaaagaactgaaaaaaattccctgcatatacatagatagatcaacagattgatagacatgtagattctgctcaggatatatgtcataaagaagtcataaatcagtaaataaattagaaagaaaaataaa

SEQ ID NO: 93463 - DNA, 601 bp, Human
aaaaaaaaagcaaaaaaaaatcttattcttgaaaagcaaaattcctagactcttttttagaaaaagctattgcaatatgcttctctattaattaaagcatacaagagaaacaagtgcttagaacataacaattagccattattagagtacaaattgagctggaatgaaagcaaacgttaatgttcaatagagagatatattttagaaagaaaataaaaatgctttttttctatgcatcacaccaaataatctgcactgaataaaataatcaataactttaagcatgcagtttgcaaaacayagaagacatgcagtttagaggagaaaaggcccaccttacaaacattcgccctaacttgtgtttagaagcatcaaggtcttcagttttaaccttttactaattttgttttgcttaaactggcattgtttagaaagagttgataagcatttctagttttattttaaactcagagtaatggcatttaaaatactttactacatctgaagaaagtgaggaatgcactgaatacaagctgaaacaaattcttcccagatctccgaatcatcagctctgcccttcagagattgttcgagtaaccct

SEQ ID NO: 93464 - DNA, 601 bp, Human
aagagaagaaacaaaccaagatactggctgggcatggtggctcatgcctgtaatctcagtactttgggaggccaaggcgagcagatcacttaagtcaggagttccagaccagcctggccaacatggtgaaatccagtgtgtgctaaaaatacaaaagttagccgggcgtggcagtgcacgcctgtaatcccagctactctggtagctgaggcgttaagaatcacttgaacctgggaagcggaggttgcagtgagacaagatcgtgccactgcactccagcctgggtgaggaagtgagactrtctaaaaaataaaaaacaaaaaaacaaaaaaaaccaagataccttttaaagagcttttaggatcattaagaccattctacatgccattacctactaatcaaaagaaaagttacaatttttgagagggaagaaacattttacctaaataaattctgtatttttttctgacttactatgacctgaaactgattaccacatcaatttttcaccaggaaggggatttgtgacagcaacaatactgccctaagaactgagtttaatcatcagattcatttcctccaatacatgtgttctgagatt

SEQ ID NO: 93465 - DNA, 601 bp, Human
ttttctacaacagtctccagggattgccttttgttaaaaggcatctaccacaacaaaaataacctgtgatattttatttattccatcgtgacaaaggcaaattatttaattctttggatgaacagacctatatttcttaaatattttcaacttattcagatgattctaaagccatagccatgccctgaagattttagatgtctattatctgccttaaaagtgctagtgttacagacatttatgacttttttcaaaattctttcaatgttttaaaaataaccacaagtcataaactaaaaawgatggataaagctatcatgccaccgacaagggctatttgtattatcaaatatgaactctgttgtgtccatttttgaaaactacaacaaagcaaagcaacctatgtcatttgaatttatttattctgaactgcatcacacctagattttaagaactgtcagcattggattcaccacagcatttagcacagctcaccataaagattcaataatatctgttcaatgtagaaatgtgatggctgccattatcaattatgtgctttctgaatcaggatagaaagagaagaaacaaaccaagatac

SEQ ID NO: 93466 - DNA, 601 bp, Human
gtccttttctacaacagtctccagggattgccttttgttaaaaggcatctaccacaacaaaaataacctgtgatattttatttattccatcgtgacaaaggcaaattatttaattctttggatgaacagacctatatttcttaaatattttcaacttattcagatgattctaaagccatagccatgccctgaagattttagatgtctattatctgccttaaaagtgctagtgttacagacatttatgacttttttcaaaattctttcaatgttttaaaaataaccacaagtcataaactawaaaagatggataaagctatcatgccaccgacaagggctatttgtattatcaaatatgaactctgttgtgtccatttttgaaaactacaacaaagcaaagcaacctatgtcatttgaatttatttattctgaactgcatcacacctagattttaagaactgtcagcattggattcaccacagcatttagcacagctcaccataaagattcaataatatctgttcaatgtagaaatgtgatggctgccattatcaattatgtgctttctgaatcaggatagaaagagaagaaacaaaccaag

SEQ ID NO: 93467 - DNA, 601 bp, Human
actcacatatgcaacaaggtaatttgtccacatgagacaaagcacaaacacaacagtacctaccttaagcagttcatcacctatcatcctcctaagatcttgagcccattctgactatactagaagtgagcccttcacccaaccaatattttactctgggttaactgcagttcctgacctttcacttaggcagaaaaattgactctctcaaggtgcaagcaactcctttgcacatgtgtgtgcacacacacacagttcacaaaacagttcacaaaattttaaggtcaaaacaacaaaacaycttcagggttgtaacctaataaggctgtgaaaactttcccaaagagtcagctttggttcctaagggaatgcttaagccttggggttgcgggtggatggaggaaatcttccagctttgattatacttgcacagctcccttggcactgccattttcagttccgacaagagctgcatttgacatggaaacacctcaacagggcaattagtataaagcagaaaagagggtgaccatggaaaagtgattgtacaaagaaagtaatgacaacaaacaacaatcaatcaaaataaagcaaaaccaaa

SEQ ID NO: 93468 - DNA, 601 bp, Human
catccgcagaaacacaaaaatcctcccaattattttagtaaaatcttcatttattcattatttcagaggctgagcaaatggtttgtgtaaacatatcctttggtaacacgcgcatgtttattttagccatctgaagacttcttctatgtttacataagccatcagacacatacaaccactcacttgtggctttgcgttttcttgaaaggggtgaagggagagaagagagaatgaaacaataaattcagtttctcttttgcataaagcactccctctaatgttttaaaatagcttatgtttrtattattcttggattgtccttcagctttctttttcattcaattatattgatctttcatatctgacagtacaggctatattctgactatcactttaagaaagccagccagtcagggagtaactgctgtatatgtttatgtccacataactcacatatgcaacaaggtaatttgtccacatgagacaaagcacaaacacaacagtacctaccttaagcagttcatcacctatcatcctcctaagatcttgagcccattctgactatactagaagtgagcccttcacccaaccaatattttac

SEQ ID NO: 93469 - DNA, 601 bp, Human
cccttatcatacgtatgccacatatatgtggagatatacacacgcactacatacacacacacatatagatgcatacacacacaaacacatatatgtaatacaaacatatggtttgcaacccattattgaaagttattttttgtttaaatattcattcttttgagagcatacattttacaaagaaaatgttatgaacaaagcaaggaaaatggctgaggtgagtgttatgcaaattaagttacatggataaaatgagagctattacccccccacactttttttttctttctttcttttttcyttttttttttttttttttttttttgccctccctctcctgaccaaccagatccaaataacctttactggctgctaaatttctcttgagaaatcaagcaactctctagaattgcagtaataaacgacaatttcttagaaaaacatgtgtaaagtaactacagaatgaagtattcaacccacagaaaggaactgctaacacatgtaacacggaaaatagctgataaaagtctctttggtgccattcaattatggcatccgcagaaacacaaaaatcctcccaattattttagtaaaatcttca

SEQ ID NO: 93470 - DNA, 601 bp, Human
aagcacaaagagttgtacatattaatacatacctcaactgtaacagtagccacattatttacagatggcaataaaaatgagcaatggcccagaaagcatggggaataaataaaataagtattttaatttaaaagaagcatttgcctttagttcctttgcaacatttcctgatctccccaagatggaaaggtttttacttccttggctaaacactctaattttattggcaaaatattaacacacaagtattagcatttcttgtaaaatgcacaataaacagttctccttattaattgctgawaacctgttgggaaaactgtgctgccctgggttgtacatgggtgcattcggactggttgcttacttcaatataacacaaaggctgcagattacgtcttgtgaaaaaaatgctcgctcagaccagtagaaggaacaaacacttaagttgaatctatttatgtattagaacaaagaaaatagtacttgataaatataccagttgctagcacttatataatgtgtattatttgccaggtactgttctacatgcttgacctaccttaaaacttttaatcctcataacaaatctatgagaaagacc

SEQ ID NO: 93471 - DNA, 601 bp, Human
gctaaatcaaaattccaaaaataaaatgtttgatatcatggatactattttcttgctattttgaccaaatgtatgacatggctccccccaaaagggaagaagcaaatgaattatttagagcttaagatgcattactggtgatggtcctgcttcattttgttattggtaagactacctctgaagtactgtatttcttctaggtagcactgtggaagaaaacctaactttatggcatttacttattgaaaaactcaccaaattatgtcattgcagaacagctaagggtagacagggaagatawagcagttgatgtggaaaggaatgtagaccgcttaagcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagccctcagttatgactcagatctgtctgatttccctggccatttcactat

SEQ ID NO: 93472 - DNA, 601 bp, Human
taaaatgaatacataagagctaaatcaaaattccaaaaataaaatgtttgatatcatggatactattttcttgctattttgaccaaatgtatgacatggctccccccaaaagggaagaagcaaatgaattatttagagcttaagatgcattactggtgatggtcctgcttcattttgttattggtaagactacctctgaagtactgtatttcttctaggtagcactgtggaagaaaacctaactttatggcatttacttattgaaaaactcaccaaattatgtcattgcagaacagctaarggtagacagggaagatatagcagttgatgtggaaaggaatgtagaccgcttaagcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagccctcagttatgactcagatctgtctgattt

SEQ ID NO: 93473 - DNA, 601 bp, Human
agtaaagaccgaacaaataagaatcatagaaccaaaatggaacacagctttttttgttctctacagaatacccatcgtgaggaaaaacatttacaggaggccacaaaggtctctgcttgcactgattagttctatagctctccagcagttttcttattctaaccctctttaacttacttttagagagagccacagcttttccttccaattcatggttccctacattggcttgcaacagaagcctgagcatttcctgctcctccccatcagtaatgataccacatttgagctgctctgcacktgaggagtttggagtgatagatggcgggttgggggttgggggtgttggaggcagtaaatgataagattccagccttactctcatcagttcaactttcgcctatgctgaattacaggctgttaaaaaaaaaaaaaaaagactggaaaacaattctctaattgctactagcataatctccctttaaaaagtatcatatggaggataaaaaaaatcagatctacatatcatgaaacaactctacagcacacattttgggtacacttaatctaatgtattgcctgttccaacactcaaatccga

SEQ ID NO: 93474 - DNA, 601 bp, Human
tttaattcacaagcaattcagtggtcagatgggtttcaatttcttacctgcctattgggttgaatacaattgaaaagtacggtgaaagatatttcttttctccttacaacaggaaaaaaaactacatgtttaaggtaggcccatgcataacatacaatttgaaatgcccaattatcaaacataccttaatcagagttttttagtaaagaccgaacaaataagaatcatagaaccaaaatggaacacagctttttttgttctctacagaatacccatcgtgaggaaaaacatttacaggagrccacaaaggtctctgcttgcactgattagttctatagctctccagcagttttcttattctaaccctctttaacttacttttagagagagccacagcttttccttccaattcatggttccctacattggcttgcaacagaagcctgagcatttcctgctcctccccatcagtaatgataccacatttgagctgctctgcacgtgaggagtttggagtgatagatggcgggttgggggttgggggtgttggaggcagtaaatgataagattccagccttactctcatcagttcaactttcgc

SEQ ID NO: 93475 - DNA, 601 bp, Human; identical to SEQ ID NO: 32895

SEQ ID NO: 93476 - DNA, 601 bp, Human; identical to SEQ ID NO: 32896

SEQ ID NO: 93477 - DNA, 601 bp, Human; identical to SEQ ID NO: 31597

SEQ ID NO: 93478 - DNA, 601 bp, Human; identical to SEQ ID NO: 24242

SEQ ID NO: 93479 - DNA, 601 bp, Human; identical to SEQ ID NO: 24241

SEQ ID NO: 93480 - DNA, 601 bp, Human; identical to SEQ ID NO: 24240

SEQ ID NO: 93481 - DNA, 601 bp, Human; identical to SEQ ID NO: 24239

SEQ ID NO: 93482 - DNA, 601 bp, Human; identical to SEQ ID NO: 24238

SEQ ID NO: 93483 - DNA, 601 bp, Human; identical to SEQ ID NO: 24237

SEQ ID NO: 93484 - DNA, 601 bp, Human; identical to SEQ ID NO: 24236

SEQ ID NO: 93485 - DNA, 601 bp, Human; identical to SEQ ID NO: 24235

SEQ ID NO: 93486 - DNA, 601 bp, Human; identical to SEQ ID NO: 24234

SEQ ID NO: 93487 - DNA, 601 bp, Human
gttgtaatgtctaaatttagaggaaaaaaacccacaaatcaataatctacattcatgccacaacacagtaaacggagaagggcaaactaagcctgaagccagcagaagaaagaaaataatacagactaaagtacaaattcatgaactagagaattaaaaaaaccctgaaaaattaatatcatttctatgaagtgtccagaataggcaaatctatagatgcagaaagttgactagtggttatatacgacaacaggatttctggcagggggttgatagctaaacatgtatgaggtttctagartgacagaagtgttttaaagtttacaatggtgatggtcgtacatatcttcaaatgtactacaaaccattaaactgtacattttaagtggatgaattacatggtgatttacatctcaataaagcagttatttttaagagagagggagagaaaaggaaatagtagtccacatacttattgagagaacgaatggatctaatggattaaatcttaaaagcttcttggtgttttccacaaaggggtcttgtggattgttgagagagtcgatgctcactccaaatgatgtgctagtgatcacatcca

SEQ ID NO: 93488 - DNA, 601 bp, Human
ttgccactcatagtaacaatgacttcagtaaaaatcgtacatgggttgtaaaactggtaggtgaaagactgaagacaaaggatatttacacagtctcagaggttttccaaaaagttacttatccattgcaaaggaaaaaataacttcatagttgattaacctggtgaacacactttcaccaaaaattgccagttaaaatcgcccttatttggatagcatggctcctgattaggtgttagatgcattaagttgctgcaaaagtaattgcggtttttgccattgaaagcaatcacaaaaattrcaattatttttgcagaaacctaataaatttccaggaagaaactttaattctgtggatctggaggaggctgagaactggcatttgatcttatgtaggtgatccacagactgctgactcttcctggcatgccagttttccttagggttgccctttaagcttagaacatggctatctatgcctgcatgcctctagaagttgcctccagctaccattttaacatccaaacctgtgtcattctgctatgtggcagaaattctcatctacctggaatacttcctgcacattttcagaacaaaacct

SEQ ID NO: 93489 - DNA, 601 bp, Human
accaatcgactgcatatcactccttaaacatttaccaaatgaccaaatgcttgagttagatgaggtcacttgcaaggcaccactgggatattttaaatggaataaaatgagaggatattgttaatggaggggggaagacattcttagataaagagaaaatatagagaacaaaactcaatgatttaatggcaaattatgaaattataagataatagcctccagtaactaataacagagcagaggagtaaatgagccctggactaggtcaagaagacaccttggaggggcttgggaattgaaytaggacttgaaagataagaacagaatgaggagaagaaaggaaagaagattagcagagttataattgagttgaaaaggagcccagttggttggagctaggcacctggaaggtgaggtcagtaaggatggccttggactgtggtagtccttcgtatccaatagaactaccttaaattagtcattttccaccttggcttcacatgagaagcaatgggggagcttttaaagccacactctgggcaaattagtttagaatttctgagatgttccaggcatcatgaatttttaaagctccctggtg

SEQ ID NO: 93490 - DNA, 601 bp, Human
catgcatgtgcacatgtgcaagcacacacacatgcaaatacatgaatgtcatttgctaaatgttcacattaaaaaacttaatatttgtatgcaaaccaatcgactgcatatcactccttaaacatttaccaaatgaccaaatgcttgagttagatgaggtcacttgcaaggcaccactgggatattttaaatggaataaaatgagaggatattgttaatggaggggggaagacattcttagataaagagaaaatatagagaacaaaactcaatgatttaatggcaaattatgaaattatawgataatagcctccagtaactaataacagagcagaggagtaaatgagccctggactaggtcaagaagacaccttggaggggcttgggaattgaattaggacttgaaagataagaacagaatgaggagaagaaaggaaagaagattagcagagttataattgagttgaaaaggagcccagttggttggagctaggcacctggaaggtgaggtcagtaaggatggccttggactgtggtagtccttcgtatccaatagaactaccttaaattagtcattttccaccttggcttcacatgagaa

SEQ ID NO: 93491 - DNA, 601 bp, Human
cttcttcagagaaaaggttccaaatctttctataaatataacacattatttaaaaattttcaaaaggcatgaatatattttccctgcagacagacatgcatgtgcacatgtgcaagcacacacacatgcaaatacatgaatgtcatttgctaaatgttcacattaaaaaacttaatatttgtatgcaaaccaatcgactgcatatcactccttaaacatttaccaaatgaccaaatgcttgagttagatgaggtcacttgcaaggcaccactgggatattttaaatggaataaaatgagargatattgttaatggaggggggaagacattcttagataaagagaaaatatagagaacaaaactcaatgatttaatggcaaattatgaaattataagataatagcctccagtaactaataacagagcagaggagtaaatgagccctggactaggtcaagaagacaccttggaggggcttgggaattgaattaggacttgaaagataagaacagaatgaggagaagaaaggaaagaagattagcagagttataattgagttgaaaaggagcccagttggttggagctaggcacctggaaggtg

SEQ ID NO: 93492 - DNA, 601 bp, Human
ccacagtccagtaattcctctcaattgaacccatctagtgtaaagatgggaagacaccttcaggaagcattatcgttttattttttaacatcttctcttggtttacaagggtagtgcaagtggggaacctctcaattcctacagtgttttgactcaacttttcttattgagacactccttcagtgttgaggggacacaatagagtgatattctgatctccatggagtgatgggcaagaaaattgccatggagatccagaagtgccagcttgggacttccaagggagtaccttccccatccyaggtgtgccagaggaccgccttctctcagggctgagtctcctgtctgagcacacatacaggatagctacatagctggcctaaagccacaaataatgtggaatatgaaaataatatggaaaccatctctatcttcttcctcttctatgtagaaagcctgcttaaggtgtggagttgcttaataaatacatgagacctagaaataagatttatagggtcttgcttaatatgaatcaatgacatctgttctttaacttcttcagagaaaaggttccaaatctttctataaatataacacatta

SEQ ID NO: 93493 - DNA, 601 bp, Human
gaaattattgagaaatgttaattatgttatcagagctcaggaggagttaatggtgctaactgggggtggtggagatagtcctatgagaagcagagaagccaaatctacttccccagcactgatttggtcatctcctctatattaccaagtataacactctatacagaccatgagagagcacaatgcacgtacagaatccctgattatttatgcagcacattggatgaagcccgtcttcatttcagggttctatttgtaaagtaatttgaggtctctggtgttctggggcacagctttcttraagagcaaaccagaagtccttagggaaatcaggctccacttacggtctcatcccttgactcagcctttagaacaatgggtttttctgttagaagaagtcctccaaagcgtaatttcagggggatctgcaacagttaaacgagcatattgagaagcattaaataaagcaaaagtagaaagtatagcatcaaagtaaaaaaaaattactgacaataatgctttgtaaacatataaaaactactttcagcactataaatcttggattcgttatacttactctataagatgtgtgaagattgga

SEQ ID NO: 93494 - DNA, 601 bp, Human
atataaagcttactatagaatactacagatataacacatgatataaatgtcactgttagagccatcaaaataattcctatttttattaatgattgtggttgaaattattgagaaatgttaattatgttatcagagctcaggaggagttaatggtgctaactgggggtggtggagatagtcctatgagaagcagagaagccaaatctacttccccagcactgatttggtcatctcctctatattaccaagtataacactctatacagaccatgagagagcacaatgcacgtacagaatcccygattatttatgcagcacattggatgaagcccgtcttcatttcagggttctatttgtaaagtaatttgaggtctctggtgttctggggcacagctttcttaaagagcaaaccagaagtccttagggaaatcaggctccacttacggtctcatcccttgactcagcctttagaacaatgggtttttctgttagaagaagtcctccaaagcgtaatttcagggggatctgcaacagttaaacgagcatattgagaagcattaaataaagcaaaagtagaaagtatagcatcaaagtaaaaaaa

SEQ ID NO: 93495 - DNA, 601 bp, Human; identical to SEQ ID NO: 42451

SEQ ID NO: 93496 - DNA, 601 bp, Human; identical to SEQ ID NO: 42452

SEQ ID NO: 93497 - DNA, 601 bp, Human; identical to SEQ ID NO: 42453

SEQ ID NO: 93498 - DNA, 601 bp, Human; identical to SEQ ID NO: 42454

SEQ ID NO: 93499 - DNA, 601 bp, Human
tgtcctctttcctctctagcaccattgtgggtttctgtgcccgtttcccttagcagaggtgagctcctcaagggcacagtctggtattacttactttcatgaccctggaccctagcaaggtactgtacacatggtgggtgaccagaaaggttggcagagttgacttgggtgagattgctgggcccctgtgtgtcatcccctctaagtctgtagaaatagactaattactctcagcaatagactaatcgttgcttgggactcaaatgtagccagcactgtgtcccaactaatgcaactggtcttgttctgcaaaggaaaatagtagaaggcatgttctgccacctaattcctcagaaggtaacataacatgaagagacttacctgctgagagttgtactgaatgtgtcaaggaagatactatgtatcagaagaacacccagaggcaccctgtgcctcttatctattcattcctgtattaaagcattcatcatgtattttaaaagctgtgctcacagtacttagggtacaaaattgactaagacccagacattagctcaattgttttgatttgtagatcctgcaaataagtgagaacatgcaa

SEQ ID NO: 93500 - DNA, 601 bp, Human
agactccaaagtgtcccatcaatccagatacatgaaaaagaaggcatcacacccaactcattcaatgagggccacatgatccaaatctgaaaaaaatcaggaccgcaaaggaagatgacatgccagtctcattcatcggcatcagtgcaaaaatgctgaacacaatagtagcaagccagagacaggagtgttcaaagatgatacaccatgaccaagttgaatttaaacctgagactcaagaatagttaacagagaaaaagtataaataccaatgatctcatcaacagattaaaggagaacrattataagatcatctcaattgttttaggaagagcctttgctagttcaataataatatattaataatacatgataatattcaactcccattcatgatataaaaaaccttcaacaactaacagcagtgaattttattaatctgatgaaagcatctaccaaaaaaaattagagaaaacattattctcagcagtataaaagcattatcctcttataccttcttgtttaccatgtgcacaaattacctttccaaaactagtaacatctttaaaaaatcctatcagttaacttactttttctgtaa

SEQ ID NO: 93501 - DNA, 601 bp, Human
tactccttatttcagtaacctcctagcttcttttgcctaccctgggcagtacttatccagggaattccctactcagccaccagacagcatctcaaaaaacatggaatcttaaagcatgcttccttggcttcagtccctgcaactgttcctatcactcacaggataaaatctaagtatatctaggaagtaacacaagaccctttctcatctggccactgttagcttcttcagcctgtctcagtccacttctccaactgtacacggtgttttaagcaaatggtgcgattggctactccccagsctctgcaaaaatgatgtgttcgtgtctccttgtgtccacacaagctgttctttagcatagactgggtccaacccagcttccatctggtgcattcctaaccatccttcaggagtcaaccagggcatcatctccccaacaagcctctttcatgaccacagcaagcaaatgctggagagggtcccgctggtgctttctcacagttttaacagctggacacacagtggctgtcatcccgggatgctcacagaattcacatgcatgaggagcttttaaaaaccacagattcactgtgtgtggagg

SEQ ID NO: 93502 - DNA, 601 bp, Human; identical to SEQ ID NO: 93487

SEQ ID NO: 93503 - DNA, 601 bp, Human; identical to SEQ ID NO: 93488

SEQ ID NO: 93504 - DNA, 601 bp, Human; identical to SEQ ID NO: 93489

SEQ ID NO: 93505 - DNA, 601 bp, Human; identical to SEQ ID NO: 93490

SEQ ID NO: 93506 - DNA, 601 bp, Human; identical to SEQ ID NO: 93491

SEQ ID NO: 93507 - DNA, 601 bp, Human; identical to SEQ ID NO: 93492

SEQ ID NO: 93508 - DNA, 601 bp, Human; identical to SEQ ID NO: 93493

SEQ ID NO: 93509 - DNA, 601 bp, Human; identical to SEQ ID NO: 93494

SEQ ID NO: 93510 - DNA, 601 bp, Human
gttcctttccatggaatatggtattcataagccaagacttgggcgctaagtgtgctcattgctattgaaatgtcattgttacctagacctatcagtgaagagaagtaggaaatatatggttttttttgtacacacacacaaacacatgtatacatttcatctatctatatatctatcatatatctgttatctatcacctatctacccatctatccatctagaagggtatgaatatacacgaatacatccattccaatctaatttcataggattcatgctagttttctccctttctgaatcmatgactccgttcttcaaagatgagaagcctggcttctatcatccttaatatatttacttctttgataaatcccctttatgtaaccaaacctcacccatcacttcccactcatggatgccctcctgacctcacatgggttctccatgctctatttaggctctggctgctcttgtaggccacacctctctatgaaccccttctctgcttgcttggactcccacacccaggcaggctgtttccacatgaacacccagtttgtcctcatcctacttggtctctgacttggaaccaccatgactc

SEQ ID NO: 93511 - DNA, 601 bp, Human
taatgtccaggtaccttcctgttgatagcaaaaggtacagtattccacataagtaaacataaaatgttccagacagttgaatgaagaccttgttttctcttctataatgggtagcacttaaggcagtataggttccaaacattctgtacaaatccagtgactctgataatatgtggtaaaatacaactgagaaatggcatggagggtcgtgtttggagatcccagcagaggcagcatatagtgcatttggatccttgccccagaatagttagtggaaatgtgtgcaccatctactgaaacyagggtggccttgggttttctactcctgttccttcttttattgtcacagctatggcaaatcaatgacactaatctctgcttctacactttctagaagttacgtgatctctcaggtcaggacaaactattgagttaatctgtcagcagcactgtcccccaaggaaagatctaggtgagtgtctagactcacatggttccatgtcaaggcagaggctgtgctgggcaaactgtttagtttctttccagctcccctctgtttggtagagtaataccacttttggttccaatgaagaggctaaca

SEQ ID NO: 93512 - DNA, 601 bp, Human
gcaaacctgaggttcctgagagttagcaagagagtcccggggtaaaccttgccatgctctggatgatgcctatacactgtttctgaaagtgtaaaacctcagaccttcctcctgaggagaagcagttttactgatggaactaagctgctctctccaatcataagaagccaaagagtgagctcaaaaacactcacctgatggtaggacaaagtagttcccaaaaaaagcagaggtgtgggccctggaatgccaagcttcttaaaaagtccatgtgaatgggctccatatctacaaactgaawcagaaatcaggtctcagggattgtgactttatagatatgggggctggtaagtcactgactgaggaactggaatgctcaagagaaggaggtaacattaaggcaataaatgataacagtaactctgacagcaatgattatatttgtacatcaagtcctttcccgtctccaccatgagacaccaaaaagtcacaatgattagtcgaaagcagcagaagtctttatggtcccaatcctggaatgaatacttgataaatgtcctcaaacgtgagtgctcctcagaggttcaggaaggaattcttc

SEQ ID NO: 93513 - DNA, 601 bp, Human; identical to SEQ ID NO: 38028

SEQ ID NO: 93514 - DNA, 601 bp, Human; identical to SEQ ID NO: 38029

SEQ ID NO: 93515 - DNA, 601 bp, Human; identical to SEQ ID NO: 38030

SEQ ID NO: 93516 - DNA, 601 bp, Human; identical to SEQ ID NO: 38031

SEQ ID NO: 93517 - DNA, 601 bp, Human; identical to SEQ ID NO: 38032

SEQ ID NO: 93518 - DNA, 601 bp, Human; identical to SEQ ID NO: 38033

SEQ ID NO: 93519 - DNA, 601 bp, Human; identical to SEQ ID NO: 38034

SEQ ID NO: 93520 - DNA, 601 bp, Human; identical to SEQ ID NO: 38035

SEQ ID NO: 93521 - DNA, 601 bp, Human; identical to SEQ ID NO: 38036

SEQ ID NO: 93522 - DNA, 601 bp, Human; identical to SEQ ID NO: 38037

SEQ ID NO: 93523 - DNA, 601 bp, Human; identical to SEQ ID NO: 38038

SEQ ID NO: 93524 - DNA, 601 bp, Human; identical to SEQ ID NO: 38039

SEQ ID NO: 93525 - DNA, 601 bp, Human; identical to SEQ ID NO: 38040

SEQ ID NO: 93526 - DNA, 601 bp, Human
ggttatttagggaaattttaaaccaacatagctaattatttgtgtttttaatttctatcctcccaccccacatcaggatcttggtttatcagttatcccttttctttcttgaatcttcattctcctttgccttacttaactctgtctcctcagattacaaatatgttcgtattcctaatttatcaaaacctattctcaattctgctcgttctcccatctctcttcattggatcttttcctcattgaaatttcttctgacacatccaaatggttccatcttttaaaacctagctcaaacctrtctcatcacccaccatttcaaattaacgtttttactgtttaatatttttattacttaacagtttttgaaaatctgtaagtttaaaagtcatgagaagtgacgcttgattaacaggtttcacaaacatcagttggacatgttctttatgattgttattttgcctttatctagtatgtctttttttgtttaaacagttgttggaatactttgtagaggaatattttgatcaaaatcctattagtcaggtacgtatctaagtgatagaattcagaattagattcctattttgcttccaaatgt

SEQ ID NO: 93527 - DNA, 601 bp, Human
aactctgtctcctcagattacaaatatgttcgtattcctaatttatcaaaacctattctcaattctgctcgttctcccatctctcttcattggatcttttcctcattgaaatttcttctgacacatccaaatggttccatcttttaaaacctagctcaaacctatctcatcacccaccatttcaaattaacgtttttactgtttaatatttttattacttaacagtttttgaaaatctgtaagtttaaaagtcatgagaagtgacgcttgattaacaggtttcacaaacatcagttggacrtgttctttatgattgttattttgcctttatctagtatgtctttttttgtttaaacagttgttggaatactttgtagaggaatattttgatcaaaatcctattagtcaggtacgtatctaagtgatagaattcagaattagattcctattttgcttccaaatgtaatttatttttaaaaattggacatgtattttgtgaattacccaaattgtttaaccagtttctggtatacttaaaaatgaaaagcgtaataactctaaaagttaaacgtaatgtgaactcatagctaaatttatttgc

SEQ ID NO: 93528 - DNA, 601 bp, Human
aaccttttatccttgccggcacacataagggaaatgacatactttcttcattagtagtttttcattaaatgcagtgaggagtgaaatgtacattggcctggagtgattcaagaaactcagttgtgagtaaccaaaagaatgtcacactagcttaagtgcagaaggaaaattttgggctatgttcaaaggtgggccaattccatatatagttgctgcatatgttggggtcctggctttgtctggcttcattctctgatagattttctggaagttgaaaagatgtctcttaattgtcccagttctacattgtacccgtagcctatagcttcagcacacgtctagggagaactctgattggcctgagttacgatctgcccatccatgaacaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttctattgcttctttttt

SEQ ID NO: 93529 - DNA, 601 bp, Human
ttgtcccagttctacattgtacccgtagcctatagcttcagcacacgtctagggagaactctgattggcctgagttacgatctgcccatccatgaacaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttctattrcttctttttttttttttttgagaaggagtctctcactctgtcgcccaggcggtgctgtcttggctcactgcaacctccgcctcccgggttcaagagattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagtttt

SEQ ID NO: 93530 - DNA, 601 bp, Human
acaaagtggccaggaaatgaagtattttgtttgtacgcttcgattgcctgctgatgcccagagcaggatagaagtagggtcagcaccacatgaactaagcaggattattatatagtggaagaaggatggttcctccaaggtaggaatataaggtcaatattttcctctcactttacccaccccgagttaccagcagttttctattgcttctttttttttttttttgagaaggagtctctcactctgtcgcccaggcggtgctgtcttggctcactgcaacctccgcctcccgggttcaagwgattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagttttctatggatgttagtgaagtcatgtataaagatgaaaaatattctggagattctgacaggcctcttgaagccacctttttttccctccaatcagac

SEQ ID NO: 93531 - DNA, 601 bp, Human
ctccgcctcccgggttcaagagattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagttttctatggatgttagtgaagtcatgtataaagatgaaaaatattctggagattctgacaggcctcttgaagccaccwttttttccctccaatcagaccactgctgtaaaccacactgacactattgtagtatgcttttttcctatacccataacacagtgggagattaaaaataattttgtagggtaggaagagaagtggatagagagccaggagatctaggtttgggtgctgctggtcctgcagttaagcaggcatatgtctttgggcaagtcatttcacttgtttagattaattttctcacttatgaagtgagggatttggactgcttagcgaggtacttttcatctctaaaatttatgaatctaaaatacttgc

SEQ ID NO: 93532 - DNA, 601 bp, Human
tgctggtcctgcagttaagcaggcatatgtctttgggcaagtcatttcacttgtttagattaattttctcacttatgaagtgagggatttggactgcttagcgaggtacttttcatctctaaaatttatgaatctaaaatacttgcagtaaatattaaatattacaaatggttaatattttaaaacttactcagatgagtaaaaactcaagggagctccaagttgatgaatagacaaagaagacatgattcacacagaaaaaacccagaaattaaatcagggaaactagtaatccaaaaamactctacccaattacataacattttattttttaatatattttaaatgagcaaaattaagtttccaaagcaatatgttgcttgtggaaccacagagaaactgttatttatagtgctgatagtcttacaaattagttcaatattttttagaaaagcataaaaattgttcctgaaattatatttagggaatgttatggaaggagaatgatcactctacaaagatactctttgtaacattatgtataatagtgacagattaaaaattaaatgtttaatagtatgctttgatggattatatttta

SEQ ID NO: 93533 - DNA, 601 bp, Human
gtcctgcagttaagcaggcatatgtctttgggcaagtcatttcacttgtttagattaattttctcacttatgaagtgagggatttggactgcttagcgaggtacttttcatctctaaaatttatgaatctaaaatacttgcagtaaatattaaatattacaaatggttaatattttaaaacttactcagatgagtaaaaactcaagggagctccaagttgatgaatagacaaagaagacatgattcacacagaaaaaacccagaaattaaatcagggaaactagtaatccaaaaacactcyacccaattacataacattttattttttaatatattttaaatgagcaaaattaagtttccaaagcaatatgttgcttgtggaaccacagagaaactgttatttatagtgctgatagtcttacaaattagttcaatattttttagaaaagcataaaaattgttcctgaaattatatttagggaatgttatggaaggagaatgatcactctacaaagatactctttgtaacattatgtataatagtgacagattaaaaattaaatgtttaatagtatgctttgatggattatattttatgaca

SEQ ID NO: 93534 - DNA, 601 bp, Human
aaagtttgaagctaacagagctgagctcatgaggttaatgaaagaagccatctccaaaacataaaagtgtaagaggggctgggcgcggtggctcacgcctgtcatcccagcactttgggaggccaaggtgggcagatcatgaggtcaggagttcaagaccagtctggccaacatagtgaaaccctgtctctactaaaaatacaaaaaattagccaggtgtggtggtgtgcgcctataatcccagctactcgggaggctgaggcaggagaatcgcatgaacccaggaggcagaggttgcagygagccgagatcgcgccattgcactttagcccagacgacactgtgagactccgtctcaaaataaaaaaaaaaaaagtgcaagaggaagcagcaagtgctgatgtagaagctgcagcaagttatccagaagatctagctaaaataattgatgaaggtgactacactaaatatcaaattttctttttcttttttgtttttgagagagggtctcgctctgtcacccaggttagagtgcagtggtgcaatcatggatcactgcagcctcaaactcccaggctcaagctattctcccagccccaca

SEQ ID NO: 93535 - DNA, 601 bp, Human
acccaggttagagtgcagtggtgcaatcatggatcactgcagcctcaaactcccaggctcaagctattctcccagccccacaagtagcagggactacaggcatgtgccaccacacccagctaatttttgttgttgttgttgttgtagaggtagggtttcgccacattgcccagctggtcttgaactcctgggctcaagcagtcctccgcctctgcctcccaaagtgctgggattacaagcatgagccactgcacctggcctcatattttcaatgtaaatgaaacagccttctgttggaagragatgccatctaggattttcatagctagaagaagtgaatgcctggtttcagagcttcatgggataggcttcttctcttgttaggggctaatacagctggtgacttgatgttggcaccaatgtttgttaccattctgaaaatcctagagtccttaagaattattctaaatctattcagtctgtgctctgcaaatggaataacaaagcccagataacagcacatctgtttacagcatgggcttactgaatattttaagcccattgttgagatatatctcagaaaaaagatttatttcaaaat

SEQ ID NO: 93536 - DNA, 601 bp, Human
ttgacaatgcacccagtcacccaagagctctaattgagatgtacaagaagattaatgttattttcatatctactaacatagcactcattctgcaacccttggataaaggaatactttgaactttcacgtcttgattatttaagaaatacatatcataaggctgtgactgccatagatggatctgagcaaagtacattgaaaaccttctggaaagaattcaccattctaaatgccattcatagaaagaggtcaaaatatctacactggctgggcatggtggctcatgcctgtaatcccagcrcattgggaggccgaggcggatggatcacttgaggtcaggagttcaagactagtctggccaacatggtgaaacccgtcctcactaaaaatacaaaaattatctgggcatggtggtgcatgcctgtaatcccagctactggggaggctaaggcaggagaattgcttgaacccaggaggcagaggttgcagtgagccgagatcgcaccactgcactccagcctgggtgtcagagcaagaatcagtctcaaaacaaaaaaagaatagcccataaacttagttggtaaagcatcagtggggtttc

SEQ ID NO: 93537 - DNA, 601 bp, Human
ctttcatgaaaggaagagttgacccatgtaacaaactactttgtcttattttaagaaattgccatagccacctcacccttcagaaagcaccactctgatcagtcagcagccatcaatatcaaggcaagactctccttcaacaaaaagatattattcactgacagttcagtcgatttttagcaataaagtatttttcataaaggtgtgtacttttttttttagatataatgctgttgcacacttactagactacagtatagtgtaaacagaacttttctttttctttcttttttttttttttgagacggagtctcgctctgtcgcccaggctggagtgcagtggcgcaatcttggctcactgtaagctccgcctcctgggttcacaccattctcctgccaccacgtccggctcatttttttgtatttttagtagagacggggtttcaccgtgttagccaggatggtctcgatctcctgacctcgtgatgtgcccgcttcagcctcccaaagtgctgggaatacaggcgtgagtcaccatccctggccgtaaacagaacttttatatacactaggaaacctgaaagttcatgtgacttgcttt

SEQ ID NO: 93538 - DNA, 601 bp, Human
atgaaaggaagagttgacccatgtaacaaactactttgtcttattttaagaaattgccatagccacctcacccttcagaaagcaccactctgatcagtcagcagccatcaatatcaaggcaagactctccttcaacaaaaagatattattcactgacagttcagtcgatttttagcaataaagtatttttcataaaggtgtgtacttttttttttagatataatgctgttgcacacttactagactacagtatagtgtaaacagaacttttctttttctttcttttttttttttttgagayggagtctcgctctgtcgcccaggctggagtgcagtggcgcaatcttggctcactgtaagctccgcctcctgggttcacaccattctcctgccaccacgtccggctcatttttttgtatttttagtagagacggggtttcaccgtgttagccaggatggtctcgatctcctgacctcgtgatgtgcccgcttcagcctcccaaagtgctgggaatacaggcgtgagtcaccatccctggccgtaaacagaacttttatatacactaggaaacctgaaagttcatgtgacttgctttattgc

SEQ ID NO: 93539 - DNA, 601 bp, Human
agccatcaatatcaaggcaagactctccttcaacaaaaagatattattcactgacagttcagtcgatttttagcaataaagtatttttcataaaggtgtgtacttttttttttagatataatgctgttgcacacttactagactacagtatagtgtaaacagaacttttctttttctttcttttttttttttttgagacggagtctcgctctgtcgcccaggctggagtgcagtggcgcaatcttggctcactgtaagctccgcctcctgggttcacaccattctcctgccaccacgtccrgctcatttttttgtatttttagtagagacggggtttcaccgtgttagccaggatggtctcgatctcctgacctcgtgatgtgcccgcttcagcctcccaaagtgctgggaatacaggcgtgagtcaccatccctggccgtaaacagaacttttatatacactaggaaacctgaaagttcatgtgacttgctttattgcaaatatttattgtgatatttgctttattgctgcggtctggaatccaaccctgcagtatctccaaggtatgcctgtatagggaaaaacatggtataatcagcc

SEQ ID NO: 93540 - DNA, 601 bp, Human
agactatctctatatacttgtatggagtgatcttcaggataaattactaagtaaaacagtagtttgagagaattttgtagtatgctgctaatcacctaagaagaaagtagagatgtaagtggatgtatatacttgtttatgttaataataaaaacaatagtatggaaataataaaaacttaaaaggggtggagggggaaatttttttttttaatgtttacctcagtgagtgtgtagggaaaagcaaagggttagaccctagacttttctgaatgcatcacttaatgatagggatacattcygagaaatgtgtcattaggtgataccatcattgtgcaaacatcacagagtgcacttacacaaacctagatagtgtagcctactaacatcgcagttatatagtatagcctattgctcctaggctgcacacctgtacagcatattgtgtactgaataatgtaggcagttgtaatgtaacacctagtgtttgtttaactaaacacagaaaaggtacaactaaaatgtattattttatgggaccactgtcatatatgtggttcatcactgaccaaaatgttatatagaatattactgtaccttgt

SEQ ID NO: 93541 - DNA, 601 bp, Human
ctatatacttgtatggagtgatcttcaggataaattactaagtaaaacagtagtttgagagaattttgtagtatgctgctaatcacctaagaagaaagtagagatgtaagtggatgtatatacttgtttatgttaataataaaaacaatagtatggaaataataaaaacttaaaaggggtggagggggaaatttttttttttaatgtttacctcagtgagtgtgtagggaaaagcaaagggttagaccctagacttttctgaatgcatcacttaatgatagggatacattccgagaaatgygtcattaggtgataccatcattgtgcaaacatcacagagtgcacttacacaaacctagatagtgtagcctactaacatcgcagttatatagtatagcctattgctcctaggctgcacacctgtacagcatattgtgtactgaataatgtaggcagttgtaatgtaacacctagtgtttgtttaactaaacacagaaaaggtacaactaaaatgtattattttatgggaccactgtcatatatgtggttcatcactgaccaaaatgttatatagaatattactgtaccttgttttaacttc

SEQ ID NO: 93542 - DNA, 601 bp, Human
tgcaaacatcacagagtgcacttacacaaacctagatagtgtagcctactaacatcgcagttatatagtatagcctattgctcctaggctgcacacctgtacagcatattgtgtactgaataatgtaggcagttgtaatgtaacacctagtgtttgtttaactaaacacagaaaaggtacaactaaaatgtattattttatgggaccactgtcatatatgtggttcatcactgaccaaaatgttatatagaatattactgtaccttgttttaacttcagagctttgtattttacataattrtaaaacaaaattaaatttaagagagtaattcttaaaaatcacaaacaagatttctgcctccagccaaaaagctgtaacagggactagatttaccctcctgtcaaaaaaagcagacaaaatatataaaacagtggttttcagacgttggacagcaagccttgctgataatgatccctgaaagaaaggaaacaaatgagatgggccctaagagcactccaccttactgcctggatggaatttccaggctgcacacagaggctggagatgttgttgagttgaagaaacaaagttcatctttca

SEQ ID NO: 93543 - DNA, 601 bp, Human
agggctgggtgtagtggctcacatctgtaatcccagcactttgggaggccgaggcaggcagatcacttgagaccaggagtttgagaccagcctggccaacatgatgaaaccccatctctactaaaaatacaaaaattagctgggtgtggtagcacgtgcctgtaatcccagctactcaggaagccaaggcacgagaattgcttgaacctgggaggcggagattgtagtgagttgagattgtgccactgcactccagcttgggcaacagagtgagaagccgtctcaaaaaaaaaaaaaaaaatgaagagggggaaaaaaatgaatgtagcataatttagttataagacatactcacagattttaaaatagacttttagaccaggcatggtggctcacacctataatcccagcactttgggaagctaaggcaggtggatcacttgaggctaggaattcaagaccagcaatatagtgagagacccccatctctatataagttataaatttttttttaaatatagacttcttttgttttttttttgagatggagtttcactcttggcacccgggctggagtgcagtggtgcaatctcagctcact

SEQ ID NO: 93544 - DNA, 601 bp, Human
gtgtagtggctcacatctgtaatcccagcactttgggaggccgaggcaggcagatcacttgagaccaggagtttgagaccagcctggccaacatgatgaaaccccatctctactaaaaatacaaaaattagctgggtgtggtagcacgtgcctgtaatcccagctactcaggaagccaaggcacgagaattgcttgaacctgggaggcggagattgtagtgagttgagattgtgccactgcactccagcttgggcaacagagtgagaagccgtctcaaaaaaaaaaaaaaaaatgaagagrgggaaaaaaatgaatgtagcataatttagttataagacatactcacagattttaaaatagacttttagaccaggcatggtggctcacacctataatcccagcactttgggaagctaaggcaggtggatcacttgaggctaggaattcaagaccagcaatatagtgagagacccccatctctatataagttataaatttttttttaaatatagacttcttttgttttttttttgagatggagtttcactcttggcacccgggctggagtgcagtggtgcaatctcagctcactgcaacctc

SEQ ID NO: 93545 - DNA, 601 bp, Human
gcactttgggaggccgaggcaggcagatcacttgagaccaggagtttgagaccagcctggccaacatgatgaaaccccatctctactaaaaatacaaaaattagctgggtgtggtagcacgtgcctgtaatcccagctactcaggaagccaaggcacgagaattgcttgaacctgggaggcggagattgtagtgagttgagattgtgccactgcactccagcttgggcaacagagtgagaagccgtctcaaaaaaaaaaaaaaaaatgaagagggggaaaaaaatgaatgtagcataattkagttataagacatactcacagattttaaaatagacttttagaccaggcatggtggctcacacctataatcccagcactttgggaagctaaggcaggtggatcacttgaggctaggaattcaagaccagcaatatagtgagagacccccatctctatataagttataaatttttttttaaatatagacttcttttgttttttttttgagatggagtttcactcttggcacccgggctggagtgcagtggtgcaatctcagctcactgcaacctctgcctcctgggttcaagcaattctact

SEQ ID NO: 93546 - DNA, 601 bp, Human; identical to SEQ ID NO: 42592

SEQ ID NO: 93547 - DNA, 601 bp, Human; identical to SEQ ID NO: 42593

SEQ ID NO: 93548 - DNA, 601 bp, Human; identical to SEQ ID NO: 42594

SEQ ID NO: 93549 - DNA, 601 bp, Human; identical to SEQ ID NO: 42595

SEQ ID NO: 93550 - DNA, 601 bp, Human; identical to SEQ ID NO: 42596

SEQ ID NO: 93551 - DNA, 601 bp, Human; identical to SEQ ID NO: 42597

SEQ ID NO: 93552 - DNA, 601 bp, Human; identical to SEQ ID NO: 42598

SEQ ID NO: 93553 - DNA, 601 bp, Human; identical to SEQ ID NO: 42599

SEQ ID NO: 93554 - DNA, 601 bp, Human; identical to SEQ ID NO: 42600

SEQ ID NO: 93555 - DNA, 601 bp, Human; identical to SEQ ID NO: 42601

SEQ ID NO: 93556 - DNA, 601 bp, Human; identical to SEQ ID NO: 42602

SEQ ID NO: 93557 - DNA, 601 bp, Human; identical to SEQ ID NO: 42603

SEQ ID NO: 93558 - DNA, 601 bp, Human; identical to SEQ ID NO: 42604

SEQ ID NO: 93559 - DNA, 601 bp, Human; identical to SEQ ID NO: 42605

SEQ ID NO: 93560 - DNA, 601 bp, Human; identical to SEQ ID NO: 42606

SEQ ID NO: 93561 - DNA, 601 bp, Human; identical to SEQ ID NO: 42607

SEQ ID NO: 93562 - DNA, 601 bp, Human; identical to SEQ ID NO: 42608

SEQ ID NO: 93563 - DNA, 601 bp, Human; identical to SEQ ID NO: 42609

SEQ ID NO: 93564 - DNA, 601 bp, Human; identical to SEQ ID NO: 42610

SEQ ID NO: 93565 - DNA, 601 bp, Human; identical to SEQ ID NO: 42611

SEQ ID NO: 93566 - DNA, 601 bp, Human; identical to SEQ ID NO: 42612

SEQ ID NO: 93567 - DNA, 601 bp, Human; identical to SEQ ID NO: 42613

SEQ ID NO: 93568 - DNA, 601 bp, Human; identical to SEQ ID NO: 42614

SEQ ID NO: 93569 - DNA, 601 bp, Human; identical to SEQ ID NO: 42615

SEQ ID NO: 93570 - DNA, 601 bp, Human; identical to SEQ ID NO: 42616

SEQ ID NO: 93571 - DNA, 601 bp, Human; identical to SEQ ID NO: 42617

SEQ ID NO: 93572 - DNA, 601 bp, Human; identical to SEQ ID NO: 42618

SEQ ID NO: 93573 - DNA, 601 bp, Human; identical to SEQ ID NO: 42619

SEQ ID NO: 93574 - DNA, 601 bp, Human; identical to SEQ ID NO: 42620

SEQ ID NO: 93575 - DNA, 601 bp, Human; identical to SEQ ID NO: 42621

SEQ ID NO: 93576 - DNA, 601 bp, Human; identical to SEQ ID NO: 42622

SEQ ID NO: 93577 - DNA, 601 bp, Human; identical to SEQ ID NO: 42623

SEQ ID NO: 93578 - DNA, 601 bp, Human; identical to SEQ ID NO: 42592

SEQ ID NO: 93579 - DNA, 601 bp, Human; identical to SEQ ID NO: 42593

SEQ ID NO: 93580 - DNA, 601 bp, Human; identical to SEQ ID NO: 42594

SEQ ID NO: 93581 - DNA, 601 bp, Human; identical to SEQ ID NO: 42595

SEQ ID NO: 93582 - DNA, 601 bp, Human; identical to SEQ ID NO: 42596

SEQ ID NO: 93583 - DNA, 601 bp, Human; identical to SEQ ID NO: 42597

SEQ ID NO: 93584 - DNA, 601 bp, Human; identical to SEQ ID NO: 42598

SEQ ID NO: 93585 - DNA, 601 bp, Human; identical to SEQ ID NO: 42599

SEQ ID NO: 93586 - DNA, 601 bp, Human; identical to SEQ ID NO: 42600

SEQ ID NO: 93587 - DNA, 601 bp, Human; identical to SEQ ID NO: 42601

SEQ ID NO: 93588 - DNA, 601 bp, Human; identical to SEQ ID NO: 42602

SEQ ID NO: 93589 - DNA, 601 bp, Human; identical to SEQ ID NO: 42603

SEQ ID NO: 93590 - DNA, 601 bp, Human; identical to SEQ ID NO: 42604

SEQ ID NO: 93591 - DNA, 601 bp, Human; identical to SEQ ID NO: 42605

SEQ ID NO: 93592 - DNA, 601 bp, Human; identical to SEQ ID NO: 42606

SEQ ID NO: 93593 - DNA, 601 bp, Human; identical to SEQ ID NO: 42607

SEQ ID NO: 93594 - DNA, 601 bp, Human; identical to SEQ ID NO: 42608

SEQ ID NO: 93595 - DNA, 601 bp, Human; identical to SEQ ID NO: 42609

SEQ ID NO: 93596 - DNA, 601 bp, Human; identical to SEQ ID NO: 42610

SEQ ID NO: 93597 - DNA, 601 bp, Human; identical to SEQ ID NO: 42611

SEQ ID NO: 93598 - DNA, 601 bp, Human; identical to SEQ ID NO: 42612

SEQ ID NO: 93599 - DNA, 601 bp, Human; identical to SEQ ID NO: 42613

SEQ ID NO: 93600 - DNA, 601 bp, Human; identical to SEQ ID NO: 42614

SEQ ID NO: 93601 - DNA, 601 bp, Human; identical to SEQ ID NO: 42615

SEQ ID NO: 93602 - DNA, 601 bp, Human; identical to SEQ ID NO: 42616

SEQ ID NO: 93603 - DNA, 601 bp, Human; identical to SEQ ID NO: 42617

SEQ ID NO: 93604 - DNA, 601 bp, Human; identical to SEQ ID NO: 42618

SEQ ID NO: 93605 - DNA, 601 bp, Human; identical to SEQ ID NO: 42619

SEQ ID NO: 93606 - DNA, 601 bp, Human; identical to SEQ ID NO: 42620

SEQ ID NO: 93607 - DNA, 601 bp, Human; identical to SEQ ID NO: 42621

SEQ ID NO: 93608 - DNA, 601 bp, Human; identical to SEQ ID NO: 42622

SEQ ID NO: 93609 - DNA, 601 bp, Human; identical to SEQ ID NO: 42623

SEQ ID NO: 93610 - DNA, 601 bp, Human; identical to SEQ ID NO: 42592

SEQ ID NO: 93611 - DNA, 601 bp, Human; identical to SEQ ID NO: 42593

SEQ ID NO: 93612 - DNA, 601 bp, Human; identical to SEQ ID NO: 42594

SEQ ID NO: 93613 - DNA, 601 bp, Human; identical to SEQ ID NO: 42595

SEQ ID NO: 93614 - DNA, 601 bp, Human; identical to SEQ ID NO: 42596

SEQ ID NO: 93615 - DNA, 601 bp, Human; identical to SEQ ID NO: 42597

SEQ ID NO: 93616 - DNA, 601 bp, Human; identical to SEQ ID NO: 42598

SEQ ID NO: 93617 - DNA, 601 bp, Human; identical to SEQ ID NO: 42599

SEQ ID NO: 93618 - DNA, 601 bp, Human; identical to SEQ ID NO: 42600

SEQ ID NO: 93619 - DNA, 601 bp, Human; identical to SEQ ID NO: 42601

SEQ ID NO: 93620 - DNA, 601 bp, Human; identical to SEQ ID NO: 42602

SEQ ID NO: 93621 - DNA, 601 bp, Human; identical to SEQ ID NO: 42603

SEQ ID NO: 93622 - DNA, 601 bp, Human; identical to SEQ ID NO: 42604

SEQ ID NO: 93623 - DNA, 601 bp, Human; identical to SEQ ID NO: 42605

SEQ ID NO: 93624 - DNA, 601 bp, Human; identical to SEQ ID NO: 42606

SEQ ID NO: 93625 - DNA, 601 bp, Human; identical to SEQ ID NO: 42607

SEQ ID NO: 93626 - DNA, 601 bp, Human; identical to SEQ ID NO: 42608

SEQ ID NO: 93627 - DNA, 601 bp, Human; identical to SEQ ID NO: 42609

SEQ ID NO: 93628 - DNA, 601 bp, Human; identical to SEQ ID NO: 42610

SEQ ID NO: 93629 - DNA, 601 bp, Human; identical to SEQ ID NO: 42611

SEQ ID NO: 93630 - DNA, 601 bp, Human; identical to SEQ ID NO: 42612

SEQ ID NO: 93631 - DNA, 601 bp, Human; identical to SEQ ID NO: 42613

SEQ ID NO: 93632 - DNA, 601 bp, Human; identical to SEQ ID NO: 42614

SEQ ID NO: 93633 - DNA, 601 bp, Human; identical to SEQ ID NO: 42615

SEQ ID NO: 93634 - DNA, 601 bp, Human; identical to SEQ ID NO: 42616

SEQ ID NO: 93635 - DNA, 601 bp, Human; identical to SEQ ID NO: 42617

SEQ ID NO: 93636 - DNA, 601 bp, Human; identical to SEQ ID NO: 42618

SEQ ID NO: 93637 - DNA, 601 bp, Human; identical to SEQ ID NO: 42619

SEQ ID NO: 93638 - DNA, 601 bp, Human; identical to SEQ ID NO: 42620

SEQ ID NO: 93639 - DNA, 601 bp, Human; identical to SEQ ID NO: 42621

SEQ ID NO: 93640 - DNA, 601 bp, Human; identical to SEQ ID NO: 42622

SEQ ID NO: 93641 - DNA, 601 bp, Human; identical to SEQ ID NO: 42623

SEQ ID NO: 93642 - DNA, 601 bp, Human; identical to SEQ ID NO: 42592

SEQ ID NO: 93643 - DNA, 601 bp, Human; identical to SEQ ID NO: 42593

SEQ ID NO: 93644 - DNA, 601 bp, Human; identical to SEQ ID NO: 42594

SEQ ID NO: 93645 - DNA, 601 bp, Human; identical to SEQ ID NO: 42595

SEQ ID NO: 93646 - DNA, 601 bp, Human; identical to SEQ ID NO: 42596

SEQ ID NO: 93647 - DNA, 601 bp, Human; identical to SEQ ID NO: 42597

SEQ ID NO: 93648 - DNA, 601 bp, Human; identical to SEQ ID NO: 42598

SEQ ID NO: 93649 - DNA, 601 bp, Human; identical to SEQ ID NO: 42599

SEQ ID NO: 93650 - DNA, 601 bp, Human; identical to SEQ ID NO: 42600

SEQ ID NO: 93651 - DNA, 601 bp, Human; identical to SEQ ID NO: 42601

SEQ ID NO: 93652 - DNA, 601 bp, Human; identical to SEQ ID NO: 42602

SEQ ID NO: 93653 - DNA, 601 bp, Human; identical to SEQ ID NO: 42603

SEQ ID NO: 93654 - DNA, 601 bp, Human; identical to SEQ ID NO: 42604

SEQ ID NO: 93655 - DNA, 601 bp, Human; identical to SEQ ID NO: 42605

SEQ ID NO: 93656 - DNA, 601 bp, Human; identical to SEQ ID NO: 42606

SEQ ID NO: 93657 - DNA, 601 bp, Human; identical to SEQ ID NO: 42607

SEQ ID NO: 93658 - DNA, 601 bp, Human; identical to SEQ ID NO: 42608

SEQ ID NO: 93659 - DNA, 601 bp, Human; identical to SEQ ID NO: 42609

SEQ ID NO: 93660 - DNA, 601 bp, Human; identical to SEQ ID NO: 42610

SEQ ID NO: 93661 - DNA, 601 bp, Human; identical to SEQ ID NO: 42611

SEQ ID NO: 93662 - DNA, 601 bp, Human; identical to SEQ ID NO: 42612

SEQ ID NO: 93663 - DNA, 601 bp, Human; identical to SEQ ID NO: 42613

SEQ ID NO: 93664 - DNA, 601 bp, Human; identical to SEQ ID NO: 42614

SEQ ID NO: 93665 - DNA, 601 bp, Human; identical to SEQ ID NO: 42615

SEQ ID NO: 93666 - DNA, 601 bp, Human; identical to SEQ ID NO: 42616

SEQ ID NO: 93667 - DNA, 601 bp, Human; identical to SEQ ID NO: 42617

SEQ ID NO: 93668 - DNA, 601 bp, Human; identical to SEQ ID NO: 42618

SEQ ID NO: 93669 - DNA, 601 bp, Human; identical to SEQ ID NO: 42619

SEQ ID NO: 93670 - DNA, 601 bp, Human; identical to SEQ ID NO: 42620

SEQ ID NO: 93671 - DNA, 601 bp, Human; identical to SEQ ID NO: 42621

SEQ ID NO: 93672 - DNA, 601 bp, Human; identical to SEQ ID NO: 42622

SEQ ID NO: 93673 - DNA, 601 bp, Human; identical to SEQ ID NO: 42623

SEQ ID NO: 93674 - DNA, 601 bp, Human; identical to SEQ ID NO: 42592

SEQ ID NO: 93675 - DNA, 601 bp, Human; identical to SEQ ID NO: 42593

SEQ ID NO: 93676 - DNA, 601 bp, Human; identical to SEQ ID NO: 42594

SEQ ID NO: 93677 - DNA, 601 bp, Human; identical to SEQ ID NO: 42595

SEQ ID NO: 93678 - DNA, 601 bp, Human; identical to SEQ ID NO: 42596

SEQ ID NO: 93679 - DNA, 601 bp, Human; identical to SEQ ID NO: 42597

SEQ ID NO: 93680 - DNA, 601 bp, Human; identical to SEQ ID NO: 42598

SEQ ID NO: 93681 - DNA, 601 bp, Human; identical to SEQ ID NO: 42599

SEQ ID NO: 93682 - DNA, 601 bp, Human; identical to SEQ ID NO: 42600

SEQ ID NO: 93683 - DNA, 601 bp, Human; identical to SEQ ID NO: 42601

SEQ ID NO: 93684 - DNA, 601 bp, Human; identical to SEQ ID NO: 42602

SEQ ID NO: 93685 - DNA, 601 bp, Human; identical to SEQ ID NO: 42603

SEQ ID NO: 93686 - DNA, 601 bp, Human; identical to SEQ ID NO: 42604

SEQ ID NO: 93687 - DNA, 601 bp, Human; identical to SEQ ID NO: 42605

SEQ ID NO: 93688 - DNA, 601 bp, Human; identical to SEQ ID NO: 42606

SEQ ID NO: 93689 - DNA, 601 bp, Human; identical to SEQ ID NO: 42607

SEQ ID NO: 93690 - DNA, 601 bp, Human; identical to SEQ ID NO: 42608

SEQ ID NO: 93691 - DNA, 601 bp, Human; identical to SEQ ID NO: 42609

SEQ ID NO: 93692 - DNA, 601 bp, Human; identical to SEQ ID NO: 42610

SEQ ID NO: 93693 - DNA, 601 bp, Human; identical to SEQ ID NO: 42611

SEQ ID NO: 93694 - DNA, 601 bp, Human; identical to SEQ ID NO: 42612

SEQ ID NO: 93695 - DNA, 601 bp, Human; identical to SEQ ID NO: 42613

SEQ ID NO: 93696 - DNA, 601 bp, Human; identical to SEQ ID NO: 42614

SEQ ID NO: 93697 - DNA, 601 bp, Human; identical to SEQ ID NO: 42615

SEQ ID NO: 93698 - DNA, 601 bp, Human; identical to SEQ ID NO: 42616

SEQ ID NO: 93699 - DNA, 601 bp, Human; identical to SEQ ID NO: 42617

SEQ ID NO: 93700 - DNA, 601 bp, Human; identical to SEQ ID NO: 42618

SEQ ID NO: 93701 - DNA, 601 bp, Human; identical to SEQ ID NO: 42619

SEQ ID NO: 93702 - DNA, 601 bp, Human; identical to SEQ ID NO: 42620

SEQ ID NO: 93703 - DNA, 601 bp, Human; identical to SEQ ID NO: 42621

SEQ ID NO: 93704 - DNA, 601 bp, Human; identical to SEQ ID NO: 42622

SEQ ID NO: 93705 - DNA, 601 bp, Human; identical to SEQ ID NO: 42623

SEQ ID NO: 93706 - DNA, 601 bp, Human; identical to SEQ ID NO: 42592

SEQ ID NO: 93707 - DNA, 601 bp, Human; identical to SEQ ID NO: 42593

SEQ ID NO: 93708 - DNA, 601 bp, Human; identical to SEQ ID NO: 42594

SEQ ID NO: 93709 - DNA, 601 bp, Human; identical to SEQ ID NO: 42595

SEQ ID NO: 93710 - DNA, 601 bp, Human; identical to SEQ ID NO: 42596

SEQ ID NO: 93711 - DNA, 601 bp, Human; identical to SEQ ID NO: 42597

SEQ ID NO: 93712 - DNA, 601 bp, Human; identical to SEQ ID NO: 42598

SEQ ID NO: 93713 - DNA, 601 bp, Human; identical to SEQ ID NO: 42599

SEQ ID NO: 93714 - DNA, 601 bp, Human; identical to SEQ ID NO: 42600

SEQ ID NO: 93715 - DNA, 601 bp, Human; identical to SEQ ID NO: 42601

SEQ ID NO: 93716 - DNA, 601 bp, Human; identical to SEQ ID NO: 42602

SEQ ID NO: 93717 - DNA, 601 bp, Human; identical to SEQ ID NO: 42603

SEQ ID NO: 93718 - DNA, 601 bp, Human; identical to SEQ ID NO: 42604

SEQ ID NO: 93719 - DNA, 601 bp, Human; identical to SEQ ID NO: 42605

SEQ ID NO: 93720 - DNA, 601 bp, Human; identical to SEQ ID NO: 42606

SEQ ID NO: 93721 - DNA, 601 bp, Human; identical to SEQ ID NO: 42607

SEQ ID NO: 93722 - DNA, 601 bp, Human; identical to SEQ ID NO: 42608

SEQ ID NO: 93723 - DNA, 601 bp, Human; identical to SEQ ID NO: 42609

SEQ ID NO: 93724 - DNA, 601 bp, Human; identical to SEQ ID NO: 42610

SEQ ID NO: 93725 - DNA, 601 bp, Human; identical to SEQ ID NO: 42611

SEQ ID NO: 93726 - DNA, 601 bp, Human; identical to SEQ ID NO: 42612

SEQ ID NO: 93727 - DNA, 601 bp, Human; identical to SEQ ID NO: 42613

SEQ ID NO: 93728 - DNA, 601 bp, Human; identical to SEQ ID NO: 42614

SEQ ID NO: 93729 - DNA, 601 bp, Human; identical to SEQ ID NO: 42615

SEQ ID NO: 93730 - DNA, 601 bp, Human; identical to SEQ ID NO: 42616

SEQ ID NO: 93731 - DNA, 601 bp, Human; identical to SEQ ID NO: 42617

SEQ ID NO: 93732 - DNA, 601 bp, Human; identical to SEQ ID NO: 42618

SEQ ID NO: 93733 - DNA, 601 bp, Human; identical to SEQ ID NO: 42619

SEQ ID NO: 93734 - DNA, 601 bp, Human; identical to SEQ ID NO: 42620

SEQ ID NO: 93735 - DNA, 601 bp, Human; identical to SEQ ID NO: 42621

SEQ ID NO: 93736 - DNA, 601 bp, Human; identical to SEQ ID NO: 42622

SEQ ID NO: 93737 - DNA, 601 bp, Human; identical to SEQ ID NO: 42623

SEQ ID NO: 93738 - DNA, 601 bp, Human
gtcggctgcgtagctcacggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggcccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagcmgcttaggggcaccgccgccctcactgccgccgccttagtagccgccaccgccgcctctgccgccccccgccgccatcttcatcgctcccgaccgcctctgctgctcctccggctgctgcctctgctccagccgccgacgccgcttctcccaggaaattacttttccaagttagtttggtaaagtttaaaaggttggtgctttatcctgtagacaattgagagtagtttctgtatttaagaaggataaataaaatgttctgtgtgcagggcggattagaaatggaagacattggaagcaga

SEQ ID NO: 93739 - DNA, 601 bp, Human
gtggtgatcgaataaatggggttcaggatggtaaagagaagcacactgttcacgctccgggagtcatccgagtccccggggagggagatcttctggctggtagagtagttgacaaaagctgggtgaccggcaatgtatatttggttgtcggctgcgtagctcacggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggmccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagcagcttaggggcaccgccgccctcactgccgccgccttagtagccgccaccgccgcctctgccgccccccgccgccatcttcatcgctcccgaccgcctctgctgctcctccggctgctgcctctgctccagccgccgacgccgcttctcccagga

SEQ ID NO: 93740 - DNA, 601 bp, Human
gccccattgagagaggccttggcccgctgggcactttgaacagagtcaaattccaccatcgcctgaactccattcttcctgaaaatgataattctctggacagggccacaaggattacagatagtgtaaagaacatccgtggtgatcgaataaatggggttcaggatggtaaagagaagcacactgttcacgctccgggagtcatccgagtccccggggagggagatcttctggctggtagagtagttgacaaaagctgggtgaccggcaatgtatatttggttgtcggctgcgtagctcmcggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggcccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagcagcttaggggcaccgcc

SEQ ID NO: 93741 - DNA, 601 bp, Human; identical to SEQ ID NO: 20355

SEQ ID NO: 93742 - DNA, 601 bp, Human; identical to SEQ ID NO: 20356

SEQ ID NO: 93743 - DNA, 601 bp, Human; identical to SEQ ID NO: 20357

SEQ ID NO: 93744 - DNA, 601 bp, Human; identical to SEQ ID NO: 20358

SEQ ID NO: 93745 - DNA, 601 bp, Human; identical to SEQ ID NO: 20359

SEQ ID NO: 93746 - DNA, 601 bp, Human; identical to SEQ ID NO: 20360

SEQ ID NO: 93747 - DNA, 601 bp, Human; identical to SEQ ID NO: 20361

SEQ ID NO: 93748 - DNA, 601 bp, Human; identical to SEQ ID NO: 20362

SEQ ID NO: 93749 - DNA, 601 bp, Human; identical to SEQ ID NO: 20363

SEQ ID NO: 93750 - DNA, 601 bp, Human; identical to SEQ ID NO: 20364

SEQ ID NO: 93751 - DNA, 601 bp, Human; identical to SEQ ID NO: 20365

SEQ ID NO: 93752 - DNA, 601 bp, Human; identical to SEQ ID NO: 20366

SEQ ID NO: 93753 - DNA, 601 bp, Human; identical to SEQ ID NO: 20367

SEQ ID NO: 93754 - DNA, 601 bp, Human; identical to SEQ ID NO: 20368

SEQ ID NO: 93755 - DNA, 601 bp, Human; identical to SEQ ID NO: 20369

SEQ ID NO: 93756 - DNA, 601 bp, Human; identical to SEQ ID NO: 20370

SEQ ID NO: 93757 - DNA, 601 bp, Human; identical to SEQ ID NO: 20371

SEQ ID NO: 93758 - DNA, 601 bp, Human; identical to SEQ ID NO: 20372

SEQ ID NO: 93759 - DNA, 601 bp, Human; identical to SEQ ID NO: 20373

SEQ ID NO: 93760 - DNA, 601 bp, Human; identical to SEQ ID NO: 20374

SEQ ID NO: 93761 - DNA, 601 bp, Human; identical to SEQ ID NO: 20375

SEQ ID NO: 93762 - DNA, 601 bp, Human
tggtgctttgaaataaggatttttcttataacgttggcttctaaacccaagccaactactccatctggtgcttggcagaagaaacagtggtcgcttctaacactagtgtgaaaactggctgtgttagactcactgcaagatggtgcatagcctgcagctgatgtgtaaatgtgaccgcagatacagcaaagtttttgtgaataatttgggccatatttacttctcacattatgcactgacagaagagttgaattaccatgtaagacacagctcttctatgtctttttttttttttttttttggagacaggatcttgctctgtcacccaggctagagtgcagtggcactatcatgggtcactgtagcgtctgaccttctggacataagtgactggacctcctgcctcagtctcccaagtagctgggactacaggtgtgcaccaccacactcagctaatttttgtattttttgtagagatggggtctcactatgttgcccaggctggccttgctctcctgggctcaagcagtcctttcaccccagcctccccaagtgctgggactgcagggatgagccactacacctggctcttctatgtctt

SEQ ID NO: 93763 - DNA, 601 bp, Human; identical to SEQ ID NO: 34145

SEQ ID NO: 93764 - DNA, 601 bp, Human
gccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaatgtgagttcctggagcttttcctcctttttctccttgcccytagggcccgagctggccaggtgggtaggtcctggaagtgaatgctgtcccaagagtggggagaagtcaaagacaagagatgcaggacagggtcatctgtcagttacctgctgtttcactggcttgggactgctagtgcagggagaagtgtgacactttagaataagtttcaaatatagatatacatatgccgattatatatttattcctcgtgggaaggaactcactatgctttttatatttcaaagctctgctgggtgtgctttaggctttcagtatgcactaacttagttttgggcat

SEQ ID NO: 93765 - DNA, 601 bp, Human
ggaagtgaatgctgtcccaagagtggggagaagtcaaagacaagagatgcaggacagggtcatctgtcagttacctgctgtttcactggcttgggactgctagtgcagggagaagtgtgacactttagaataagtttcaaatatagatatacatatgccgattatatatttattcctcgtgggaaggaactcactatgctttttatatttcaaagctctgctgggtgtgctttaggctttcagtatgcactaacttagttttgggcatttttgtttcataaagtgctgtgtgtatgttgtrttagaagttccattaatattcactagaaaagaggttaaaataattaactttcccaaatctgttgagggaagtgacagtctctcccttaacatcttttttgagatttaagttaaccaatttcccttttcattttatatatcggattttgcttaggagatggcatccagagatggccttgaaaatgatctgtaagaggagaagttctgagtgttgaaatgcactcgctcaaaagaaaaaaatatgatagttggaagcctaaaagcctggtctaatttaatttggacttgacttcccagagat

SEQ ID NO: 93766 - DNA, 601 bp, Human
cactggcttgggactgctagtgcagggagaagtgtgacactttagaataagtttcaaatatagatatacatatgccgattatatatttattcctcgtgggaaggaactcactatgctttttatatttcaaagctctgctgggtgtgctttaggctttcagtatgcactaacttagttttgggcatttttgtttcataaagtgctgtgtgtatgttgtgttagaagttccattaatattcactagaaaagaggttaaaataattaactttcccaaatctgttgagggaagtgacagtctctyccttaacatcttttttgagatttaagttaaccaatttcccttttcattttatatatcggattttgcttaggagatggcatccagagatggccttgaaaatgatctgtaagaggagaagttctgagtgttgaaatgcactcgctcaaaagaaaaaaatatgatagttggaagcctaaaagcctggtctaatttaatttggacttgacttcccagagatatgattttgagaccacttggattataactcttaattgcccattgaataatttcccaggactaggttggatgataaagcactgg

SEQ ID NO: 93767 - DNA, 601 bp, Human
ctagtgcagggagaagtgtgacactttagaataagtttcaaatatagatatacatatgccgattatatatttattcctcgtgggaaggaactcactatgctttttatatttcaaagctctgctgggtgtgctttaggctttcagtatgcactaacttagttttgggcatttttgtttcataaagtgctgtgtgtatgttgtgttagaagttccattaatattcactagaaaagaggttaaaataattaactttcccaaatctgttgagggaagtgacagtctctcccttaacatcttttttgagatttaagttaaccaatttcccttttcattttatatatcggattttgcttaggagatggcatccagagatggccttgaaaatgatctgtaagaggagaagttctgagtgttgaaatgcactcgctcaaaagaaaaaaatatgatagttggaagcctaaaagcctggtctaatttaatttggacttgacttcccagagatatgattttgagaccacttggattataactcttaattgcccattgaataatttcccaggactaggttggatgataaagcactgggtagaactctgatgaa

SEQ ID NO: 93768 - DNA, 601 bp, Human
tcattaacatgagattttattcgtatacgtggaagattgtaaggcaaagtttctcccagttttccttattgtgtttgatactgagataggcagccctaaagtggggcttgggctgtggccttccggttgtcgagtgcgcatgcatttttccttccacagaaaacatacaaccatgtttctgccaacgtagttgaccaagataacctgttttttaatgtaagtaagagaccttcctagtctctgttgcctgttctgctgctgatgcttatggtgtaagcctcaggcaaaaggaaatgacagyagagcagaggggaatgttcaggcctagcatagctgagatgtgtcgggagcagccaactgtcgggctgagtccagggtgctaggatctctatctttttggcaaggagagcaggagccaagagcggagagcaagggtggatagggccccaactgtggtggtcttggactgggctggttgaggcttaccaggctggtccaaagtctgtggccttttgtcagaatctttttcatgagatggggtgtcagtagttagatggagaaggccatatggaattcagagtgcttctgactgttttgagat

SEQ ID NO: 93769 - DNA, 601 bp, Human
ttctaatttctactctaacttttttcccttttgatttgaaaacctcttggggttgtgggattggagaggtatatagggctaagtgttgagaacagggaattaggttagtaatattagtctggctgggtagatgtgagtcctgagacaaagtatgtttctctgctctatctcagctttgtgtgagcccagccagtttgtgccccagtgcctttgtctgtaactcgtatgacaatacttctttggaaagtactccatataattattttgaattctgcttttttgacctaaaaatgacatcagyggatgcgcttgtttcactctcatccttatatgacaccatctatgttctttttcttacatattaatatttgcttgcacagcttttaaattcttgtccagtggataccagctacagttggaaccaaattatacatattttaaaactttgttgttaggcccagtggtattcctaaaataacctgttgtaaagttctggtttagtggtatgtagctgaagttacgtgcgtctattttttaaaaatagaaataatgtggtgaataaactgtgattagcaacacacaacttgctgaaacaacggtt

SEQ ID NO: 93770 - DNA, 601 bp, Human
attgcaaaggacaagttctgtttcacccaagtggtaaaaggcacagtcaaaagaagtcgtgcatttttttagctgtggtaaaaaaaaaatacataacctaaaatgtaccatcttacagttcagtagtgttctgtgtatccatgttgctgtggaagggcatgcatttttatgttgcacgtgctttatgaagactaatagggatcttttttttgaatttctccagtggtattctctgatttgggggtaatatttgagaacagccttatatttttcctcttagcacaacctaaatagaatttgragcttctcctatgacagactctatgtgcaatttattgttggcctggttaagcagctgtaatgttgtgtcattaatacattgattttggccctcttactttaataagctttgccattgcaattaattgtacttaaaaaaaaatcctggcattcacaaagattcagtgaaaggcatcaatttttattactctgatgtttacttctcagcccctccattgggggttttagaactttggactgtgtcttatatgcatttaagagccatgtatttaaatttggagcacggttacataagccacac

SEQ ID NO: 93771 - DNA, 601 bp, Human
gaaaagccttgtgacccttttgaccctactttcttccacctccccttccatcacccattatttatacaggaaaatgggtttgatttttttcttctctgaaaagtgatatttccttatgggaattcagaatgctggagttaagagaagagcctgggctgtatgttattacaagcaagtattgggaagttgaagcaatgtggtcccagttccctagtgtggagtttaggtctgtttaaggtctctcactgtttctatcccataaacctctgtttgtgtctgcttcaatattcccttataaagrtgttttctaagctgaagagttggctgaacagctgagagttgaggtctctttctccctagtaatattctgtatgatctctttgactatatctaggtcataggagtataaaaactagtgtttttgtttagctggggaaggggaattgaatttcttttctcttctcctttctttctttctttcctttttttttttttttttttttttttttgccttgagtgttaagcaagtgcatccagttttaactcattggtcatcttgcctgctagggaaaaaaacattatcaaaccattattgaatacc

SEQ ID NO: 93772 - DNA, 601 bp, Human
gcctcaaatggcaaagatctgagctccactgtggcctgataattttagctcacatttgattgctgatcaatctccattagaaaagtaaaggtcccatataactgggtgccttctcaccacttactttgctctctggggtgtccaaaggactgggaagttataaatattgatctgggagatggatgagtgaatgtgctcaaagttacaaaaatcttgcaaagaaaagcaatgtgtagatactaagtttattccttatgtgtttcaaaaaataaaaataaaaaagcatatcatggaaagctgragtcaggagacctggaacttcatcccaatgtcaccactacccagtcactacccagttacctgatcttgaagcagccttttaatgtttctgggcctcagcttgtcacatgtaaactgagggctttggatttgatgctcagacaagtttctcaaggctctgaagttccctgaagcctcggtcacggagataaggaagtgtatacatcagctgtgaaggaagggcatgatacaaggtgctcggggtctggcagtgtgtgaatctgaagacctttggtgtcagagtgttatgtggaaatgtttt

SEQ ID NO: 93773 - DNA, 601 bp, Human
acctttggtgtcagagtgttatgtggaaatgttttcagtgtctgctctgaactccctcaaaccatgtctttttaaatgtgagctgctaacaaggctagtggcatgttagtactggtctgatgagtccaaggtcacagggtcagtgttcagatgggtcacttagaatcggaacctcagaaagagaaagggctttagaaatgatctgcttcagcctcttctttgcaaaaatcaagggcagtgaagaaagttgccgaaggccgactcattaacagcattgtgggaactagaagctccttctccyagcatccaaatgaatgctgggggcctttgctttagggtgcctcccctccgttctgtgttctcaaacagaccgcctaattctggctcatcattttattaggttggtgcgaaagtaactgtggtttttgccattacttttgcaccaacctaatagaaccaccataaatggggagacaagtttaacatggctaagtctgtgcaaactcatctctgtgagagaccaagtaattgaaaagtgcatgagctactgatctgaaagcaatcatcttatcttcatataggaagaaatatattttctgtt

SEQ ID NO: 93774 - DNA, 601 bp, Human
gcctcccctccgttctgtgttctcaaacagaccgcctaattctggctcatcattttattaggttggtgcgaaagtaactgtggtttttgccattacttttgcaccaacctaatagaaccaccataaatggggagacaagtttaacatggctaagtctgtgcaaactcatctctgtgagagaccaagtaattgaaaagtgcatgagctactgatctgaaagcaatcatcttatcttcatataggaagaaatatattttctgtttagcttactgtgtgtgagtgtgtgtgtgtgtgtgtgtgggttaaatttgaagtgttcctcttctttaggcaattcatacacaaaaaatttgagcttcagagaaaagccttcatgagttggcagcaatgaggtatgctaaccttgggcctgctgggccatctttgcagattggcattagaagaggggcagagcagacagagtgaaatgaaacctgttgcccctggagtctttgccacagtcgggggtgcttatgtaagtggagaaacccgcagccctttcgatgaggtctgtgttagctgccctgaaagacctgtggccagagagtacttattattcccc

SEQ ID NO: 93775 - DNA, 601 bp, Human
gcattagaagaggggcagagcagacagagtgaaatgaaacctgttgcccctggagtctttgccacagtcgggggtgcttatgtaagtggagaaacccgcagccctttcgatgaggtctgtgttagctgccctgaaagacctgtggccagagagtacttattattccccgacttctttcttccccctgacttctcaatgcctcaagattgatgactagtctcagtggctgagccagtgagcaaacttcaggattattggctcccatccaaaattcatccagctaccattttatgtgttgttygtgttctgctctgagacctttccaggaaaagcacccttctgagacatatttttggttgcatgaagatttgctcccatgggacgtgaagggccctttacagacatctgcttatttaggtttacagcctcactctgaagaaggtggggaggttttggcagcctctgaggggctgtgaggtttattagtttgcctgggccccttggtaaagcagagcataatttaggggtaggatcctatctaatgtctcatttagggctctgtctactccaaccttggtgcccaaatttgacctcgagagcc

SEQ ID NO: 93776 - DNA, 601 bp, Human
gaagatttgctcccatgggacgtgaagggccctttacagacatctgcttatttaggtttacagcctcactctgaagaaggtggggaggttttggcagcctctgaggggctgtgaggtttattagtttgcctgggccccttggtaaagcagagcataatttaggggtaggatcctatctaatgtctcatttagggctctgtctactccaaccttggtgcccaaatttgacctcgagagccaaggcaattctaggagaggtctagagatttgaattcatgttcacagattaaacttcatgcartgggaaggaggtgggctggtgcttcatcctctgtcttccccacccctatcctcttctcctgttcagctcctgagcagtctgatatatattgtgaagagataaatgatttggttgcctttggtaatatggcatcttcttgtacaaaataaaactgttaataatcacacaccatttagagttcctttttttatgtcaaataaggacaaattgctacttagcatcccatcctttcctgtaatcttcatatcccaagaattgtctacacacacacacatagacacacaccataatgttgtatgt

SEQ ID NO: 93777 - DNA, 601 bp, Human
tgttaataatcacacaccatttagagttcctttttttatgtcaaataaggacaaattgctacttagcatcccatcctttcctgtaatcttcatatcccaagaattgtctacacacacacacatagacacacaccataatgttgtatgtgtgtaccgtgttttcatcaatacataaatctgtgtataaaactctgccatgtgtaatttgttcaacttaattatcttgagttgtaaaattttctgaataattgagaatgtgcttccctaaaccactattttaattttgtttttatcattctgratgtcccttggccaggatctggttgggctgtcttctttgagagaagtacttgagcattagtgcattgaccctgttagccgacctggtcactcagagacccactgtgtctatcttctgattctttgatatcttctcaacataaacgaacaatgtaaacaaaattgaaaggtatcggaattttggtttcaacctctgcaatatagtgcaatttaaaaagaaaggatcttctcaacgctaatctttgtaacaagagttgtttctacttcatgtaccccagagtcccttgctgtgaggtggcag

SEQ ID NO: 93778 - DNA, 601 bp, Human
aggatctggttgggctgtcttctttgagagaagtacttgagcattagtgcattgaccctgttagccgacctggtcactcagagacccactgtgtctatcttctgattctttgatatcttctcaacataaacgaacaatgtaaacaaaattgaaaggtatcggaattttggtttcaacctctgcaatatagtgcaatttaaaaagaaaggatcttctcaacgctaatctttgtaacaagagttgtttctacttcatgtaccccagagtcccttgctgtgaggtggcagaggggcctatgccygaattgtctgactcttgctcactgtgtggcaagtgacctctcttttctgggcttggcttattcctctgtgtgatgcatgtgtaggggtggagggtgctgggcaagagagcttgacatcatagcccctagattccctggtaaggtgtgacaaaaaaacacacaactatggtgaaacaaaacaaaacaaaacaagtgtctttctccaaagaacaaaacaaaaccccaaaccagaacactctttttagtttactcccaattttacttcaaaaccctgctgctaccacccaaactcaaagaatg

SEQ ID NO: 93779 - DNA, 601 bp, Human
agcctctttctgtttctggtggtgtttcttatccccttctcctctgttcccaaatcacagacatatatatacaaacaatcatttggctgtaaaccccctttaatggattgtaaagaaatcttgacttgtgtacttttttctggtggacgacctgtgggcagaccatcattgtttcaactgaacctggcttggtaaggttaacacagtgggaaaggcgacaaagtataggaacgtggtataactgaaaggagcgctggttagggatctaggattttggatacccactctctgacagtatcarggtctgggattttggttgagccacttgacctcaccagcctgactgatttcatcttgaacctggaggctgtgacactcatgcatgctactccttgaaagactctgtggttctgaatcagtcagccatgagcactagtgtttccttttctgttcaagaattcaccattgccttcactccaggggcaaacaagagcctgcttcagttcttttggtggctaaacagcagaaacctgaccagtaggttttctttaagtccagctctgccgttgaggctggatggttttgcaggtcaccagcttcc

SEQ ID NO: 93780 - DNA, 601 bp, Human
cacagtgggaaaggcgacaaagtataggaacgtggtataactgaaaggagcgctggttagggatctaggattttggatacccactctctgacagtatcagggtctgggattttggttgagccacttgacctcaccagcctgactgatttcatcttgaacctggaggctgtgacactcatgcatgctactccttgaaagactctgtggttctgaatcagtcagccatgagcactagtgtttccttttctgttcaagaattcaccattgccttcactccaggggcaaacaagagcctgcttcrgttcttttggtggctaaacagcagaaacctgaccagtaggttttctttaagtccagctctgccgttgaggctggatggttttgcaggtcaccagcttcctgccatcctgggtgacagcccttccatggtttcccaccaatagaaacaaatttttatttttttccctgggagtagtgttcaagactttttcagcccattcctggcccacttctgtggatgaggctctggcaagttttctaactgacctctttggttagtctctgttttctgtgacccccaagagcagaagctttcatggac

SEQ ID NO: 93781 - DNA, 601 bp, Human
ccatcctgggtgacagcccttccatggtttcccaccaatagaaacaaatttttatttttttccctgggagtagtgttcaagactttttcagcccattcctggcccacttctgtggatgaggctctggcaagttttctaactgacctctttggttagtctctgttttctgtgacccccaagagcagaagctttcatggacatcaaatcttatttttctgctcatcaagttgtcttttcatcttggtggaatagtttgtcacatttcctgattgtcatgtgggtgggctgccatcatgcaaamagtagttcagtgtcactagtgttattgaggacatggagatgtccaacaaacagggtactctgcagaggcaaggagcccctgagcagcttatatctagcaagagacagatgcatacacatctaaacactcccaatagtgggaagcattgatgtgtagatgggatgtgagtaattcccaatccttacttcctatggtagcagtaatccagctgagtttcattattttctctctgtcaaataatttttgatattcctggggccacctccactcatactgcattagagtaagctgcaacttgca

SEQ ID NO: 93782 - DNA, 601 bp, Human
agcagaagctttcatggacatcaaatcttatttttctgctcatcaagttgtcttttcatcttggtggaatagtttgtcacatttcctgattgtcatgtgggtgggctgccatcatgcaaaaagtagttcagtgtcactagtgttattgaggacatggagatgtccaacaaacagggtactctgcagaggcaaggagcccctgagcagcttatatctagcaagagacagatgcatacacatctaaacactcccaatagtgggaagcattgatgtgtagatgggatgtgagtaattcccaatycttacttcctatggtagcagtaatccagctgagtttcattattttctctctgtcaaataatttttgatattcctggggccacctccactcatactgcattagagtaagctgcaacttgcatctgcaaccagttacgatggaagggctggagcgcctttcagctgaagctaatcactcaacctcgagcttttttctatcagcaattttccctctctcacatacctgtattttctgtttctttctattgttccacattttaagataagaattgaagcaggttcatgttcctcccatcttaga

SEQ ID NO: 93783 - DNA, 601 bp, Human
aaacccattgccagtgttccctattgtaatgaatggcaccattatccactcagtaatacaagccacaaaccgtgactcttccttctctgtaacccctacactcattcacatattacgtcttgtcaatccattttcctaagtatttcctaaatctaatttttaatatttccactgacattattcaatcattctttcaacaaatattgattggggtcttctctatgttgggaactagctaggtacatgggatatggtgagaaaaactgccctggtctcttcttaccgggcttgcagtgtgtgkgagtgggggatggggaacaaacatctaataagtacttaacataaaaacaatataattcatgccatcatcatcttttgcctaaaatgctgcaatcgcttcctatttcgcatccccgcctccagtcttgtcccctctctgcccatacgccacactgtagctggagcggtctatctgaaatgctgatcttatcctgtcactgcttataattaccctctggctcccagtgtctcttaaaataatgcctaaagttgtttatttttgtttcagtttttaaagaatagaacaaaattgtcactatat

SEQ ID NO: 93784 - DNA, 601 bp, Human
gtcactgcttataattaccctctggctcccagtgtctcttaaaataatgcctaaagttgtttatttttgtttcagtttttaaagaatagaacaaaattgtcactatattgctatataaagaggcatataactattacatggaccagaatgcacagatcagcataacagtctttttctacaccagcagctctataaaaaagaacaaattataactggaagcttgcttggtgatcttggaattagagcaagggcatttaattttgcatttaaaatgttaaatggcattaagctaagcttgccygaggcatccatctccataatgggagagccttcacaaagggaatgtagaacttgaagtactttggcccagacttgtatcccctggatggacactccttttcctctccttcattcactgcccaacaccaatgctgattgatgtattctttctttggaaaggttagtgcctttaaccaatgcttctcatgtctgggagcctttcaaattccttaaagtgattttgcacatcttctctctgaaatgcattaactttattgtatggaatttagctggtaattatattttttaaagtaatatttga

SEQ ID NO: 93785 - DNA, 601 bp, Human
tctataaaaaagaacaaattataactggaagcttgcttggtgatcttggaattagagcaagggcatttaattttgcatttaaaatgttaaatggcattaagctaagcttgcctgaggcatccatctccataatgggagagccttcacaaagggaatgtagaacttgaagtactttggcccagacttgtatcccctggatggacactccttttcctctccttcattcactgcccaacaccaatgctgattgatgtattctttctttggaaaggttagtgcctttaaccaatgcttctcatgyctgggagcctttcaaattccttaaagtgattttgcacatcttctctctgaaatgcattaactttattgtatggaatttagctggtaattatattttttaaagtaatatttgaaagtgatcagaaatgcaagcagcgcaaaggagtgtaccatgaatacactttgtaactcttgttacaaagagtgtaccttcactctgaagaagttggggaggttttggcagcctctgaggggctgtcaggtttattagtttgcctgggccctttggtaaagcagagcatagttagggataggatcctat

SEQ ID NO: 93786 - DNA, 601 bp, Human
tggtgatcttggaattagagcaagggcatttaattttgcatttaaaatgttaaatggcattaagctaagcttgcctgaggcatccatctccataatgggagagccttcacaaagggaatgtagaacttgaagtactttggcccagacttgtatcccctggatggacactccttttcctctccttcattcactgcccaacaccaatgctgattgatgtattctttctttggaaaggttagtgcctttaaccaatgcttctcatgtctgggagcctttcaaattccttaaagtgattttgcayatcttctctctgaaatgcattaactttattgtatggaatttagctggtaattatattttttaaagtaatatttgaaagtgatcagaaatgcaagcagcgcaaaggagtgtaccatgaatacactttgtaactcttgttacaaagagtgtaccttcactctgaagaagttggggaggttttggcagcctctgaggggctgtcaggtttattagtttgcctgggccctttggtaaagcagagcatagttagggataggatcctatctaatgtctctcttagggctctgtctactccaatctt

SEQ ID NO: 93787 - DNA, 601 bp, Human
ctccttttcctctccttcattcactgcccaacaccaatgctgattgatgtattctttctttggaaaggttagtgcctttaaccaatgcttctcatgtctgggagcctttcaaattccttaaagtgattttgcacatcttctctctgaaatgcattaactttattgtatggaatttagctggtaattatattttttaaagtaatatttgaaagtgatcagaaatgcaagcagcgcaaaggagtgtaccatgaatacactttgtaactcttgttacaaagagtgtaccttcactctgaagaarttggggaggttttggcagcctctgaggggctgtcaggtttattagtttgcctgggccctttggtaaagcagagcatagttagggataggatcctatctaatgtctctcttagggctctgtctactccaatcttgttgcccaaattcgacctcgagagcccaggcaattccctcccaccatgtactcccaccctctaaaatccctcagctcccctctccaataacaaccactgattttattttgtgtcggtcccctttcagaaatctttgtcttacatatatagcacatatataggtcttt

SEQ ID NO: 93788 - DNA, 601 bp, Human
gtgatttgtgtgtgtgtgtgtgttttcttgttgcttattttactttaagttccgggatacatgtgcagaatgtacaggtttgttacataggtatacatgtgtcatggtggtttgctgcacctatcaacctgtcatctaggctttaagccccacatgcattgggtatttgtcctaatgatctccctccccttgccccccaacccctgacaggccctggtgtgtgatgttcccctcctgtgtccatgtgttctcactgtttaactctcacttatgagtgagaacatacagtgtttggttttcygttcctgtgttagtttgctgagaatgatggcttccagcttcatccatgtccctataaaagacatgatctcattcttttttgtggctgcatagtatttcatggcatatatgtgccacattttctttatccagtctatcattgatgggcattttggttggttccaagtctttgctattgtaaatagtgccgcaataaatatatgtgtgcatgtgtctttatagtagaatgattaataatctttgggtatataccctttaatgggattgctgggtcaaatggtatttctgagactagatcctt

SEQ ID NO: 93789 - DNA, 601 bp, Human
tatttctgagactagatccttgaggaatcaccatgctctcttccacaatggttgaactaatttacactcgcacccacagtgtaaaagcgttcctatttctccacagccttgccagcatctattgcttcctgactttttaagaatcgccattctgactggcatgatagtatctcattgtggttttgatttgcatttctctaatgcaatgatgagtgaggatgatgatgagctttggttcatctgtttgttggccacataaacgtcttgttttgagaaatatctattcatatcctttgcccamtttttttatgggttttttttttcttgtaaatttgtttaagttccttgtagattctggatattagacctttgtcagatgtgtagattgcaaaaattttctcccattctgtaggttgcctgttcactctgatgatagtttcttttgctgtgtagaagctctttagtttaagtagatcccatttgtcaagtttggctttcgttgcaattgcttttgatgtcttagtcatggattctttgcccatgcatatacctgaatggcattgcctaggttttcttctagggtttttatggttttgggttt

SEQ ID NO: 93790 - DNA, 601 bp, Human
ttgtagatgtgtgatgttatttctgaggctcagtaatatttgtgatttttaagtaaatattgccaagttgttttgcaaagaggtcacatcattttgttctcccacagaaactgggagtgtctgctttcctacaattaaggcagtactatttgtcgttgaacttttgttatcaaaccttttgtcctttgtcaaccagtttcctgagaaatagtacctcaattgctgtattttgcgattatgtaattatgattcagattgaaagtcttttcgtatgtttgtaagtcattggtattttttttcygtgaacttagcccttttcttttttaattgaattgatggccttttcaaaaaataataaaatttgtacttcacctaatgttttgcttgtcttctaatgtcagttaaggattatgatatttcttttcttctcctccttctcttcctcctattttgtgaagcagaattaagtttttttctagtaaagcttattttttttttctatgttgtaggtgtggctaagaagattattcccttttctaagagtataaaatgagcaattttatattttcttctactacttttactattatatgtttttact

SEQ ID NO: 93791 - DNA, 601 bp, Human
tatattcataatacgtatacaaatgaaagtggtttagactccatgtgtatttgaaaattaaattttaaaaaatgaatgggaattatgtatttgacgggtttttttcctttttttgtggagacagggtttcgccctgttgctcaggccggtcttgaactcctgggctcaagtgattcacctgcctttggcctcccaaaatgctgggattacaggtgtaagtcactgtgcctggttttggaatgggaattatggaaccaacataaaatgtttaactctgatgagaaaagtcttatttttggarttgagtcattggctctcacgataagcctaggtgaccctctaggatttaacttcttggctgtctcatttgtctcatttgcacaaatctttctcattagacctatttttgtttgttggagatcaggtaaccctggagtgattattttcccctggattttcctctattgcggaggaattgctttcccaccaataaaaagtgtcttctggagcttaaattcctggtgtcttgagggtactatagagcctcttacttacccagtctacactagaatccatgtggtcattaccatcctttgattgc

SEQ ID NO: 93792 - DNA, 601 bp, Human
tcaagggcacaaacagagcccccagtcagatggccctacctttctctctccccaaaactacaagggacctcataggcaggtgcatggacagttcggcctacacacccaaactctatcaacaccaccatagacatcaaccttggacctccccctttcccttacactgctgtacctggtgtgtgcatatccatggcttggtgcaccctcaggaagatggatccaaggaaaaggcctgctcaggccgtaggagtggactcagggtctttgagtagggaattctgggatcctggggaagggtgaratccaggaaggagcatcctattggctctgtggactccttgcctcatgtggaagcacttgctgaaggagaacagagtgatggactccaaaggacctgggcccaatgctcagggctaaaggtgccatggaccaggctgatcggccctttgcattgtggacctggcctctgcctcattgtgcttttgtgctatgacgatgatgctctggatcagggcaagtgcagggcatatgtcctgggagtgtgtaggggggtggccaggctcttcagatggttcctacacttcagtgccccaccctctct

SEQ ID NO: 93793 - DNA, 601 bp, Human
ttggactagtaactaaagctttcatgtctcagtttccccatctggaaaagtgggcaataatagaaaaatagaaaagcattactgtgaggttaaagtgagctgatgcatgtagaatgcttatagcagtgcctgacacacagttcgcactctgctgttagcttatatgtgtgcgcatgtgtggagctatcttcaaatatgattcagaggaaactactctgtgaggttgggaggactgaaaagcaaaagactctgccttgagcatgacactgaacagcctgaggctaagaggacagatgtaaayggcgctggttcccttatggcaacctttgcatgccctttggcttgtctgtgcattactctcatcgtgtaggacctggtgtgcttagctgattgggacattaaccattcgtgtgctgagcgatcacaagtgagatttcatgactgttattcaggtcattgtctttgttctgtgactttggtttctttgatggtcctggtctattttattggtcaggttgtttattaacagtcctcctggactctgggattgtcagtcattttctcttttatttttctccattttctcttttaactgtccttt

SEQ ID NO: 93794 - DNA, 601 bp, Human
ctgtgttctgctgtgattcgtgatgacttgaatgctttttagaattcttacagtccaggcgaatcattggagattcttcttcaagagtcataaatgggaaatgtattggcttgaaagaacagggaaagaggaaaagacattttaaaaaatgataatttattacaaaaaaaaacattagctgggcatggtggccggtggtggcaggcgcctgtggtcccagctacttgggaggccgaggcaggagaatggtgtgaacctgggaggtggagcttgcagtgagccaagatcacgccactgcacyccagcctgggcgacagagtgagactccatctcaaaaaaaaaaataaaaaaaatgataatttatatgttagattgaagtttcaagattttactttttaatgagcattcattctgaaattttaataaatcatagatgaaactacttactaacccatttcttgaaaacaactagtatagagtaattctatagtgtcagcatattgtacataaagaccatttaatttttatggaatgaatgttaaaaatgtcacaatcagtttttcatcagtatttgaataactatttgaattataattatttt

SEQ ID NO: 93795 - DNA, 601 bp, Human
atgaattagctgcagagggcaccccaagtcgctgaatgagctgacttgtgtttctgatggtttcatattgaccgatgttagagtacatctgctccaaataaaaactgtggcttaaacgtcaacttttaagccatttctattttttggagagtagttcagtgtcatttttgtcctggtactcttcatggtttaatatggtaaattggtgccatggtacctgttcagttattgtcttcccatcggctgtcgtggattactgtgacctatgaaagatctgagacctaatgtaaaatatacaatkatattaattaaatacgttggaagaaaaaaaattgtcagaaaaaaacccatcccttgcttctcctgggaattgtatttaccattataccaactatcaaattaccttggctatgtctgtgcaagtattagttcatttttaacaacagaagaagtttgcaaagtttccagaacaggtaaaagtaacttaaagacattgtcaatttttaattgtagtttctgtgtcattttacacacagtttcttttcttttcttttttttctttttttctttttttttttttttttttgagacagagtctcac

SEQ ID NO: 93796 - DNA, 601 bp, Human
gggtagcaggaaacgattccactttgaagagtcaccatttgaaatattcacagctgcttccatttcattttgatgtgttgccaaagtacagttcaggtaataaagtctaggctaaaggggaatttttcttttgagtaataccactattaagctaatatgcttaaagacaagatgcattagatactactccttgttgcttgaagagattacctagaggaattatttgataggttgttaaagcaaatgtgaaaccttttaaaatgtaatgaggaccctttccagggaacctgtaagtcaaaartatttctgtgaattttctctaaaattacctcttttctcttattttccaaaaagccagctataagctttttgttaagccaaagaagaggaaattctttaccctcagaaaaatgtcttagtaaaggtcctgaatgtcaaattgagactggagaagatttggtgacaacacaaaacaagatgacaaatagcatgtactgtgtttatgttctaattctttatccactttccgatcactcttcaaagcttgagctcaatgccctttctccttttaagccttcactgacctgcccaattatttaaa

SEQ ID NO: 93797 - DNA, 601 bp, Human
cttcttcttaaaaccttttctttttggctcatcatatcctgtggcagtgtccactgtctctccttagagcatcatctccttcaagataaagaattgctggatttgaagaatcatggaggccatttctagtcttacattcctcacatgttggggttctgtggcaaatgaatgcttatctgctgagggcaattattattattattttagacaagatcttgctctgtcacccaggctggagtgcagttggcgctatcatggctcactgtagccttaacttcttggactcaagtgatcctcccayctcagtctcccaagcagctgggaccacaggcacctgccaccatgcccagctaatttttaaattttgtgtagacagggtattactatgttgcccaagctggtctcgaactcctggactcaagcctcctgccttggcctcccaaagtactaggattacaggtgtgagccactgtggctagctggtttttatcacttaaataaataagtaaataagtagtgggtttgaatatgttgtgttcttgtaatctaaattagcttttagattggacaaatttggggttccaaatcagctttccacccc

SEQ ID NO: 93798 - DNA, 601 bp, Human
tccaggtggaggatcagtttgggtgccctaagtgagcagacattccttgagcatcagctctgtgctaggaaacggagatcagtgagatgagatgaggagctagcaattcagttatggggtcaggtagactcatagaaaaataaaattgagggtacaaagagtacctcccattgctctaattcttaattgcaaacttacaagtgcaataaatgctaaaactgcatgccaaccgatggaataaaaatgttctgattggaaaaagcatttttggtgttgtgtctacaaatcactcaagcagtcktggagggtcctgggatagatttagatgagtacattgataagactctatcatataagatccaatctttagggcaatagttaatgaccttgggatgtagtaaatgtgcaaaaaataacagcaaaaactgccctcataatatgaggtcctagcaagagtcctgtatatggacttggtaagggaggaaggcacattctgggcagaacaggatggttgaaggccaccaatgattcctggcagattattaataaaggttgagggccagggaccctgagggactgacgaggtgagagaaattcctaa

SEQ ID NO: 93799 - DNA, 601 bp, Human
ccctttcttgcttgctgtctctttcttttcttttttcttcataaattttaaaaattcaaaaaagtataatgacataataactttatataattacattcagaaataatagttgaatatttttaagctattttttcttttaataaaatagtttagcagtttaataacataaatggtataaatagtttctgtgtatgtgtgtgtgtgtgtgtaaccccagacccattctcctttcccaaggccaccttccttggaatcatctttctatacttggcatatctacttgactgtgaacactatgtgrtattattttttgtgtatttttaaaagttcacacagattgttttatgttacatgtacgtatcagtatacaattttgcttatcttctttctcacttcgcatagcagtgtctttctgttcaaatatgtagatctgatttaatctaatatatatatatatatatcaccttattttaaacaatgtctatttctttatggatggacactcgggttgttccagcttttgactctatgacaatgaatgttgtaatattctactgatcatattacaatgactcttcttgagtccatatgtgagaacttc

SEQ ID NO: 93800 - DNA, 601 bp, Human
tttaaaaattcaaaaaagtataatgacataataactttatataattacattcagaaataatagttgaatatttttaagctattttttcttttaataaaatagtttagcagtttaataacataaatggtataaatagtttctgtgtatgtgtgtgtgtgtgtgtaaccccagacccattctcctttcccaaggccaccttccttggaatcatctttctatacttggcatatctacttgactgtgaacactatgtgatattattttttgtgtatttttaaaagttcacacagattgttttatrttacatgtacgtatcagtatacaattttgcttatcttctttctcacttcgcatagcagtgtctttctgttcaaatatgtagatctgatttaatctaatatatatatatatatatcaccttattttaaacaatgtctatttctttatggatggacactcgggttgttccagcttttgactctatgacaatgaatgttgtaatattctactgatcatattacaatgactcttcttgagtccatatgtgagaacttctcttggatgaatacctggaatagaattgctgggccctgaagggttc

SEQ ID NO: 93801 - DNA, 601 bp, Human
tagcagtgtctttctgttcaaatatgtagatctgatttaatctaatatatatatatatatatcaccttattttaaacaatgtctatttctttatggatggacactcgggttgttccagcttttgactctatgacaatgaatgttgtaatattctactgatcatattacaatgactcttcttgagtccatatgtgagaacttctcttggatgaatacctggaatagaattgctgggccctgaagggttctgatttataattttccaagatacaggccaagtgcttttcaaagtagttataayaatttacacttcctccaacaatttcagagaaatttcatcacatccatagaaatgttttacattgttagactttaaacattttgtcaatctagtgggagaggaataatatgtcattgttattttaatttacatttcacatttcttgggagataagcaacttttcatgtttcttggccaccgaagttttccctctgtgaattccctgttattcaccttactggcttcttttctaaccctatgatttgattcttcacttagtggtagctaaggagagtttcttagggggtagatttcctgagc

SEQ ID NO: 93802 - DNA, 601 bp, Human
ttggcctttccatcttgacaagaagaaaaatgtatttatttatccagggcattcttgcccccacagtagaagcgtattctctagtgaccatttttcataacttcttttgatggtgcttttgaatggttttcagcaaaatttcctgtctggtcttagatttcagaatagtggtgctttgcttaattggctcattttcatctcatgaatactgtgaatttaccattgaccaaatttatcctcatctccttctttcttggacactggtgactagaaagcatagaattaagcttatgtgtgtgtktttttttttttctaacgagtgtatgcatttctaaattgaattccgggctccgttgatatctctttatttttaatttatttttatttttaaattgttttttttcttttttttcccacatagttttgtgcaatccattgacatctctacccctgtctttctctcctctatgccttccatttttatttgctggttcgttgtattctattgaataaaaccggggagtttataaattaaatgtctgatgaaaaatgaaaagaaagggcataagtaacaaaaagttaaagatgagtgccttgtgca

SEQ ID NO: 93803 - DNA, 601 bp, Human
atcttgacaagaagaaaaatgtatttatttatccagggcattcttgcccccacagtagaagcgtattctctagtgaccatttttcataacttcttttgatggtgcttttgaatggttttcagcaaaatttcctgtctggtcttagatttcagaatagtggtgctttgcttaattggctcattttcatctcatgaatactgtgaatttaccattgaccaaatttatcctcatctccttctttcttggacactggtgactagaaagcatagaattaagcttatgtgtgtgtttttttttttttctaacgagtgtatgcatttctaaattgaattccgggctccgttgatatctctttatttttaatttatttttatttttaaattgttttttttcttttttttcccacatagttttgtgcaatccattgacatctctacccctgtctttctctcctctatgccttccatttttatttgctggttcgttgtattctattgaataaaaccggggagtttataaattaaatgtctgatgaaaaatgaaaagaaagggcataagtaacaaaaagttaaagatgagtgccttgtgcagatcataataa

SEQ ID NO: 93804 - DNA, 601 bp, Human
ataacttcttttgatggtgcttttgaatggttttcagcaaaatttcctgtctggtcttagatttcagaatagtggtgctttgcttaattggctcattttcatctcatgaatactgtgaatttaccattgaccaaatttatcctcatctccttctttcttggacactggtgactagaaagcatagaattaagcttatgtgtgtgtttttttttttttctaacgagtgtatgcatttctaaattgaattccgggctccgttgatatctctttatttttaatttatttttatttttaaattgtyttttttcttttttttcccacatagttttgtgcaatccattgacatctctacccctgtctttctctcctctatgccttccatttttatttgctggttcgttgtattctattgaataaaaccggggagtttataaattaaatgtctgatgaaaaatgaaaagaaagggcataagtaacaaaaagttaaagatgagtgccttgtgcagatcataataaagtccccattgagttccaggcccttgttgtgagcatggaggatgcaaggataatccaggaaaagagtgaggaagaactctcaatg

SEQ ID NO: 93805 - DNA, 601 bp, Human
gtgtggtgggaggagagaagggaacgaaagcttcctgcacatttattaagtgtgccaggccctgggtatcagggacaaccaagaattttttcagaagaagccgccgttctatcttggaggctggttttttatgtaacaggggacaatgtttgtgtggatgcttttaaaagtatttctctttggtgtaattttgtcttctcagagaatctactgatttttatttttaaaatttattttctaaaaagaggtgcccaaacccttactatacagcttgtcatcattttctttcacacagtggggracctatagatgctgtgtgttcctccccatcatttaatatttttttcattttaactcacattgttaacagcagggctgcatatttgttttcagtgtcttaattggaatatgttatatatcttaaattttttcaaaaagaaaggggagatttcctcctggcataatttcttgtaatgcctttgtaactccaagtgcagttcatcttttctccatctgtccatccatccgtccatccatccatccatccatcctttgagtacctaccttgtactgggtactgagccaggtgctgtgatgcata

SEQ ID NO: 93806 - DNA, 601 bp, Human
aaatttattttctaaaaagaggtgcccaaacccttactatacagcttgtcatcattttctttcacacagtgggggacctatagatgctgtgtgttcctccccatcatttaatatttttttcattttaactcacattgttaacagcagggctgcatatttgttttcagtgtcttaattggaatatgttatatatcttaaattttttcaaaaagaaaggggagatttcctcctggcataatttcttgtaatgcctttgtaactccaagtgcagttcatcttttctccatctgtccatccatcygtccatccatccatccatccatcctttgagtacctaccttgtactgggtactgagccaggtgctgtgatgcatattaagaattataaaacagatctagctatctcaaagacattgtgatctaagaaaactgaatagacaggtacttaaataactgtagtacagggtagagtataggaaattccatgatgatggttttaatagctatttgtttggatcactagggactttactgattgcaaatgatagaacttaagattaacttaggttagtgacatctagcctgagagacagttgtatct

SEQ ID NO: 93807 - DNA, 601 bp, Human
ccaggaaaatagagagaaaagaggaaggggtagggaaaacgcaccttagtattttaggaggtaaaggagggagtggctgtctctcttgaaatgtggggaaatatgtgacttttcttgtgcagtgatgacagcagcatctctgtggctctcaccgtaagagtggaaacacctttgagaggagtagatgcatttccacggtgttttcacatatgtacactggtgatactccaaaagggaaagaaaagtgaaattgttgggtgaaagagtgatgaaacacgaggagaaatgaaacccagtgcawgggttattgaccatgaaacctggtcagtcatggtttctgctcagtcatgctcagttttgctctactgctgtatttaaaaaaatggcaaggctcagagtggtgtggagggagcaccttggacacctgggtgaggtggatgggagttcttcatggtgctgctgcctacattctgagtcactgcgattcactctctgctttgttacagtttcatcgcaaaccagaaaaggttagaaatcatcaacgaagatgatgttgaagcttatgtgggactgagaaatctgtgagtactcaggaccaggg

SEQ ID NO: 93808 - DNA, 601 bp, Human; identical to SEQ ID NO: 34146

SEQ ID NO: 93809 - DNA, 601 bp, Human; identical to SEQ ID NO: 34147

SEQ ID NO: 93810 - DNA, 601 bp, Human; identical to SEQ ID NO: 34148

SEQ ID NO: 93811 - DNA, 601 bp, Human; identical to SEQ ID NO: 34149

SEQ ID NO: 93812 - DNA, 601 bp, Human; identical to SEQ ID NO: 34150

SEQ ID NO: 93813 - DNA, 601 bp, Human; identical to SEQ ID NO: 34151

SEQ ID NO: 93814 - DNA, 601 bp, Human; identical to SEQ ID NO: 34152

SEQ ID NO: 93815 - DNA, 601 bp, Human; identical to SEQ ID NO: 34153

SEQ ID NO: 93816 - DNA, 601 bp, Human; identical to SEQ ID NO: 34154

SEQ ID NO: 93817 - DNA, 601 bp, Human
atacccaattgtggtaatttatttttaaatcaatgtgttctagttgctattaattattctcattgccttggtgcggtagtctgggaaaattaccactacctggattgtatatagtattctgttgatgtctccagtgactcagacaacatttatgtgcagtgtggagtaatctttgcaagtagaatattaattcagagtggatggctgtaaagtgcatagagaaaaagtacactgcttattctttttgtttgtttgttcatttgcttatttgttcatatttgtttttccatctatccatccrtccatttatccacccatccatctgtgcaaaaactatctgctaaaagtgtggcacttctctggccacatatacccttggatggcacccaggccaaggatctcagggtgatgaaagtgtcctggcagcacaagcaaatccaattcaatccagcacattcccttaaacttgtcttactgccagaggtctgtgtctcttgatggggtgccccaagtctgccatgccacgtgcttctccccatgtctggatttaagatctcctactttaccgtcatcccctattcctcttcccagcgttttcatc

SEQ ID NO: 93818 - DNA, 601 bp, Human
tgattgataagagggtaactgttctctgttctggtgcaaatttgtactgctgagagaaattgcctagagggacaagaaattcaatgttgagtcacctggccttttggccagctcccaaatccccatggcagttgtggccacattggttcagcaaccactgagaggaaaagagagaaagcatctgactcttgctctgatttcacaaactgcctcttaacagacgtctgctttgtccttgcctgaaaccaatttcatttttttccattgtaatttttggttgtgttgtcttggcagcattccrggaatgcaccccgccttacgtgttattgctcggccattgtgattgggataggggacgtgtagggagtgaactggtcctcatttttcctaaacagtttgtcaattttcagtcattttttatttctgttttctacaaattagtcaatgaattgtgtgtctaagagtgaggttttgaatctactgtaatgagggcatgggctcaattgatcgattaggactgaatggttacattcacggtaacattcacaattcatttcaatgtcaaggatgcttttcaaaaagcaacattatagaagagtgt

SEQ ID NO: 93819 - DNA, 601 bp, Human
tttttataattgcatgtattatattgatatgtcttgttgcaaaagtaatttcctacattacacatatgatgtttgtctttttcttgcctaaccatttctcctaaccatttcaggtcagtagtcatagatctgtcatattctttttaaccattacgtgaaattcatgatacaatgtgtcttaattaattaagtgttccatattgacgagcattttgcttattttccattttttcaatactgcaaaaatgtttcagcaagcatccttattcatgctttttacacatatgtacaagtgcaaagktttttctagaatacacagaaagaagcagaattgttggtttatgtggtttgcacatgaaaaaatggctgtatctatttatgcccaccctaacaaggtataccttgatattagcaaacttgttagtgtttgtctttctaaaaactgctgtcatggcttttgagtttgcattttcctgattactattgagtatcttatatgtttattggactgtgtttatgcttcagtaaatttcctgtttatatcctttgtctatttttctgtagggtttttctgtttctttactttcattgttctttgttt

SEQ ID NO: 93820 - DNA, 601 bp, Human
atatttttgcttccctttacttctcctcccagctctcagtttgttatcatctgggattttatttttgtattgttacctggcttttttgaagatgtcatatttctttgtatatcatagacttttgtgtcttactgtgttcttttggtgtgattgttctttttgctggagtatatcttctaatacttctttcatagaaattaaaaaaataaaatcaagttcttgggtggtgggaaattggcctgtattttttcttctcagtggaatttgctgagtaaaaaattataggctcaaaaactgagarctttgaagatattgcaccatattctttttgtattgagtgttgctgatgagaagtctgaggtcagtctgttgcttgctctttctaggtaaactgtgctttttatattttttcccctctagaggttttgagaatttactccttatccatgttattcttaaatttcaccacaacgtaactagatgtgggtttttttttttttaattctgcttattgtgagggataccttttcaatgtgtgggttcatgtcttcagttctggaaaatttttcttattgatttgctcaatgtattctttccattt

SEQ ID NO: 93821 - DNA, 601 bp, Human
aggctcaaaaactgagaactttgaagatattgcaccatattctttttgtattgagtgttgctgatgagaagtctgaggtcagtctgttgcttgctctttctaggtaaactgtgctttttatattttttcccctctagaggttttgagaatttactccttatccatgttattcttaaatttcaccacaacgtaactagatgtgggtttttttttttttaattctgcttattgtgagggataccttttcaatgtgtgggttcatgtcttcagttctggaaaatttttcttattgatttgctcwatgtattctttccatttattctttcattcaggaatcgacattggatagatatttacacttttggctccacccatgctggccaccctttccttagtagtttccatctgcttgtccttgtgtaccgcattatgggagaattggtttgctcattacttagcttttcagctgtttctccagctgctgattttttttcctttcaaccactgatgatcaatttccacaatctctcgtgagtcattttttttgtgactgaaatgcccttctccatacggggtttgctacatcagcagggagtcctgc

SEQ ID NO: 93822 - DNA, 601 bp, Human
gttgcttgctctttctaggtaaactgtgctttttatattttttcccctctagaggttttgagaatttactccttatccatgttattcttaaatttcaccacaacgtaactagatgtgggtttttttttttttaattctgcttattgtgagggataccttttcaatgtgtgggttcatgtcttcagttctggaaaatttttcttattgatttgctcaatgtattctttccatttattctttcattcaggaatcgacattggatagatatttacacttttggctccacccatgctggccaccytttccttagtagtttccatctgcttgtccttgtgtaccgcattatgggagaattggtttgctcattacttagcttttcagctgtttctccagctgctgattttttttcctttcaaccactgatgatcaatttccacaatctctcgtgagtcattttttttgtgactgaaatgcccttctccatacggggtttgctacatcagcagggagtcctgcaatcctgcctctacttttcggtcctttgaaagcctcactattttgtgaagcacatggttatgtgtccacttggggctgtactgct

SEQ ID NO: 93823 - DNA, 601 bp, Human
cattaatcctcttctgctttctctcgcttaggagttctttatagtttcttctccatcagcgatgtgccttctcactttccaactttgttctgggttttaagaaaaatattgagtatcacttctggatatctgggataagaaagggagccttcactttggggcttagtcatgtattaattttcttttgatggtttcccaactttggttctttcaggagaagttataatctagacagaaaatgacactagaatgttggatttaaattctctggaattctgtgttgaagaaaccagataataayacgccaatatcttcaagttagataagtcttcaagtcttgtttgaaaaaaatgaatttatggtcagctggctttttcttttacatatactttaaaaacacatctgttgtgtttaagtcacagatttgaagttcatcttatttccacactttttttgggggtaaaactttttagctaactctgaatcagtgaagaccatggtcttgtgtgtgtcatctttgtaaaccaacaatttgccaactactgtggccattgtatttagtttgcaattggtactatttttatttcaatgaaaaagaaga

SEQ ID NO: 93824 - DNA, 601 bp, Human
taatgaaattatttatcacgtagtattttctttttaatttctgctcaattcctgcacacttagatgattttcagcagttagtcttgcagtagaaacctttcagtcacctcccctggcataatgggattattaaggagaagtggatgttatattttaattttaaaaaatactatcattattatttaaatcttatctgagagcttcttcagcaagtgttaatagtacatgaaatgctctgtcttaagttgatggcaaatacatttaagaaaggcagtattcctctgggtcatatcaaaagaawccctgcacctattttactagtaactagttaccacacagaataatagtcccacagtgaatataaggtggcaattcacttgttggttgaagaactgtgcagttactatataaaccatccttaatggtcccatggattgaaatcagacttgcctttgatttccttcctatttattaggacaatttcagttttccacttttccaaccttccaacttttaatgtagaagcttttaaaggcacatcgacaaaatactatttatgatagtgaaggtcagttcacaggtgcccaggaggagaggccgg

SEQ ID NO: 93825 - DNA, 601 bp, Human
cctggcataatgggattattaaggagaagtggatgttatattttaattttaaaaaatactatcattattatttaaatcttatctgagagcttcttcagcaagtgttaatagtacatgaaatgctctgtcttaagttgatggcaaatacatttaagaaaggcagtattcctctgggtcatatcaaaagaatccctgcacctattttactagtaactagttaccacacagaataatagtcccacagtgaatataaggtggcaattcacttgttggttgaagaactgtgcagttactatataaaccatccttaatggtcccatggattgaaatcagacttgcctttgatttccttcctatttattaggacaatttcagttttccacttttccaaccttccaacttttaatgtagaagcttttaaaggcacatcgacaaaatactatttatgatagtgaaggtcagttcacaggtgcccaggaggagaggccgggttccttgagataaattgaatttaatgatttatttttaagaattacttttggtttcaaccacagtttgtagcacatatgtctgtgtagcatatttgtacatactccttctt

SEQ ID NO: 93826 - DNA, 601 bp, Human
acattataatttacttgaatacttttatacatgtggaatgatgacccaacatgaaatgaacagagctcaggatcactgaagcaagctgaaaacaaacacaagcaagacctactggtgattactaaaaaatgttagtaaaacccaaccttaacccatcttatttgttgccaaactgggttaatccaaaatgactagagatttgtttttccttaagagaaagtgagggcctacacactttgaatgagtgattgaagcacctagtcaatttggtcaactctcaagaagtatgcactaataggtrgaagcagagacatggaagatcccagcaaaggaggcagccagaatgctctggttaaggccctggacagacagatgtgggccagggccaaccccactgactagctatttagtcataatacttgatagccttaacttcttcatctggaaatagaaatattaatggcacctactttctaggatatttaggatgactgataaggtgataaatggaaaatatttaaaacagagtctagcacatactaagtacccaataaataatagctattactatcatcaacaagaatagttagatttaaatgta

SEQ ID NO: 93827 - DNA, 601 bp, Human
ccttcctgaaggaatccagatcaagagacatttacgcagaggtatctgtctgcctgagaagctggtcatctccgatctccagcgaggttccccagagtgcaaaggaagacagctgtagggcttagagtcaggatccttttacagtagagctagcagctcttggaaacgttgctgggctttgctgtgtacttgtgctgatttcaaatcttgttaagccaagaagtagtgcctggcaaatggttgatcctgccttggctattcatgcttcccaattcatttttattgtgctaattaaacctcragtggtatttcaagtacagattgttttttccattattgaatctttggccagcatattaacgctgtagaattaacatgagtcagatgcttacttatttgtggaagactttacatttaaaagatcaagacttggccaattttgctcagattcctttggaaactgcgatgacagggtgatacaatttctctataaataaaggagactcactcttctacagaatagacacgtaattatttttaaatgaaataattcctttatcaaggaatcataaataccactttatcagtggtatttatggtc

SEQ ID NO: 93828 - DNA, 601 bp, Human
cttgttaagccaagaagtagtgcctggcaaatggttgatcctgccttggctattcatgcttcccaattcatttttattgtgctaattaaacctcaagtggtatttcaagtacagattgttttttccattattgaatctttggccagcatattaacgctgtagaattaacatgagtcagatgcttacttatttgtggaagactttacatttaaaagatcaagacttggccaattttgctcagattcctttggaaactgcgatgacagggtgatacaatttctctataaataaaggagactcwctcttctacagaatagacacgtaattatttttaaatgaaataattcctttatcaaggaatcataaataccactttatcagtggtatttatggtccatgatgaaatggatatgtacagctcgggaggtagtggtgaagaccctgacctttgagttcaaattctaggtctatatgtactcggacaatgttgaataatgtatttgacttttccaaaactcatatacttcattaattaaatgagggcaaaatacttatcttcaagattggttctaaggatgagataaaacaaggtactaggcaa

SEQ ID NO: 93829 - DNA, 601 bp, Human
acatatttttaaaagtcacccagattatgccattgacttcaaggagatttttcactaagtaagcccatttcttctattttgccttgacatgctctgtaataaactgaacagcttaattgtcatagaagttgtgaagaaaacacattgagaaaaacaacagactcatctaaggccacaaagttagtatgtgccaggtttagggtgtggggcttgtattacactctgttaatcattgttatatatttcattgccctgtataactctggctattaggggcttttttttttttttttttttttttgaaaccccatgaaagatgtaacattggtctctattggatgcttacgggaaggaagagtttggaagggggggtctcactagcccctgaaagccagatcttattggggaatcctctcccagtggtgggataaccatgaaatatagactgtacaaatcttattccagtctgatttcactaataaagaaagatggctttgccggtaagaatacatgataagagaaaggtttatccataataatgtgaagacgaagggtcagatattgccaggtgggtgggttaattgcaatttaacggctgttg

SEQ ID NO: 93830 - DNA, 601 bp, Human
gtctttcaaaatctgtgtctggtagagggttagatttgtgagagttacttaaagcaaaaaacagatttttgcaaaaacaaaataggtgcatctcacccttttgtgttcttgagcattagtaaaaaatggggggtaggagacaggaggaaataaaagacatgatgtcagtccttatgtacaatctctgtttatgtgcaaaaactggattagtaactgtagaacaggaaaagaggtggaagacagttctttatactagtgttcttgaaataaaaggttattcggcaataatgctttaagtaawgtgcataatttattttgaaatctaattatagctttttttggtttatgttagatctatgaagctgatcaaagtagcactttttcagatcaacagaaatcagtctcaaaaagcaattaaagattgatttttaaagcataaacagttttcaatttattgcttttattttgatactgcatttaactatttgcatatgcctctgtttacttttcttgttccataggtttgccatctgcaaatctggccgcacctaacctcactgtggaggaaggaaagtctatcacattatcctgtagtgtggca

SEQ ID NO: 93831 - DNA, 601 bp, Human; identical to SEQ ID NO: 34155

SEQ ID NO: 93832 - DNA, 601 bp, Human; identical to SEQ ID NO: 34156

SEQ ID NO: 93833 - DNA, 601 bp, Human; identical to SEQ ID NO: 34157

SEQ ID NO: 93834 - DNA, 601 bp, Human; identical to SEQ ID NO: 34158

SEQ ID NO: 93835 - DNA, 601 bp, Human; identical to SEQ ID NO: 34159

SEQ ID NO: 93836 - DNA, 601 bp, Human; identical to SEQ ID NO: 34160

SEQ ID NO: 93837 - DNA, 601 bp, Human; identical to SEQ ID NO: 34161

SEQ ID NO: 93838 - DNA, 601 bp, Human
gtgtgagcttcaggaacagtgggacaagtgtcatgcatttacctgcttcagatgctgtccttcagtggagtgttcttacctactcagtctcattgcccaaatgcttgctaccaatgtggtggccaaggcctgtgtttggatgttgggagctgtacatgaatagagttcctcatcagagtagctctgagtcagtcaaagtcatgcaaagatgacttggtggagagaagggaaaatagaaccctggggagacttgtaaggcaggggctgcttgggctgcatgtacctgtgtggctcccagggsccccccaccagcaaaggtgatccatgcaaagccatctctgcaaaacaataaacaagaatgcagtccttctcattacatgataagttcctattattttgctcttcactagacctctttttaaatgcacaagcttgcttagtatattcaaaatgtgatttggaatatgtgtttgatttataaacagtagcccttcaggagcacataaaacaagcaatatttggatgcaaaacccagacacccctggctgttgctgtcttttccattaaatcttcctcttaattgagagtttagctgcttggc

SEQ ID NO: 93839 - DNA, 601 bp, Human
gtgtgcctgtagtcccagctactcgggaggctgaggtcagaggattgcttgagcctgggaggcggaggttgcagtgagccatgatcgtgctactgcactccagcctgggtgacagagccagatcctgtctcaaaaataaaacgtaaaaaataatttttaaaaaagaactaagatttccatgggatggtcattttgcttaggaacttgtttttgaaaagagagaataaagactattgaaagaaactgaagcataaataaaccaaaagtctccaaaacaaaaattggtgaagaggaatggacmaattggatgtaatgacagtcctcataacctttacttccgcttgggatgcagacactagacgaggtggcagacactctgttctctacttggaggaaggatggggaagttcgacctcaagacagcggcagcccagtccaagggggtgccagtcacagcgtgtgaggatgtgaggcaggcattaaaagagagcggcccagcaaaccaagatccccgtgtaatgtatcttgagagtgctgggccttgcagactctgccatttccccagccagcaggctaatgtggaaggacaggtgctagcaga

SEQ ID NO: 93840 - DNA, 601 bp, Human
tttggttattttcagctgcagatagaatctcaattgagaaatggcatgtcccacctgagctagaaatgaaaactctggatttgagctcgtggccagtctcctgtcctccccaagttcaggctggcagtatggggtcagggatggagtttgttgaagtttcagtgtccctgctgcccaggtgaaagggggtggagaaggagatgacagggtagttggctcactagtggctttgtgctcttggaacctgggaatgttcaatgctgatgtgccgactttctttcctggatacctttgtgggctyttggagatttctctctctgtatttcccatgacatgaacaaatgtgcctctgctccagctggcacaagcaactcctaactccaggaaagtactttatgttgttggggtccctcagcaggacctgactccccacaaagactttctcctgtgctgcctctggactgcaggggacactcatagtctcttgtcccctaggtgtacaggtcaagccaaatgccacctataccccatggctgcaggtttctttcaccttctctggcaagggtcaggccttgtcctctgagccatccgtttgcagaga

SEQ ID NO: 93841 - DNA, 601 bp, Human
aagtgagaccccgtgtctatgaaaaataaaaagaaataaaaataaaaattgtcgtccttcatgctcactgagaccttttgactctggtaaaacttctcagtgagttgttaaatcagggcttctcgaactttaatgcacataccaaactcctggggaccctgttaaaatgaagattatgattcaatggatttgaaaatgggccaaactaatgtatttctaacaagctccccgatgatgccagtactgctggtccatggatcatactttgcttagtgaggatgccctgcagaagctggagggrccactggaagaactggtcaggcatccatcaagatgacctcactgactttccctgaggatatcaaatagtaataacaatacaaatatagaatagatggtgcacagagatgccctttaattggttttggcataaagttggatgaattcaatatgtggcttaagaaggctagggagagtgaacaaaaagtagagacagcagttgcaggcacgtacacacacacagggtggggttatctgaggaatcttcaaaagttctcatgtatcctatttagcttaccagccaaaaagaaagacttgtcta

SEQ ID NO: 93842 - DNA, 601 bp, Human
cacagctcaagaatgctcattcacacaagcagtgggagtcagtgacttgcgcttcctaattcgggagctcctgtctcctatgcgaaatgcgcgtcaggaacaaactataaatattggaagagcttttcccacagcttctccttccgtgctgttttatcgaaagattcatgacatctggatgaactagagctctctgcggcacttagaatgccccacactggtggatttagatttggtgtacttagtctaaagaacgaggggagaggaaatttctccaaatgttatgcattaaataaagctytcctggctttatactatttgttcctttggtcttttgtcaggacctatttcttgtcctggaggtgaaggagagaaatttatgtctgcttttctgccttaaataactgagaagagaatgatttggccatacattcagaataatgataattaagatttatacttaaatagcttcttatacctcaggagtgctaatgttagttaattatgcttcccaaagctcctgaggaattgccagagccaatgctattatcctctcctgtcttatagaagactccattgttacagaaaaagtggagactcc

SEQ ID NO: 93843 - DNA, 601 bp, Human
ctggctccctgggaagctttgtcaggagtgcggctgtggctgtgatacagttgctatccttcttttactatttttttcaacttgtattttagaatcggggtgcatgtacaggtttgttacgtgggtctattatgtgatgctgaggatggggatgtgactgaacctgtacccagctaataagcatggtatccaataggcagtttttcagccttcccccccatccgtctctctccatcttcagtagtcccacttggggcacttcaggctgtaccgtggactggctactcactttcggtaattyttgacaacattccttaggtcaagaacaaagtaaaggtgagtatggcaccttaggatgctcaacacgttcttcagaaaacaggatttgaccatcagatctgcagaccttggtacttggccttcaacctctttcagctgaggaggagttgcagcttacatcccagtgagctgtggggatcatagacagtctgctgcttgtttggaactccagtgggttgaatagagttcctggatttcaatattttattccactgtctcccaacatgaagatttaaggcttgacgctacttcttgctaccta

SEQ ID NO: 93844 - DNA, 601 bp, Human
ctaacatttgttacagtgaatagatgtgatgttcttggatcttcctaggggcttcgtgtgggtagtgtgtttggatgttcctgttctgcaacgtggcagattaaacctgtatgtcattcatagtcactgaggccgtttaaatgtgtggctgagataaatctggctctgaatcctcaggcttgtcactttcttatggagctgtaggtgtaaaagcgatggtgaccacaggcccttctctcacatgcggtgggggtctgtgggggcctgagaataaatcagtggccaactcctcccaggctawggagtgaaagccccagaactagaaaaagccctcagtcctgggcagatggaaaggatgtggctgggagtgtccccgttttaaaacttgtaaggaatcctcttagttcctggcagtctgggatggttggccaccctactgcaaatgaagacccacatacttatatccaaatatttaaagattataaatcaaatcagtgaatgtgaattgtgaaatagagtaggttccaccttcctgcaagacaaatgtatagttatgatgacgtggaaggctggatttgaagttgaaaatctcatattgtgt

SEQ ID NO: 93845 - DNA, 601 bp, Human
attcccatggtgagggggactccatttggtctagggcttttgtaaagggaaaggacttcagaggacaactgagtcccctgcaagtgacatcaggagggcagccactgggacttcttgctgctgctttattcattgagttagccctcaaactacagggcagctttcaagactcttctcagagtgttataacagctataagcaaccctgacaagacatattcacatatgataactcaaaatgagtttgaattggtgtttgggataataaaattcttcaaaatatgattgaaatttactggaaycaatgactttgcatacattgatacagtgccatcatatgtggctgcacagggtgtgcactgcacaatttcccatcacatgtggctgcacaggtgcacagggtgtgcactgcacaatttcccatcacatgtgactgcagaggtgcgcagggtgttcatggcacaatttcaggtgatgttattcacatggactacaacattaaaggcgccccctagagttgtgcgaagcatgcactatacagcagtatgcagcatccctggatggaagtacacagccattcatttcattttttttccctgcta

SEQ ID NO: 93846 - DNA, 601 bp, Human; identical to SEQ ID NO: 34162

SEQ ID NO: 93847 - DNA, 601 bp, Human; identical to SEQ ID NO: 34163

SEQ ID NO: 93848 - DNA, 601 bp, Human; identical to SEQ ID NO: 34164

SEQ ID NO: 93849 - DNA, 601 bp, Human; identical to SEQ ID NO: 34165

SEQ ID NO: 93850 - DNA, 601 bp, Human; identical to SEQ ID NO: 34166

SEQ ID NO: 93851 - DNA, 601 bp, Human; identical to SEQ ID NO: 34167

SEQ ID NO: 93852 - DNA, 601 bp, Human; identical to SEQ ID NO: 34168

SEQ ID NO: 93853 - DNA, 601 bp, Human; identical to SEQ ID NO: 34169

SEQ ID NO: 93854 - DNA, 601 bp, Human
gccagctgatccttgatgtttcttcaggggaggaaagatctttcattctccaattataaataaagcttgggagagggaccaccccacagtgattttaattcatcctgtggggtggttctcaaacttgactgtgtgccaaaaactcctataggacttgagaaaacacagattcctgggctacccctagagtttctgctttagcaggcctagtgttcacctgacagctggcatttctaacagtttctggagaatactgatcctgcttgccctggttgttgtgttctctacacaacagtgtagrgaatcactgttctctacaataaacatgggctgccaggcccccttcagaatgtgacaagatgttggtagagacatcgcaaaccaaactcacccacagctttgcacacattttgggatccccatatctcaactgcacccaggcccaggctaggcggctgctctgtgtgtgccgcaccctaccatggcatttggcggttctcatgtttatcaggtgctttccttccttagaggcacttggactggatgtctctaaacatagatttcactggaggctaccaactaacattagagtttctggtct

SEQ ID NO: 93855 - DNA, 601 bp, Human
tctgtaagcttcgtcgggttttgttccttgttctgtggattcatcgtaaaccaaatgctgatggtccactccagaacaggcagcacagactttgagctccatggtaacagcattcatatttgtggtgttcatctttatctactgagtgcctagcccagagttggcgctcaatacatattaacgacagaatgatcagagaagattttcaactccgtccacctaagttcggtaattggaaaacagttagtatttggaggatggctaaacagtgagtgactaaagagagaacctgagacttttytaagtttctaaaagagacaaagtcccacctcttttttttttttttttttttttttttttggttattccatatgagtcatggccatagataagagatcagtttgtcccggttttgtctcagggtatgtaggttttcacacactgttttcaacaatcgtcattgtttaagtttggaggattcactttgactttttattttgcatgtgaacatcttcaatttctacctccctacctttgaatgtatcgttttggaatatgttgttttttcagttctgaagttggcaaaagtgctagattgggg

SEQ ID NO: 93856 - DNA, 601 bp, Human
gatggtccactccagaacaggcagcacagactttgagctccatggtaacagcattcatatttgtggtgttcatctttatctactgagtgcctagcccagagttggcgctcaatacatattaacgacagaatgatcagagaagattttcaactccgtccacctaagttcggtaattggaaaacagttagtatttggaggatggctaaacagtgagtgactaaagagagaacctgagacttttctaagtttctaaaagagacaaagtcccacctctttttttttttttttttttttttttttkggttattccatatgagtcatggccatagataagagatcagtttgtcccggttttgtctcagggtatgtaggttttcacacactgttttcaacaatcgtcattgtttaagtttggaggattcactttgactttttattttgcatgtgaacatcttcaatttctacctccctacctttgaatgtatcgttttggaatatgttgttttttcagttctgaagttggcaaaagtgctagattggggattttatcttgtggtaaacctagaatttatgttttattcttgcttgatagagtttaagc

SEQ ID NO: 93857 - DNA, 601 bp, Human
ctgctcttataaatgatctctgagtgtctttcaatagcaaccaaaaatctgcctatttaaaaatagtcataaacatagcggggccaaagctaaagaggttgaaggttaaagccttttatatgagctgaaaacaattctgggaaatttaagaggttgagtttaacagatatttggatcaacttttaagaggaaaaaatgtgaccaaaagccagaaacacagttgtagaaacatctgtaaggacaaactgttttccatatgcaccctcttccttcttcttttttttaaagaaaaatgccgtcraaaaattagaatggtaacaattgaatgcactcttgtttttcaaaatttcaaggagtttagaaatacctaaacataaaaatggatgttcccatcaccttcttctgcatgaccatttccactcctagaaataactttctttaactgtatagggtgcatatagtatgtaaacaatcaaatatatggcttcatttttgattccataaggaaattataataccagtcttgttctgcattttttgggggtaacaatttgccttgcggatttttctttatcagtacctagctatctactacattcca

SEQ ID NO: 93858 - DNA, 601 bp, Human
tggctcatattttcttctagtcttttgactttttgatagtgtcttttggtaaccaaagagatttacctttttataaaagcaaatctgtccatcttttccatttaagttgtgtcttgcttaggaagatctttcctgctctaaggtggtaaacatatttctaaatatttatttcactagttttttactctatgtattttttaaacttagccctttagtctttttgtaattattattattattattattattgagacagagtttcactcttgttgcccaggctggagtgcagtggcatgatctyggctcaccacaacctctgccgcccagcttcaagtgattctcctgtcttagcctcctgagtagctgggattacaggcgtgcgctaccacgcccggctaattttgtatttttattagagatggggtttctccatgttggtcaggctagtctcaaactcccgacctcaggtgatccacccgcctcagcctcccaaagtgtttggattataggcgtgagccaccgcacccggcctttttgtaattattttattaaactttggtatgaagtagtcctctctttttcagagacgtatagaataaag

SEQ ID NO: 93859 - DNA, 601 bp, Human
gtgatttattttaaaaaataggccttaattctgatgtatgtacagcctgctagaaaggaaaagagggattgtcaagaaattaaattcttccttatgcaatagattgtcatttatattattataaccacagaccctgcattttctgtgagaaagccaaggcttggacaggctaacagtggtggaagacctttgtttttatcaaagcgtcagcaaaagcagaaacacattggccttttctgtgatcatctgggaactttagtggcctgaggacaaagagaatgagagagagaatgagccagtsagctagtgacctgatctctatttcaattctttaagtcttttgtagacattaatatcctggattgaagcagaagagtcatctctgtcttcagcgacagtgtaaggaaggaagggggaggtgacttaaggggtgagggtgctgtggggagggagaatgttgagaatgaagtggtgtttctatttatggttgtggttgtcaactttagaagtcctggcaagacttgagtatagtcaaccacccaactgagcctttcctgcacttgcttcctggattgcctgtaaatgaaaattgcataaagac

SEQ ID NO: 93860 - DNA, 601 bp, Human
ctaagttatcaatagaaggtattttctatttagttggcattcccagtgaatctgtttactgttaatttgcaggtagcatgcatcttgtcagggtgatatggtttggctatgtccccacccaaatatcatcttgaattgcatctcccataattctcatgtgtcttgaaagggacctgatgggaggcaattgaatcatgggggtgggtctgtcccatgctgttctcgtgatagtgaataagtctcacacgatctgaggttttttttttataaagagcagttcccctacacaagctctctcttrcacactgtcatgtaagaagtctctttgctcttccttcatcttccaccacaattgtgagacctcagccctgtgcaactgtgggtccgttaaacctgtttcctttataaactacccagtcttgggtatgtctttattagcagcatgagaacagactaataaacaagggtacctttgacattccagcttgagagcaaagagaggcagccctgccttagccatctcttcctggaatggtgtggatgtcagggagcagctcaacatgtgggctgtttcttgatcttttaagtcagacttcatagc

SEQ ID NO: 93861 - DNA, 601 bp, Human
tatgcccacaaaaattgaaaaacaataaataaaaaagagtataatgagcctaaatgctttcaggattcccttttgcattttgtggctggtggtagcatcaaagacagtgagagctagcagcaggtgagaaatcacttgcagcctttattttatagatgaggatggtgggcccagagaacttgagcgacttgcctgagggttacctggtttgtggccaatccaggggcagaagccaggtctcatgactccagcttcagtgttttctgctgtgaaactaagacttgtaagaagactccacaasacaacttatttccatgccatgttcactgcttgagcgtgtcatacgtgactagtattgtcttgcccctgggtaatgctatgtttctcaaagctggggacacttaagatctgtggtaacaagagagttttaggaggtgctcagggactaacattttaaattttggtaattctgttatctatttattttagtgttcattagaaaaaatatacctattacatcatactgttggtttcatcatattattgtttaggatgagactaaattaatataatagaaaaaattaaaaaatatggtttaaac

SEQ ID NO: 93862 - DNA, 601 bp, Human
agggtcatgatcagcttcattttgagaggagaatccacccctcaacacacatacacacactcaacacacaaacacacacacataaaacacacacatacacacaacatacacacattcaatgcacacaaaccacacacattcaacacacttttaatacatacattcaacacacagatacatacataacatgcacattcaccacatacaacacacacacaacacataatatgcacacattcaacacacacacttttaaaacacacgttcgacacacacatacacacaagacccacatgtattyaatatacagaaaacacctgcactcatcccagaatgatggcttgaggtttctaggtgtctgcggttcccctgggtcatagtgtacactcctggcatgttgtaattgttacccatcacatggccatggccacttgagactagaaagggataggacccagactttgacttatgtcttgactttttcttgaaattcttctcatcttcagcctgattccttttatacagtctaatctactctaaggcctgggatattatatcattaattgcaaggctaatataatttgagtaaaattttctcttc

SEQ ID NO: 93863 - DNA, 601 bp, Human
taatctttcttgaatcaccattggtgatggtgatagtggagatctaattatccaaatctcctaaaatatggttttctgtctcacacatttagcctaggaatgactgagtgtcacagtgcttcatctccccttcttaatctctctatattttggaaaatagttgattggctgtcaccttttgggatctcctatcttcttcccacatatttccccatactacgtctctctctcctctggtcctgcatgttgtgaaacagtgtcttctacctcttttcccccaaatatctgggaattcgattcytcttaattcttcattactgtcatatagctctttctctttacaaattgctcaatagtacatatttattctagtctgatttatttcccatcacctaaaatgcttatgggttagcaaactcagagacactaactcagatattaccagaaaaccagcatgtttgaaaagatggatctgctgtgtacagacttgcataatggaaacctaagaatggaaaataagggctatagtcttggataatcccattcattggcatgggctctcaaaaatcaataatgttaagtttgctttgacttctcagtt

SEQ ID NO: 93864 - DNA, 601 bp, Human
attgttgagaattttgtttgtggaagacactcagtcattcctaggctaaatcctctccccttgccaagcccctccctccgcaggggtttttctttcatctcttgagctactgcagtgtcctctgaacccctgagatggaaaacatcccctgacccttggtggcaggtactgtagttacttattattcacttatttaaaaatggacatcatatctaggtgcaaaaacttaaggtgcccattaatcatcaatatgatctctctgttgggacccccagaaattcatcatgacttttgttttgaygtatctggttattcagtgtttgtaggtgtcaaagaaaaccagagctcaggactattgcaatatggaaaaagagagctcagtatggaactgggctcaactctgcatacagcatggacatgtgggaattcatagccaagaagcagggtgggtggcagtggatgggaaattactaagaggaaacatcaggggtaaggggggatcctggctaaaccaatgtaacaggactggtgctgagggcaggccagggtgatagacatcccctgcgggacagtagaggatgaggaacctgattagatgtgg

SEQ ID NO: 93865 - DNA, 601 bp, Human
gacaatcagatatggaagattttggcttaaccaacttaataggattcttaccaatccaaggcagacgaacgtggaagtccaaaagtcaggcctacttgagaaagagttcaggggagcccaagcagaggttggtcaaggagaggatctttgtcgtagggtgtactctgctcttccagttctagtcttccagatgtgttgacgtaattgccttaaattgtacgtggtcaaattataaacattattgaaaaaattttaaaaggcagtgtatggaactacttactaccctaacaaattaattgcrtgtgttacttaaaaatattctgatatctcacatttctataatcattcataatagtacattagttaatcctaaaatcttatgacccaatctacctacccaattggctgtctccattgagtccctgaatgatcacctgaagttaagccagatttcctttctatagataaagatgtagaggcataagaaattctattttttaaatgacaagaatttatttgaataaggcagagtcttgaatctctgtactatagatctgtgttaaccaaatgcattgacgatacaattcaattcaaacagcat

SEQ ID NO: 93866 - DNA, 601 bp, Human
gcatatcatttggtgatgagcaaactcctgtgagctaaaggaagaggtgacacagacacgtttccacagcattttcttgattcatattgcagctgtcgtcagtgctctgctcaggtaccctctgactccctttactggccttgtgtgctcaccctggcttctgcatatgtttgcttctgagggtcacgcacctggaaccttgttcagagggctggacttgagctagtggagctcctccccactcctggcatgtgcatgagaacacacacacacacacacacacacacacacacacacacaaaaacacacagctggaagcagctgggagttaagtgccttccactcccttccctcaaccctttgccaggttttgctgatgagtggtgaaggagtatgaaaggtcaccctcttgtcttaagtctgggcaaactctgtggtataatttacacgttctctgcaggatctgtggtataatttacacaccacagctctctgtagaatcaggctgaggctgagatttcacctgaagttgcaatcttgcctggcttcttcctcccctccctgttcccctctcctgggagcccctccttaataaatcact

SEQ ID NO: 93867 - DNA, 601 bp, Human
tcctgtgactatagtgtaccacagtgctgtttagaaaatgacttcctcggccctgaaatggaccacagtgtcctgaaagccctaactcatcacatagaagttatcagtccattgcagggaggttctttaagaaaatgaagggataatggcaatgatggcatggccatctagatggacttccttctagtgtccgtattgggacctgattgaattattcactgctgacacaagccctctacacaagttaaaaattcagcaaaaatacacaaaagccatactagagacctttaaagtttctgtrtggtgaagtcatcagcatttatcgcagactgtacctagtctttctttctggaatgttcttcctccatccatctgcctggttatttcttacttggctttttaagatgaagctcaggtgtcacttccttcaggaatgcttctctgatccccacaacatggacaaagtccctttttagtaaatttgtgtgatcgtgtgtaatcatctagaaaaaaaatgcttagcttatcatattgaaagaatatgttttcctgttaatcttcccactaaccatctgagggccacttcggggtatcgtttgag

SEQ ID NO: 93868 - DNA, 601 bp, Human
tagcagaaggagcaggggctgaggttttactccaagctttcctatgttcttcttctgtgactcaacctctctaaattttattttctttcactgtgaagtcacatgccagcaccaaagttagggaagattcctgagaatggtctaaaggttaataagatactgcccagcaaatatttggtgttccataaagtttcataaagcatacctcagatggacaatgatggggaaataggtttgttaacagtggacatgcatccatttacttgttctccctataaacaatttttttttttgagacagrgtctcactctgtcatcacccaggctggactgcagtggcaggatcccagctgattgaaacctccgcctcctgggttcaagcaatttttgtgccttggcctcctgatgtagctgggattacaggcatatgccaccaagcctggctaatttttagtagaggcagggtttcaccatgttggccaggctggtttcaaacttctggccttaagcaatctgcccacctcggcctcccaaggtgctgataaacattttactgagcatgtacaatatgccagccacagggaatctacatgtgtacatca

SEQ ID NO: 93869 - DNA, 601 bp, Human
gtctgaagttcgctgtaggaaaataaattttctaccttacaaatatttctttgctgggatttatgcagaaggtttatgatagccagtttctaatctagaaatcacagaattggatttgagaataaaagcatcttttttttcccctttcacttcaaaaagaacacttaacactctttctcttttttcaattgagtccctactctgtgcttggttttgtgctaagtgctttatgcatacaatctctcaactcctcaacatgtctctgtgagatatgcatcatcatcttcgttttgtaactgargacattgagactcagggagattttgctgatctgccaaggtttgtggctcctaacgtcaagtctgcctcaggacagtcatgtcctaactactgtgccttcctgccctcccctatggcctggtttcatttcttcctttgtttattctcctgtgaccctctctgtctaaatattttctttctctccctcattcatttggcaaatgtcatctattgagatggcaaacatacccagactgctgggcagtcactgggaggggatattcaggcttcaatggaggggactggacccatattgagttct

SEQ ID NO: 93870 - DNA, 601 bp, Human
ggaggtactcaaatatttcacaataaaattctaaaataccttgtcagtttttcttttatttccgagccttctttcttgtgcttttcaaattggtacacaaatgtttccctaagtatataagatgagatagaaagattaatctctttgggctgatgacagtcttaaataatggtccatgaggctgagagaggccgtctgtgcaggtgaccaagccctaacaccaagatgtgggagctgagaggtggcatagggcctgggcctagaggcacctgctcctctccctcattgcccagagagaatygaatctgctttccttggctcccacagcaaggaggtgacagagcggggacaactccagcctcttgactcccagcccagtgtgtttttccctgcagcacatttattttttttcagagtctgtcttatgctcacatattattttccctgttatgcttagcccatcagcatttgcttagccagagatattgccagcaacataaaccataaagattgtaatttgcctggtttattgcttgctacagtccacagactcttggcgtaacctaggacgggcttctcctgcatatttcttttgctcttg

SEQ ID NO: 93871 - DNA, 601 bp, Human
gccctaacaccaagatgtgggagctgagaggtggcatagggcctgggcctagaggcacctgctcctctccctcattgcccagagagaatcgaatctgctttccttggctcccacagcaaggaggtgacagagcggggacaactccagcctcttgactcccagcccagtgtgtttttccctgcagcacatttattttttttcagagtctgtcttatgctcacatattattttccctgttatgcttagcccatcagcatttgcttagccagagatattgccagcaacataaaccataaagatkgtaatttgcctggtttattgcttgctacagtccacagactcttggcgtaacctaggacgggcttctcctgcatatttcttttgctcttggttctttgaatagaatgtgtatataatttggaatcaagacaaatttataatcaatattgatatttttctcttataaatatgcatatattcctaatcagatatttaaatggacttcctgggttgttatggatatttttattaaacattttatagtttatgcagatataagagtgacaatatgtatacagtttatatttagttgctgttagac

SEQ ID NO: 93872 - DNA, 601 bp, Human
gttttctacattattacctaagagagtatctataaagcatctctgaggcacacagttggtacctgtctatctatccaactagatggatagataggtaggtagagagatagatatagatataaatataaatatagatacagactgtttaaaagctttattatttatttatttattttttcttttgagacagagtctcactctgtcgcccaggctggagtgcagcagcatgatctcagctcactgcaacctctgcctcccaggttcaagcgattcttatgcctcagtctcctgagtagctgakattacaggcatgtgccaccacacccagctaatttttatatttttagtagagatggagtttcaccatgttggccaggctggtgtcgaactcctgacctcaagtgatccgcccaccttggcttcccaatgtgctgggattacaggtgtgagccaccatgtctggcctgtttcttaaaagctttattaaaaactatgaaatgtctaagatcttaccctactttcaagctaacaagttagcctgccatgatttcatagatgatggcagaagacatgagattttggggtcagagacagaggactc

SEQ ID NO: 93873 - DNA, 601 bp, Human
tttttcttttgagacagagtctcactctgtcgcccaggctggagtgcagcagcatgatctcagctcactgcaacctctgcctcccaggttcaagcgattcttatgcctcagtctcctgagtagctgagattacaggcatgtgccaccacacccagctaatttttatatttttagtagagatggagtttcaccatgttggccaggctggtgtcgaactcctgacctcaagtgatccgcccaccttggcttcccaatgtgctgggattacaggtgtgagccaccatgtctggcctgtttcttraaagctttattaaaaactatgaaatgtctaagatcttaccctactttcaagctaacaagttagcctgccatgatttcatagatgatggcagaagacatgagattttggggtcagagacagaggactctattacttttacacagcatgtggcatgaacagcatatttgtatcaattctctcttccaaaaccccatgagtgtgaggcaggtgggacccaatggatgcctgcacattctctggattgtgttataggagaggaaccctgaatttagggaatctgaatcttttaaaatggacagt

SEQ ID NO: 93874 - DNA, 601 bp, Human
cttgagctcaggagttcgagaccagcctgggcaaaatgacaaagcgctgtccctataaaaagttacaaaaattagcccagagtggtggcgggcacctgtcgtcccagctacttaggggactggggtgagagaatcgcttgagcctgggaggcagaggttgcagagagccgagatcataccactgtactccatcctgggtgacagattaagaccctgtctaaataaacaaaaacaaaaacaaagccttccttaaattgtgggtttaactagctgatttgcttcctttaaataaattggccaycagctcagcttatttctctcctatggaagggcctgtaggtgcagtctgattgtcactgatatttttagagaagcaggaggttattcagacttaaccaaccagtgatgattccttatacttgggttatatgtagaaccgtagtgaattacaactttggacacaaggtgcctgcatcgttggttggactgagatcatggtaaatcttctctgcactaatgaggctttgtgcctcttcaagagacttaccctggaattccctctgggctcagtttggctgtcgattctgtaaagtccctctct

SEQ ID NO: 93875 - DNA, 601 bp, Human
ccgtagggttgctgcacctttttttgtttttttgacactgacacaagaacatcacagtagttgtgggttgtttaaaggcttagctgtgtgctgatgatattgtttctcctcaactgttcaagatcaagaaggtgaggcatttaattagatcagaaaagagtgagcaagtttgaagaacttttctcaacctgtcagatctgaaatcttaattccatgctggactttctctctggagaagcctccttctgtattcctgtttacttctgataagagtaaacaaatggtagaaatgctaaaaggraaccaagatactctggaccaccaacacgtccagcattaacaacccacaccactagtgggtcaggttagcatttctggcagctagcctttatgattagaaaataaggcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaaccccaggctcaatctgaccagttgt

SEQ ID NO: 93876 - DNA, 601 bp, Human
tcctcaactgttcaagatcaagaaggtgaggcatttaattagatcagaaaagagtgagcaagtttgaagaacttttctcaacctgtcagatctgaaatcttaattccatgctggactttctctctggagaagcctccttctgtattcctgtttacttctgataagagtaaacaaatggtagaaatgctaaaagggaaccaagatactctggaccaccaacacgtccagcattaacaacccacaccactagtgggtcaggttagcatttctggcagctagcctttatgattagaaaataagrcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaaccccaggctcaatctgaccagttgtttgtttttgtaaataaagttttattggaatacagccccattcattcatttatggattatctatggctgctttcatggtacagcagcagagttgagtagctgtgaca

SEQ ID NO: 93877 - DNA, 601 bp, Human
catttaattagatcagaaaagagtgagcaagtttgaagaacttttctcaacctgtcagatctgaaatcttaattccatgctggactttctctctggagaagcctccttctgtattcctgtttacttctgataagagtaaacaaatggtagaaatgctaaaagggaaccaagatactctggaccaccaacacgtccagcattaacaacccacaccactagtgggtcaggttagcatttctggcagctagcctttatgattagaaaataaggcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaaccccaggctcaatctgaccagttgtttgtttttgtaaataaagttttattggaatacagccccattcattcatttatggattatctatggctgctttcatggtacagcagcagagttgagtagctgtgacagagaccttatgtctcagaaaacctaaaatgt

SEQ ID NO: 93878 - DNA, 601 bp, Human
aatggtagaaatgctaaaagggaaccaagatactctggaccaccaacacgtccagcattaacaacccacaccactagtgggtcaggttagcatttctggcagctagcctttatgattagaaaataaggcattataatgggactctgcggttttttttttccttaaaaatctggttttgattattaacactcttgccattagggaacatttggtctgagctacgtgttagagttccaccagtacaagggaagaaaaaaaacctgagctatccccttaaaacagttgtcatactatgaacccsaggctcaatctgaccagttgtttgtttttgtaaataaagttttattggaatacagccccattcattcatttatggattatctatggctgctttcatggtacagcagcagagttgagtagctgtgacagagaccttatgtctcagaaaacctaaaatgtttactctctggcccttcacagaaaaggtttgctgacccctgccttaatggaacacataagcaaaatatctaatgaaataaccatccacctcccggacttccacatattttgtaataggttgtggagatggggatcttgcccg

SEQ ID NO: 93879 - DNA, 601 bp, Human
atgggagcagaagttcaaacttaggggaataccaaggtccagctctgcgcaactttaccttaagagtctgtgattccctctgtgtacacttccatttcatatactaacatgggtactgtgtaaaaagagaaagagacaccttcaaagctaccatcaggggtagcgaatggtgctagacctcactggtccatagttcctacttgattaggtctcagttaagagctagtatattagatggttatacatggaaacataggtggatgttttttcctctctaaaagaaagctatgagctatgaagytttctggcttggatgggtcagtgataatttcgggggtatggcagactttgtgatattttcttgggaagtaaaagaaaaaaggtatggttctgataaagattctgtcaggaattctatatttgagtcttttttttgttataacatcacactaattttttttatacaaaagactgtcagggttcagggtgcaaaagggtaaatgtgcagtctttgtatgttccattgtcttttcttcctctcttcataacttttgcagagaaggccagccttgtttgtatgttccggtgtccaaaccttatg

SEQ ID NO: 93880 - DNA, 601 bp, Human
tttttgttataacatcacactaattttttttatacaaaagactgtcagggttcagggtgcaaaagggtaaatgtgcagtctttgtatgttccattgtcttttcttcctctcttcataacttttgcagagaaggccagccttgtttgtatgttccggtgtccaaaccttatgtgtacaaagtaactgtgtggttcagtcagaagaaaggtgataggagttttgagaaactggcattttgaaaaagggcaattcctgcctctgtaggagtcttagtacttttaggatgtcttaggagaacatmcaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgttgaaaatgtgaattttgagattaataaataatgtattttagtcatttcagtataacattcttaacttcgccggttaaaaac

SEQ ID NO: 93881 - DNA, 601 bp, Human
gcagagaaggccagccttgtttgtatgttccggtgtccaaaccttatgtgtacaaagtaactgtgtggttcagtcagaagaaaggtgataggagttttgagaaactggcattttgaaaaagggcaattcctgcctctgtaggagtcttagtacttttaggatgtcttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgttgaaaatgtgaattttgagattaataaataatgtattttagtcatttcagtataacattcttaacttcgccggttaaaaacaatacctattttcaatgagatgaatgccccctggtggaaacagtggcaaatatttgcactgatttggggggcccacagacaacaagaacaagcatatcaagtgtaatgatggaacaatgtagg

SEQ ID NO: 93882 - DNA, 601 bp, Human
gaagaaaggtgataggagttttgagaaactggcattttgaaaaagggcaattcctgcctctgtaggagtcttagtacttttaggatgtcttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacytagccttttttgcttcccgttgaaaatgtgaattttgagattaataaataatgtattttagtcatttcagtataacattcttaacttcgccggttaaaaacaatacctattttcaatgagatgaatgccccctggtggaaacagtggcaaatatttgcactgatttggggggcccacagacaacaagaacaagcatatcaagtgtaatgatggaacaatgtaggcatataattgacatagcttagagagtgtctttagttttttaagtctatacttcatttaaatgcagtaaatagaaga

SEQ ID NO: 93883 - DNA, 601 bp, Human
ttgagaaactggcattttgaaaaagggcaattcctgcctctgtaggagtcttagtacttttaggatgtcttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgytgaaaatgtgaattttgagattaataaataatgtattttagtcatttcagtataacattcttaacttcgccggttaaaaacaatacctattttcaatgagatgaatgccccctggtggaaacagtggcaaatatttgcactgatttggggggcccacagacaacaagaacaagcatatcaagtgtaatgatggaacaatgtaggcatataattgacatagcttagagagtgtctttagttttttaagtctatacttcatttaaatgcagtaaatagaagataacatcaaattgggagggt

SEQ ID NO: 93884 - DNA, 601 bp, Human
ttaggagaacatacaactgaacaccacctctaaaattaatttctacttacagctgagtgtttttatgtatatgttttgttgacgcttcttaagagttcataacattctctggtatatcatacttttcagatcataagtatacttttttcttactcatataataacttttcatatatacaaacatctaattcaagaattacccattaaagacctagccttttttgcttcccgttgaaaatgtgaattttgagattaataaataatgtattttagtcatttcagtataacattcttaacttcsccggttaaaaacaatacctattttcaatgagatgaatgccccctggtggaaacagtggcaaatatttgcactgatttggggggcccacagacaacaagaacaagcatatcaagtgtaatgatggaacaatgtaggcatataattgacatagcttagagagtgtctttagttttttaagtctatacttcatttaaatgcagtaaatagaagataacatcaaattgggagggtcaaaacattcaacaaggaactaactaaacccttattatggcaatttctctagcgtctttcttttcagct

SEQ ID NO: 93885 - DNA, 601 bp, Human
ctatacttcatttaaatgcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaa

SEQ ID NO: 93886 - DNA, 601 bp, Human
atacttcatttaaatgcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagt

SEQ ID NO: 93887 - DNA, 601 bp, Human
atgcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatc

SEQ ID NO: 93888 - DNA, 601 bp, Human
gcagtaaatagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatccc

SEQ ID NO: 93889 - DNA, 601 bp, Human
atagaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatcccctctata

SEQ ID NO: 93890 - DNA, 601 bp, Human
gaagataacatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacacgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatcccctctatagga

SEQ ID NO: 93891 - DNA, 601 bp, Human
acatcaaattgggagggtcaaaacattcaacaaggaactaactaaacccttattatggcaatttctctagcgtctttcttttcagcttgggaatctcttagctagtaaagtcatttatatcaaggctcttcgtaacgattttttaatggaggaattttcaataataccttggagggtgttctaaaactaaatagttgtataagagagaattgcttaaaggattataagatggcctccaagaaaacacacacacacacacacacacacacacacacaaacacacacacccacaaacaaacamgtcagtgggtgagaggagcaggttttgggatttaagcttcaccaatgacaactttatgttgtttgtctcgttaactgccagacaatccatctctggttccatagggaatgcttaccaagccaggcatgtgagcttgccaggactcatgtttttatagaaagctttattttggaaatttctaatctgaacatacttgaaatctaattctcagaaaactttggaaaaccatttaaaaggaagcaggaaaagggaaaagcaaaagtgaagtatgaggctgtatcccctctataggaaacggaa

SEQ ID NO: 93892 - DNA, 601 bp, Human
aggtgcctagaaaatggtcctcagagatgggcattgaaggaggctttgggatttgcagagtgtgagagttggggaaagagcatggagaagagagagggatggattccaggtagaaattttatgtcccaagatgtgaaagtgtaagaaaatgtgtggcattcatacatttgctaggagtctggtttggcttgagcagagaacgggggtagagaattgggagaagagactgctgggttgtgggggcagggcatgaagggggctagggagttgacagtatggacagaatttatcccaaagactycgcatggaggagtaccctaattaagtgtatgctatagaaagaagacttggcagcatgaggagatggaggttggaagactggggtgtgatgggaggtgggactgccactgggttagatcaagttcaaataactcagtctaatattagcaggctgtaaaggtaagattagaaaatgaatcccaaaaatgttgtgggcaaaggcagcaaggttgaaagaagctgtatggcctgagggaaaggcagaggggagtcagatgagtctgagttcaaaacctagcactgccggttactagttgtatga

SEQ ID NO: 93893 - DNA, 601 bp, Human
tagaaattttatgtcccaagatgtgaaagtgtaagaaaatgtgtggcattcatacatttgctaggagtctggtttggcttgagcagagaacgggggtagagaattgggagaagagactgctgggttgtgggggcagggcatgaagggggctagggagttgacagtatggacagaatttatcccaaagacttcgcatggaggagtaccctaattaagtgtatgctatagaaagaagacttggcagcatgaggagatggaggttggaagactggggtgtgatgggaggtgggactgccactgkgttagatcaagttcaaataactcagtctaatattagcaggctgtaaaggtaagattagaaaatgaatcccaaaaatgttgtgggcaaaggcagcaaggttgaaagaagctgtatggcctgagggaaaggcagaggggagtcagatgagtctgagttcaaaacctagcactgccggttactagttgtatgacctccaatagtctcacctgtctttaaattttttaaattgagaaataataattgtgcatatttatgagatacatagtgatgcgtgatacaaataatgcatagtgatcagat

SEQ ID NO: 93894 - DNA, 601 bp, Human
gtacatttgggtacgtgtatgaagaaaggagagacagaggacctccattcagacatcgattttctctgtgcttatttaaaactcttcattcacatgctgcacactcaacaaatacttatttagtggtacacacatgcaaggtgccagctaaggactctgttccctttagtgacatctcctgagggggtgagggcagaagatgtttaataaattaatgttggtcaactaattcatgcccacatatgatgacaaaagtgtctaatagccagtacaagtcaaaatactagaaaaccatccatcygagttattaacattttaatttagatcaatagggaaaaataagtccttagggggtttatttatatccttagtgagtgtttttttcttctcgcaatttagtttccttgagaactgaacatttataaagtgtttttggtgaacccatttatacagtagaattcattttctctaggaggttgggaactacagagagaaaccagagagtcataaattctatttaattcaagttcatgcatttcactagagaaagcaccttctttatcctcttattgtacttcccctgagacctctgaacagatga

SEQ ID NO: 93895 - DNA, 601 bp, Human
tagaattcattttctctaggaggttgggaactacagagagaaaccagagagtcataaattctatttaattcaagttcatgcatttcactagagaaagcaccttctttatcctcttattgtacttcccctgagacctctgaacagatgatgttagcagtgatttaaaaatgcaaatcatatcacagaagtcctttaaaggattgttcctcactcctcctcccaccctccatcacacaggcccttaaacaacaggaatggtaaattcaaaaccaaaacttgcgtcataggtaaaaaccaactrtttgctgaaataggctgtaccagtctggctattttgatcacccatgatagttggaagacagaggatctatattctaaatctgatgaatgtatttactattcacattacatgtttgaggtgagcctgctatatgtacatgtggagaaagaagtgtggttataaggcaaaataaatagtagcccttgcagtcaagtggcttccgtggatcaagagctcgtataactcattttccagaagaagggcagatgcattgcagtgggagttcatagagaaagattactcttggctcatgctattgag

SEQ ID NO: 93896 - DNA, 601 bp, Human
agcctgcagtcccttatgctgatccctgccaatcccatctcatctgagcctcacattcccacagtcccctgaagcttaatcaagttggtaaaatttatgtgtgttccttagaataaccatcacaacaattattgctattatttatggagcacttgcttgtttctaagcatgtttccatgcactttgcatgcattatcccatgtaataccctaaacaacctcatgagttaaacaatgagactgagatacgaagaggtgcagtaacctacctggcctcacctgtgtgtagggggtgagtggcrataccaggatccaagcctaggcttacaaatttgcagcgatcttcaagattattatttattttaattattcatttctctttgttcttgttgttattttgatccatctgtctctacttctggttcctttttgctgtttttctccaaaataggatatgttgttttctttatctcagtagacatcttttaattattttagcctaataatacttaagggggaaaaacaaaaaccctacgaaaagaaaagtattatcttaaaacttaaataggttcagtgggaaaaaatcttggttcagaggaagg

SEQ ID NO: 93897 - DNA, 601 bp, Human
tctcatctgagcctcacattcccacagtcccctgaagcttaatcaagttggtaaaatttatgtgtgttccttagaataaccatcacaacaattattgctattatttatggagcacttgcttgtttctaagcatgtttccatgcactttgcatgcattatcccatgtaataccctaaacaacctcatgagttaaacaatgagactgagatacgaagaggtgcagtaacctacctggcctcacctgtgtgtagggggtgagtggcaataccaggatccaagcctaggcttacaaatttgcagygatcttcaagattattatttattttaattattcatttctctttgttcttgttgttattttgatccatctgtctctacttctggttcctttttgctgtttttctccaaaataggatatgttgttttctttatctcagtagacatcttttaattattttagcctaataatacttaagggggaaaaacaaaaaccctacgaaaagaaaagtattatcttaaaacttaaataggttcagtgggaaaaaatcttggttcagaggaaggctttatgttgcacatgtttgaattatggacttaccgc

SEQ ID NO: 93898 - DNA, 601 bp, Human
gattaaataagggactatctataaatcccttggtatggtgggcaatatagtgtatggagaggtgatctaacttaccagtgaagagcaggactatggagacagacttctcgagtttgaatgctagctccagcatttaccaaatctgtggccttggtcatgttattcacctttctgtgcctcagtttcgcacctctaaaagggcataatcacaatgctacttataaggctattatgaggattaaatgaattaatatatgataagcacttagaagaaagctaaaaagcttggcatatggtttgygccatgtatcaggtattactatggtacataataagcataagagtaacatccaataagtatattatcatcatcacgatcatcattatgttattacgttgtaattattgatcttggcgatccaaagcaaagtgactcatggagaatagttatacttagtagggacatgaaaatgaaattttaaaaattgggaaaataggaggaaaatgaaaatgaaattaacaaaaaagtataaattcagtagatgcagatcagagtcattgaaccagcctgtcatttctcaaacatgagctaagtgctggg

SEQ ID NO: 93899 - DNA, 601 bp, Human
tcttggcgatccaaagcaaagtgactcatggagaatagttatacttagtagggacatgaaaatgaaattttaaaaattgggaaaataggaggaaaatgaaaatgaaattaacaaaaaagtataaattcagtagatgcagatcagagtcattgaaccagcctgtcatttctcaaacatgagctaagtgctgggactatagagaggagaaggtcatctttgagaagcacctggtgagtttgctgaaaagcaaacatcagagggcaatgtgacatgttgtgtcatcaatgtctatctgaggggytcagatgggggctcttccaccccagtcctagagaccagagcttgctttatgtagaagaagccacttgaacttggatgtagaggccaagagtctcccaggcagaacagtgggacaggaaattctgtgcagaggtttgagtgtgtgggatgagctcaaggtggggtgttctgtgggaacagcgtcctggatgatggagacacagcatgcatgaggagggggagcaaatggcagagtgggtgggggaattcgagaggtggcctgggatgggcctaaagtggatgttaggtagaagagggcttc

SEQ ID NO: 93900 - DNA, 601 bp, Human
ggcagtgagaaacaaggaattagaacacagcccacacccatccattaggaagtcattagcctagaggtaagtagcgcatcctctactttggctctgctgcgtgctcaccagagccaaagcttccgcttgttagctgggaagggcatagagaaaaagccattgagaaattgcttttaagggctttgtggtggccattgagagggtatttcagaggagtggcaaagcagaaaagccagctctcaaaccaagttgaagaacagctaggttctgatttgccaagagctgaggtatctgcctctcrttcaatggcacgcagggggagagaagaaacagtgaggctaacagggacacacagagaggctactgcctgtcctcaggtatggctggaagagatgataacaccacagattggcctcaattcaagcaggttgtgaaatggctgagctgctggggaacagccagaagcctcggtgaggtgtactgaattaattgtatctgctccagatcttgagagcccagagccaattgtccagagcctttgccttcaagagttggaaggcagaatgtgctctgctgacctggccctcagaggcagctgcct

SEQ ID NO: 93901 - DNA, 601 bp, Human
gaattagaacacagcccacacccatccattaggaagtcattagcctagaggtaagtagcgcatcctctactttggctctgctgcgtgctcaccagagccaaagcttccgcttgttagctgggaagggcatagagaaaaagccattgagaaattgcttttaagggctttgtggtggccattgagagggtatttcagaggagtggcaaagcagaaaagccagctctcaaaccaagttgaagaacagctaggttctgatttgccaagagctgaggtatctgcctctcattcaatggcacgcagrgggagagaagaaacagtgaggctaacagggacacacagagaggctactgcctgtcctcaggtatggctggaagagatgataacaccacagattggcctcaattcaagcaggttgtgaaatggctgagctgctggggaacagccagaagcctcggtgaggtgtactgaattaattgtatctgctccagatcttgagagcccagagccaattgtccagagcctttgccttcaagagttggaaggcagaatgtgctctgctgacctggccctcagaggcagctgcctacctgtccaccagcgg

SEQ ID NO: 93902 - DNA, 601 bp, Human
ttgttaaaatcagcctggagtaaatagcagacctaaatccagaagaactggattttcctgatgctgcacatgtttcactatatgcgtctctgcagccttatccattctcccttagcccctctctctggtgcccttttttgccctctggccgcagagattgtcagtcaaatctaccttaaccctaagctttctgatcccttttctatcttcctacccataagagcatttcctgctcttttctcagagccttatttggtgattggtaactaaacagcttaagtgctagggtggcaatgtagtrgatgtaggggatatgacattctattcctcctgggcaatacatttgccttttacaagataccttctcgctggattttcgttcaaatgttccacttattctcctgtctacattccaaactctatggtattgactggtgatgaagggaggtgatttgagaagggacattttttagtacggacatcctcctcagtgcatagacagactcttggtctgggaatctaagtggtctatatgccagtactctctcagagaacacttttagtcagaaaaatgaagtcaagcaaacgtttagtttaaaaa

SEQ ID NO: 93903 - DNA, 601 bp, Human
acttctgtaaccaagaaacagagcttgatcaatactctcaaggtcactgttgctatttgctatgcctgctggtcttttttagagttttgaaaaccatcctatgcatccatcctgataaatatgctcagttttggtacagggagatatggttttaagtgtggggcagatgagatgcagaaggaagaagtgtagcctttctttgtgggaatctgtagggaaatctaccacaaaattttcagttcaagatagaacctggggacacaagagagaaactctccttgtgatagccaatctgttctgwtaaggcagttattattactaaaaggatccctggctataacgtggattttaaagaacattattcaatgtgtttcctcttcaattacttctgtgtcataatttagctagctgtttgccttcaaatgtggcattggccctgtgggcttgcctagtagttcacatcatattctgtttgttcacttttgtatttgttggctaagttgacttttttagaataaagattctctaacttactaatgtcagagctttttaacgctgatactgaccaaaataagtgaaatgttcttttggtaacttatgc

SEQ ID NO: 93904 - DNA, 601 bp, Human
tctcaggtgttgacatgtatatctgccaggacgctgaaaatgtctacatccaggagtattttagccttcacctacagcatttggcagtagatacgaaccacatgttcagagagagagatttaatctatgaaaatacaaaattacaaggagattaggaagaagttgcctagaaataggcaggagccatcacccgaaaatgggggcatccttgtccgtggccgttggtgcatttgcttatatggacaggggcataggttgcaggttgctcttcattttcctttctgggagacagagaggaaayaggattaaaaggcagttcagatgagttaacatcatggcatagccaaaaaaccccagtgtaatgcaatactctttatacttagatatagctgagtttttattggctgtttggaattgggcatgttacttatcatctcagcggttttctcatctccaatatggaaataaaatacactttaaatgagctatgtataaaatgtgccttgcgcaatacagaatatagttagatgcataaaaatgttagttactctccctttttattgtctttcctctgtcacacacagagctttataattatggt

SEQ ID NO: 93905 - DNA, 601 bp, Human
ctgtgccctccaccccccaaattaatgtctaccttgagctctcagctctgtccacgacagagagcttcatgtagtcgtttccaggtgaattggtcaaaactgggattatattccgactgcaagcataggcaagttcagggatctatctgttctctccaaagacagagggaagtgggaggacctcctgaggggtggtggcagctttcctgcatctactgaaacctactttgtcctgctgccaggtctttgctgttggcctctgccctaggtgcctccactgctgacactttcagacctgccrtgacccccaacactaagaccacataggctgtcccgtgtacccctcatcccaacacgcccagggacagtcttggccacgtctgtgcctcttttggggacagaggaactatggatgttctaacttactgccctgggctcttgggaaacgcgagggctgagtgaggtccctgcacatgctggtgcaggccgagcacagtgcagtctttcttctttcactggcactgagaagaggggacctatgtgtggctgctgcttcccagaggtctttatgggaagcagccccaggtctcttcaactctca

SEQ ID NO: 93906 - DNA, 601 bp, Human
atctacaatatctgccaaaggtcagacagaggtccttagacagagagcagtaaagctatttcaaaagatggtattaatctatgatgtcataggattacaatttatttagcttttctgaaagttcaaaaactcttgctgattcagatcattaatttagtgaggaattgggttggtggaatattagggtatctttcatgaacaaaggaatttctaaattaatgactagtggaaacaagatgggtggtaggaatcatatatcaccatcttaggaaacaaactttttaagcattttcaaaggaawctcatgaaaacaattgatgaatcatataatcttaaattatttttttcttttgggtaaggctgaattaccccctacttgccaaaacatgctggaaatgttttattggcttaattttgattcctttatatatatgaaagtaataaagctgcatttctttaaatatatttcctaacttagagctttcataaattcacactggcttttatttctagtcttaataaattagattctaccgcatattgaatataccctgttaagtatattgaaacagtacgatgttcactgaaggaggaagcttaa

SEQ ID NO: 93907 - DNA, 601 bp, Human
tatatataatatatatattatatatactatatattatatatattatatatactatatatactatatattatatataatatatatactatatattatatattatatatactataataatatatatattatatattatatattatatatactataatatatatattatatatactataataatatatatattatatattatatatactataatatatattatatatactataataatatatatattatatattatatatactataataatatatatattatatattatatatactataataayatatataatatagtaataattattattactataataattactaattactattaatatttactattagtaaaatatataaagtaaaatgtagcagtagtgtgttcaggactcctgggtatgagccattgggactgtcttagtcttgccgctataacaaagtatcacagactgggtggttgataaacaacagaaatttatttttcacagtcctggaggctgggaagtccgagatcaaggcaccagcagattcattgtcaggtgagggcccattttctggttcgtagatggcaccttctcatt

SEQ ID NO: 93908 - DNA, 601 bp, Human
ataatatatatattatatattatatatactataataatatatatattatatattatatatactataataacatatataatatagtaataattattattactataataattactaattactattaatatttactattagtaaaatatataaagtaaaatgtagcagtagtgtgttcaggactcctgggtatgagccattgggactgtcttagtcttgccgctataacaaagtatcacagactgggtggttgataaacaacagaaatttatttttcacagtcctggaggctgggaagtccgakatcaaggcaccagcagattcattgtcaggtgagggcccattttctggttcgtagatggcaccttctcattgtgtcttcatctggtggaaggagcgcatgagctcccttgggcctcttttgtgaggacattaatttcattcatgagggctccaccctcatgacctagttattatacctcccaaatgccccacctgttaatatcatcacactgggaattaggtttcagcatatgaattttaggaggacacacacattcagaccataggaggggtattaattttcatatcaaaacaatgggtt

SEQ ID NO: 93909 - DNA, 601 bp, Human
attatatatactataataacatatataatatagtaataattattattactataataattactaattactattaatatttactattagtaaaatatataaagtaaaatgtagcagtagtgtgttcaggactcctgggtatgagccattgggactgtcttagtcttgccgctataacaaagtatcacagactgggtggttgataaacaacagaaatttatttttcacagtcctggaggctgggaagtccgagatcaaggcaccagcagattcattgtcaggtgagggcccattttctggttcrtagatggcaccttctcattgtgtcttcatctggtggaaggagcgcatgagctcccttgggcctcttttgtgaggacattaatttcattcatgagggctccaccctcatgacctagttattatacctcccaaatgccccacctgttaatatcatcacactgggaattaggtttcagcatatgaattttaggaggacacacacattcagaccataggaggggtattaattttcatatcaaaacaatgggttctgtttctgtcttcagctttagcctgtcatgaaagatggtctcaccatatt

SEQ ID NO: 93910 - DNA, 601 bp, Human
cagataaaaaaaaaattaggatgatagtggcaatgcaggttggaaactgggtcatttttctgaaatcatctttctttgccaatgccatttttgaattctttctgagaattaaaaaacaaacaagcaaacaaccgatgtggaacaatctgtggcagatggttatttcagctctaggtgagtttttgtcattatattctgggaagtggaaattattactttagataatcatctgttattttagtgaactgccagctaggaactattgtagctatacgggtttaggatggggatttttttttttcctagagattaggacataaattattttcatttgaattctgtggaatttttgatgttcagcatgggagggcattttcactatagttccttgctatgagaatgatctctggcatagaagaattggtattccgtgccattctactgaatataaacaagaaatctaacagttcagttgggggtgggagaggtgagatgaaattaggcttaaagaacaagttagcccacttttcaaggtttagcttcccctggaaaatacagcaataaacatctaaaccatggtattcattaccaacgcaagtcc

SEQ ID NO: 93911 - DNA, 601 bp, Human
ttaggatggggatttttttttttcctagagattaggacataaattattttcatttgaattctgtggaatttttgatgttcagcatgggagggcattttcactatagttccttgctatgagaatgatctctggcatagaagaattggtattccgtgccattctactgaatataaacaagaaatctaacagttcagttgggggtgggagaggtgagatgaaattaggcttaaagaacaagttagcccacttttcaaggtttagcttcccctggaaaatacagcaataaacatctaaaccatgrtattcattaccaacgcaagtccctaattaatttattttatgttaattaagtttataattatatagtaaaacatttactttctccctcaagaaattgactgaatcttctgaaggggctttgtgactgtaatttaggtgcaattagccagttaaatttagttagggtttggttcatttagctgctgccggaagatggaaacaggcactgtctcagaagcaagcctggatagagagtatgtgttcctggaggcactcctctcgcctttggacagctagttctgttgtctagaacaactggaag

SEQ ID NO: 93912 - DNA, 601 bp, Human
caagttagcccacttttcaaggtttagcttcccctggaaaatacagcaataaacatctaaaccatggtattcattaccaacgcaagtccctaattaatttattttatgttaattaagtttataattatatagtaaaacatttactttctccctcaagaaattgactgaatcttctgaaggggctttgtgactgtaatttaggtgcaattagccagttaaatttagttagggtttggttcatttagctgctgccggaagatggaaacaggcactgtctcagaagcaagcctggatagagagkatgtgttcctggaggcactcctctcgcctttggacagctagttctgttgtctagaacaactggaagccgaagctctatcaagatatagtttctttcttttttttttttgagacggagtctcgctctgtcgcccaggctggagtgcaatggcatgatttaggcccactgcaacctgtgcctcctgggttcaagtgattcttccggcctcagtctccggagtagctgggattacaggcacctgccatcacaccagctaattttgtatttttgtagagatggggttttaccatgttggccagg

SEQ ID NO: 93913 - DNA, 601 bp, Human
taagtttataattatatagtaaaacatttactttctccctcaagaaattgactgaatcttctgaaggggctttgtgactgtaatttaggtgcaattagccagttaaatttagttagggtttggttcatttagctgctgccggaagatggaaacaggcactgtctcagaagcaagcctggatagagagtatgtgttcctggaggcactcctctcgcctttggacagctagttctgttgtctagaacaactggaagccgaagctctatcaagatatagtttctttcttttttttttttgagayggagtctcgctctgtcgcccaggctggagtgcaatggcatgatttaggcccactgcaacctgtgcctcctgggttcaagtgattcttccggcctcagtctccggagtagctgggattacaggcacctgccatcacaccagctaattttgtatttttgtagagatggggttttaccatgttggccaggctggtcttgaactcctgacctcaggtgatctgcctgcctcggcctcccaaagtgctgggattacagatgtgggccaccgtgcctggccaagatgtagttttataattaccacc

SEQ ID NO: 93914 - DNA, 601 bp, Human
tgtgggccaccgtgcctggccaagatgtagttttataattaccacctatgtgtatattcctcagtcgaggaatgcagagtcaattccacaataaaggatagaggcaaaccccttttgcaaaacatttccttgtggtcccagaattggaactaaagccatggaacagttctcagaccctttctaccatgggtgtgaaatcactggcatttgccagcattcagacacagagtgatatcagcagccaggacccaccatttggctggaaggacatcttacctcccgagaggggtcaagagggcaygagcccaccctgtaggtctctcaagctggggttctggggccttcctccaggaacctaaagacttctttcagtttgggccacccttttccaggaggaaattggaattttggggccactctttcagtttgggccacccttttccatggggaattggaatttttgagcaaagttcctttccatgactttttgcttcataactcatgacaaagaatgtgttttggcccatgatttacaatgcaattgatgtgatcatttgcagtggctgctgagctactgcaggcagggttggtgttcactgct

SEQ ID NO: 93915 - DNA, 601 bp, Human
attcctcagtcgaggaatgcagagtcaattccacaataaaggatagaggcaaaccccttttgcaaaacatttccttgtggtcccagaattggaactaaagccatggaacagttctcagaccctttctaccatgggtgtgaaatcactggcatttgccagcattcagacacagagtgatatcagcagccaggacccaccatttggctggaaggacatcttacctcccgagaggggtcaagagggcatgagcccaccctgtaggtctctcaagctggggttctggggccttcctccaggaacmtaaagacttctttcagtttgggccacccttttccaggaggaaattggaattttggggccactctttcagtttgggccacccttttccatggggaattggaatttttgagcaaagttcctttccatgactttttgcttcataactcatgacaaagaatgtgttttggcccatgatttacaatgcaattgatgtgatcatttgcagtggctgctgagctactgcaggcagggttggtgttcactgctcgtgcctgcgaatggaaagctggaaggcactgaggtactcacattagttctggtt

SEQ ID NO: 93916 - DNA, 601 bp, Human
ttctggggccttcctccaggaacctaaagacttctttcagtttgggccacccttttccaggaggaaattggaattttggggccactctttcagtttgggccacccttttccatggggaattggaatttttgagcaaagttcctttccatgactttttgcttcataactcatgacaaagaatgtgttttggcccatgatttacaatgcaattgatgtgatcatttgcagtggctgctgagctactgcaggcagggttggtgttcactgctcgtgcctgcgaatggaaagctggaaggcactraggtactcacattagttctggttatcagaacctgttagattttttttcatctctattgtaaagttggataactgaggttcagagaggtcccctcacttggccagcatcacatagctcaggagggaaagggataggatccaaacgggtgtttctggttttagactgcttcttgctgcctaaccagcggcaggtgggtttctttcaggcatcactgtagaaatgaatcctttagcacgaaatgcgtggaatgactgtactttttaaaattcaaattccagtggtactagttagtacagacag

SEQ ID NO: 93917 - DNA, 601 bp, Human
tctggttttagactgcttcttgctgcctaaccagcggcaggtgggtttctttcaggcatcactgtagaaatgaatcctttagcacgaaatgcgtggaatgactgtactttttaaaattcaaattccagtggtactagttagtacagacagtccctgacttaggatggttcaacttagaattttttaactttatgatcatgcagtggtgatgagcattcagtagaaagtggttcggtattctcctgtgacgctgagcaggggcagcaagccacatctctcagtcagccacaggattcagagrgtaaacaactgagaccctacaaggttttgtgttgccgggtgattttgcccggttgtaggcaaatataagtgtctgagcagttttaaggcaggccaggctatgctatgatgtttggtaggctaggtgtattaaatacattttcaacgtactatattttcagctcatgatgggtttattaggacataatcccatcatcaattaaagagcttctgtttagttctgggatcttggacagttaaatgatggatggtaaatggccataattgtgatgaatgaaaggaaaattaatatataatccag

SEQ ID NO: 93918 - DNA, 601 bp, Human
gcccggttgtaggcaaatataagtgtctgagcagttttaaggcaggccaggctatgctatgatgtttggtaggctaggtgtattaaatacattttcaacgtactatattttcagctcatgatgggtttattaggacataatcccatcatcaattaaagagcttctgtttagttctgggatcttggacagttaaatgatggatggtaaatggccataattgtgatgaatgaaaggaaaattaatatataatccagtcattcctgctatacccatgtaattacactgtgtcttttcatctatrtgacattttaaattttttactgctttcgcagaaggaaatgcatttgtccatcacatgtttttcaaggcctcttgttctttaaggagatgatgattccttttttaagctaagaatttgcatcgggttatgaagtagatcgccttttccttttaatcactttgacttagccaacaacttcctgtaagttttggaaaacatctcttaaaataatgtcagatgttttgggtacattaaatttttattttaaaaaatctaaaatgcattttttttccagtgtcttaggtctggttgatttttagc

SEQ ID NO: 93919 - DNA, 601 bp, Human
gggtttattaggacataatcccatcatcaattaaagagcttctgtttagttctgggatcttggacagttaaatgatggatggtaaatggccataattgtgatgaatgaaaggaaaattaatatataatccagtcattcctgctatacccatgtaattacactgtgtcttttcatctatgtgacattttaaattttttactgctttcgcagaaggaaatgcatttgtccatcacatgtttttcaaggcctcttgttctttaaggagatgatgattccttttttaagctaagaatttgcatcrggttatgaagtagatcgccttttccttttaatcactttgacttagccaacaacttcctgtaagttttggaaaacatctcttaaaataatgtcagatgttttgggtacattaaatttttattttaaaaaatctaaaatgcattttttttccagtgtcttaggtctggttgatttttagcatggtcaccataatttctaaccaagctgttatatttggaatgccttagctggccctccatactttaaaaagaaaaataaactgcgaaatctggtgtgtgtatatagaaatttatgcccttta

SEQ ID NO: 93920 - DNA, 601 bp, Human
ggttatgaagtagatcgccttttccttttaatcactttgacttagccaacaacttcctgtaagttttggaaaacatctcttaaaataatgtcagatgttttgggtacattaaatttttattttaaaaaatctaaaatgcattttttttccagtgtcttaggtctggttgatttttagcatggtcaccataatttctaaccaagctgttatatttggaatgccttagctggccctccatactttaaaaagaaaaataaactgcgaaatctggtgtgtgtatatagaaatttatgccctttasaatccagggttttcctcatatataaattccacttgaaccaaagaattatgaagggacttcctgcgctccaacatgaaggagtcgaggagaagagagaatccttcagaaagaggtgttgctgtgtaaaaccactgaggttggcacacgccccgctgctgtaagacattgttgagcattaggaaagacagtgaggtgggatgacttagcagcatgggcttattccaaaatgagctctttgagcaaataaaaatgtccctgacagcagaggcttctagaactgtgggttaatttaactcaagt

SEQ ID NO: 93921 - DNA, 601 bp, Human
aaaatctaaaatgcattttttttccagtgtcttaggtctggttgatttttagcatggtcaccataatttctaaccaagctgttatatttggaatgccttagctggccctccatactttaaaaagaaaaataaactgcgaaatctggtgtgtgtatatagaaatttatgccctttagaatccagggttttcctcatatataaattccacttgaaccaaagaattatgaagggacttcctgcgctccaacatgaaggagtcgaggagaagagagaatccttcagaaagaggtgttgctgtgtraaaccactgaggttggcacacgccccgctgctgtaagacattgttgagcattaggaaagacagtgaggtgggatgacttagcagcatgggcttattccaaaatgagctctttgagcaaataaaaatgtccctgacagcagaggcttctagaactgtgggttaatttaactcaagtgaggggttctgttggctgcctcagtcggaacatatataaggctgtgaccctgggattggctttgcacttttcaagtttcctattgagaatctgctttcagatagagtaagctctctgttttaatg

SEQ ID NO: 93922 - DNA, 601 bp, Human
gagggtaatttgtttgaccctcttctagcttaattggtactgctggtggatttgacttttgggacttgcagcaataggcagagacatcggccacacataagcccccctgattgttgctatcttaacacgaatactaaatgttaaagatctccaaactctatttctgaagtattgcttgggatgcctgatgaaaaagtgttgcttcatgacaaattttattttcacctacactctttcttctagggtcagcttaaacttggacctggatttatcttcctgttttggaggcttattatctctrtttttactcttcaataattgtgttcagtctctgaacatgcttgaggggtctgaggcgcatcaataccaaccactttaaaaaaaaatttctcctcctcctcttcctctttctatctcttgattttcatctcccccacaatcattatcgtcatcctcacacaggcactggctgacctatgtgtacttcttttatgtgttttgttgtacattatttactttgtacaaattgattcccagatccactttggtcaatggcctacagtttcagccaaaattgggcagagccaagcaactcacattg

SEQ ID NO: 93923 - DNA, 601 bp, Human
ctcctcctcctcttcctctttctatctcttgattttcatctcccccacaatcattatcgtcatcctcacacaggcactggctgacctatgtgtacttcttttatgtgttttgttgtacattatttactttgtacaaattgattcccagatccactttggtcaatggcctacagtttcagccaaaattgggcagagccaagcaactcacattgtgtatatctgaggttcttgcagattttatatagttataggttgaattgggtaatggatttatatcattaacctcttgtttggactctgyaagtttcagcactctggcttcatatactataaagaactggctagagtattttgacgaaaataaattgaggcacaagatctatggtggcagcagcaactgcatactcttctgtgatgacatatattgcttatctgtactgactatttgaatcactgataagcccctctagacttagaattgtggaatgacatctttaagaaaatgtcatttcactctacagatatcgaccctatagatttttcaatatatgtttattgaagcaagacagaaaggctagacacagcccaggagaacaataga

SEQ ID NO: 93924 - DNA, 601 bp, Human
ctcttgtttggactctgcaagtttcagcactctggcttcatatactataaagaactggctagagtattttgacgaaaataaattgaggcacaagatctatggtggcagcagcaactgcatactcttctgtgatgacatatattgcttatctgtactgactatttgaatcactgataagcccctctagacttagaattgtggaatgacatctttaagaaaatgtcatttcactctacagatatcgaccctatagatttttcaatatatgtttattgaagcaagacagaaaggctagacacascccaggagaacaatagattaatttgggtgtctccatgtggtagtagtaaagccttttgagcatctgagtacctctcaaaccacaaattcttctttctttttctctactccacttaaagcaattttaggtgattctgtggatggggcaatggtatcagtctttggatgcattccccatcctctgtgaagtctctgaaatggtagttgttgagtcctcggacacttgtcatcagagcctgctgattagagcacattccccttagaattgttgagttttaactgtgcaataactttggctttc

SEQ ID NO: 93925 - DNA, 601 bp, Human
tgcagccttcactatacttctgagaaaaatgtgatttcgtactggaagctttggaatgcctggactcacccagttgccaatgagaagcagtagatcctgcattgtgttgcatccttcattctccttcaattcagttgggttgttgagtacactgaagtttgctatggtttgaatgtttgtcccctctgaaactcatgttgaaacttaacccccaatgtggcagtatagagagttgaggcctttaagaaataattgggtcatgaggcctctgccctcatgaatagatgggttcattcatggmtcagtggattaatggattgtcacaggagtgggactggtggctttatacaaagagtaagagacagctgtactagcacactcagcctcctgggcatgtcatgccctgtactgcctttgaactctgcaaagatttcccaccagcaagaaggccctcacaagatacagccccttgaccttggacttgtcagcctccataactgtaagaaataaattccttttctttataaattacccagtttcagatattctgttataagcaacagaaaacagactaagacaaataaaactcaacatttagacc

SEQ ID NO: 93926 - DNA, 601 bp, Human
gcaaaaggggtgttttagggatgtttaagcaacttctggattgagcacagagaagaaaggaccaggaccaagaccaggacctaaatttatatatggggagatttctgctacaggtgcagatgatacctttgccaaagagggactgacaattccgaggctctgagtttagatttcagctctctcattcattcttgggtgaccttggacaattcatattcaccatgtgagttgagccagttatctataaaatagaaaaagcgacaacagcaagggatagttggtgcagcaaccaacagatatraagtgctccacaaatatcaaattaagacaataggtgtttaagcccagatgctgaacaaagcacaactgtaccttgctcacatctcactttgtgatggaaagtttttgaacccactgtattctagacacacgatgttatgagaacataggagtttattatttcattttacctagtaaacattttccagaagacttaaaaggcatttgttttgctttccaatgaaggtgagctgctaccttggtgccccatccaccagatcatctccaatggcaccatgccacgcagatgctcaagttggca

SEQ ID NO: 93927 - DNA, 601 bp, Human
gagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtrtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagc

SEQ ID NO: 93928 - DNA, 601 bp, Human
gtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcatt

SEQ ID NO: 93929 - DNA, 601 bp, Human
gaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccacygtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaat

SEQ ID NO: 93930 - DNA, 601 bp, Human
tttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcrtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattcc

SEQ ID NO: 93931 - DNA, 601 bp, Human
gaaccatatggggtgagttatttttccttgacaaaaccctgagacatatgttatattctttaatgtatgatctcattttatcttccatcaaatctcttccaactccagtaaatatttattaagtgtcaattatagttgaccctttaacaatgtgggggttaagggcaccaatcccctgcacatttgaaaatatgagtataatttttgactgccccaaaacttaactactaatagcttactttttttctttctttctttctttttttttttttttttggtgacagcgtcttgctctgttgcycaggctggagtgcagtggtgcgatctctgctcattgcaacctccgcatcccaggttcaagtgattctcctgcctcagcctccctagtagctgggactacaggcgtgcaccaccacgcccagctaatttttgtatttgtaagagagatcgggtttcaccatgttggccaggctgatcttgaactcccgacctcgagtgatttgcctgcctcggcctcccaaagtgttggaattacaggtgtgagccaccgtgcccagccaatagcttacttttgaccagaagtcttactaattccgtgaac

SEQ ID NO: 93932 - DNA, 601 bp, Human
taagtgtcaattatagttgaccctttaacaatgtgggggttaagggcaccaatcccctgcacatttgaaaatatgagtataatttttgactgccccaaaacttaactactaatagcttactttttttctttctttctttctttttttttttttttttggtgacagcgtcttgctctgttgcccaggctggagtgcagtggtgcgatctctgctcattgcaacctccgcatcccaggttcaagtgattctcctgcctcagcctccctagtagctgggactacaggcgtgcaccaccacgccyagctaatttttgtatttgtaagagagatcgggtttcaccatgttggccaggctgatcttgaactcccgacctcgagtgatttgcctgcctcggcctcccaaagtgttggaattacaggtgtgagccaccgtgcccagccaatagcttacttttgaccagaagtcttactaattccgtgaacagttggttaatacatagactagtatctacatgtattttacgcattcatgacatatttaacttttcgttaattttttcaatatttctatgttacaaggttcatctgttaattttttcaaa

SEQ ID NO: 93933 - DNA, 601 bp, Human
gaactcccgacctcgagtgatttgcctgcctcggcctcccaaagtgttggaattacaggtgtgagccaccgtgcccagccaatagcttacttttgaccagaagtcttactaattccgtgaacagttggttaatacatagactagtatctacatgtattttacgcattcatgacatatttaacttttcgttaattttttcaatatttctatgttacaaggttcatctgttaattttttcaaattgtttcaaatctcctaaaaatttcgaatatattcattgaaaaaaatttgtgtataagcrgacctaagcagttccaacctgcgttgttcaaggatcaagtgtgtatgtcggccagtgagctaggtgctgggaggtacctccacaaaccaagcaactccatctttggccttatgggctatggcctaatggtagtgtgtataatattgatactatcactgcccataataagagaacaatggcttaaaaagttaaatgacttttccaagggcacacacatcagatttgtctgcctataaaatctctgcttctggcattgtttctctgaggccaatgattttcctttgtctcttgggtgtctct

SEQ ID NO: 93934 - DNA, 601 bp, Human
tacatagactagtatctacatgtattttacgcattcatgacatatttaacttttcgttaattttttcaatatttctatgttacaaggttcatctgttaattttttcaaattgtttcaaatctcctaaaaatttcgaatatattcattgaaaaaaatttgtgtataagcggacctaagcagttccaacctgcgttgttcaaggatcaagtgtgtatgtcggccagtgagctaggtgctgggaggtacctccacaaaccaagcaactccatctttggccttatgggctatggcctaatggtartgtgtataatattgatactatcactgcccataataagagaacaatggcttaaaaagttaaatgacttttccaagggcacacacatcagatttgtctgcctataaaatctctgcttctggcattgtttctctgaggccaatgattttcctttgtctcttgggtgtctctaggctgcaagttctgagctagccataagatctctgctcttcattttggtggctgtaattcttcttgacttggtgtaaatgcatgaagtatccctgcccttgtaacctgttttcttttttttatttctctttt

SEQ ID NO: 93935 - DNA, 601 bp, Human
tcattttggtggctgtaattcttcttgacttggtgtaaatgcatgaagtatccctgcccttgtaacctgttttcttttttttatttctcttttatctttttttaaaaaaatcattttcttctcttttctttcagttctctttttactcaagacaaacaccataaatatgctttgtcttttctttaattttcacactttaaaattttcaaattggttgggcggaatgtacttagcttgcatgtttatgtgtgtgtgcgagagagagagagcaaggaaagggcacaagaatttacacacacamacacacacacacacacctatggaataggaataccatgtattttcagttctatttgatcaaatgggaatgtaatcccagtacatacaccatttaccattatcacctcctcagtgcttactgtgctgtaacactcccagctcttcttaaaaaactttccatgttgtattttttgctctttgtttttacttccttataaatagcaagaagttttgctgagaagaaataattacaaatcccaaaaggttggtgttccgttctgagctccaagatgtaaggattgagtggatttcaaacttggca

SEQ ID NO: 93936 - DNA, 601 bp, Human
attcttcttgacttggtgtaaatgcatgaagtatccctgcccttgtaacctgttttcttttttttatttctcttttatctttttttaaaaaaatcattttcttctcttttctttcagttctctttttactcaagacaaacaccataaatatgctttgtcttttctttaattttcacactttaaaattttcaaattggttgggcggaatgtacttagcttgcatgtttatgtgtgtgtgcgagagagagagagcaaggaaagggcacaagaatttacacacacaaacacacacacacacacctatggaataggaataccatgtattttcagttctatttgatcaaatgggaatgtaatcccagtacatacaccatttaccattatcacctcctcagtgcttactgtgctgtaacactcccagctcttcttaaaaaactttccatgttgtattttttgctctttgtttttacttccttataaatagcaagaagttttgctgagaagaaataattacaaatcccaaaaggttggtgttccgttctgagctccaagatgtaaggattgagtggatttcaaacttggcaaaatttctgacttggca

SEQ ID NO: 93937 - DNA, 601 bp, Human
gctgagaagaaataattacaaatcccaaaaggttggtgttccgttctgagctccaagatgtaaggattgagtggatttcaaacttggcaaaatttctgacttggcaaatgcttccatccttatttatgacagcttggaaacttccattttccagggtttataaatgatgctgctgattttgtctcctttttttattttgctgtgaattataaaataaccagcctgaaggtttccttataatattaaccctcttagcagagagggagagaagtagagagagagagagagagagagagagaggagagagaatgtgtgtaaattgctgtgttctttcttttcttggttatgaggtgcattttacatatttcataagcccatttacttccctttttctgcctttcaacaaaatgaaaatctagaaatgttgaggtttgggatacagagagtgacaacctgtgtttgtcattttcaccataaaggacttcttggccagcagtcctctaagggatgatacatttcatctccaaattgcaatttagcatttggaattctggagcaagataggtaatgcataaagtatcagagagtctttttctagtgg

SEQ ID NO: 93938 - DNA, 601 bp, Human
gagaagaaataattacaaatcccaaaaggttggtgttccgttctgagctccaagatgtaaggattgagtggatttcaaacttggcaaaatttctgacttggcaaatgcttccatccttatttatgacagcttggaaacttccattttccagggtttataaatgatgctgctgattttgtctcctttttttattttgctgtgaattataaaataaccagcctgaaggtttccttataatattaaccctcttagcagagagggagagaagtagagagagagagagagagagagagagagaagagagaatgtgtgtaaattgctgtgttctttcttttcttggttatgaggtgcattttacatatttcataagcccatttacttccctttttctgcctttcaacaaaatgaaaatctagaaatgttgaggtttgggatacagagagtgacaacctgtgtttgtcattttcaccataaaggacttcttggccagcagtcctctaagggatgatacatttcatctccaaattgcaatttagcatttggaattctggagcaagataggtaatgcataaagtatcagagagtctttttctagtggtgt

SEQ ID NO: 93939 - DNA, 601 bp, Human
gcttgccatctctctgtaaaacacaatgaccaacctacaccctggacactcctggctgaacatctgggttgagtgctttcggaaactccacttccttaaatgacctactgtcagtttcattggttaaaagggcttctactacaatcattttttttttttaaaagtacccaggctgggcaagtcaacattttgaaatgtttaaaaaatgtaatttttgagctgtagctacccttttatttatggcaacataaaacaacatctgaaactaagacctgtttttgtttttctcgcctacatactraaaccacgagtgatttttatttcatttcattttgtgttccccatcaaacaaatttcctatcatgacagctcttgttattgattcatattctttcagaagagtgtttatggaagtgtacatcaatgccttgccaggcatgaggaccaagtcggagtggtacagagcgatgcatcctcttacacaattactcactcctggacttcagcagcccttgcattgaattgttttcaaggaaaatgagaccttattcagatgcaaccaactttattgagtactttctatgtggtagaccataggttc

SEQ ID NO: 93940 - DNA, 601 bp, Human
taggctcctggggactgtgtcaaatggaatgctacatgccttctctgaagatagtagcttgttagtgtttactgacaaatgtggacccttgtacaggattgtttgttttgttttttttttaaagaagccagaaatctatggtgttttttttttgttgtttgtttgtttgttttgagatggggtcttactcttgtcacccaggctggagtgcagtggcacgatctcagttcactgcaacatctgcctcccaggtttaagcaattctcatgcctcagcctctccagtagctgggattacaggygggtgccaccacacctggctaatttttgcatttttagtagagatggggtttcgccatattgtccaggctggtcttgaactcctgacctcaagtgatccgcctgccttggcctcccaaaatgctgggattacaggtgcaagccacagcgcctggcccagagatcaattttcacatgaaattttctaattttaaaatgtcttcaggtcatatgaattttgtttgtttgtttgtttgttttttgttcttttttaagcaggtaatagtcaaacaaagcacatctgagggcaggttcactctatg

SEQ ID NO: 93941 - DNA, 601 bp, Human
actgacaaatgtggacccttgtacaggattgtttgttttgttttttttttaaagaagccagaaatctatggtgttttttttttgttgtttgtttgtttgttttgagatggggtcttactcttgtcacccaggctggagtgcagtggcacgatctcagttcactgcaacatctgcctcccaggtttaagcaattctcatgcctcagcctctccagtagctgggattacaggcgggtgccaccacacctggctaatttttgcatttttagtagagatggggtttcgccatattgtccaggctrgtcttgaactcctgacctcaagtgatccgcctgccttggcctcccaaaatgctgggattacaggtgcaagccacagcgcctggcccagagatcaattttcacatgaaattttctaattttaaaatgtcttcaggtcatatgaattttgtttgtttgtttgtttgttttttgttcttttttaagcaggtaatagtcaaacaaagcacatctgagggcaggttcactctatggactcctagatttggtttctgccctaatgaatgctacacaacagcttagaatggctttgtttctctaaac

SEQ ID NO: 93942 - DNA, 601 bp, Human
ggttccttattattttcctgtctccttatgctttagagcagcctaagggtgtgtgtgtatgtgtgtgagcatgcgtgtatgtgtatgagcatgcatgcgtgtgtgtgtgtgtgtgtgtgtgtgattttggcttaatttttctttctttgaactgttcttagcctataagagagaaaggagatgttatagattattgaacaaaatatgctcataccctatgccaggtagaggcagtttaatctccaaagcttttctcaatatttttttaaaaaagtattttgaaataaccatagaatggtartgaactaattatgatcccatattctgtgtttacttcttccctcaagtgatttttaaaaatcctactggcattgtattttttaaacaatatatgaattacaaagtagtaaagatttcctataatcctgccacccagaaatatttcatttagttttcctaatgcttttctgtgcctataattgttctgtgcttgaatcatattgtatataaatatttttatttcctattacatgtactgaacagtatatttacaaggatttcttcatggagttaacatttgtcataaataaacttttccatc

SEQ ID NO: 93943 - DNA, 601 bp, Human
cagagtctgcattcttgtaagagaaaagaagagacttcagggcctaggccacatgatggataatcaacagaaggggtggtcagcacaggtgatcacaggatgtaagtacacttaggagattctcacagttctcttttcttagtgactggaagagtaggttctgattcaaagtaagataaacctctaaaaaaggcaagatattttagctcagacggaaagatctttcactgccactgaaataaaatttgtaaattattcttcatgatcatacccagttaactccaaaataattcagaaattkcatttgttttatgcctaaaaaacatagttgttttctaaatacgaagaggtgttagggttttctttccaccttgaccttcagaacatggaatctgatgaagcttaatattcttgtattctcttgttacccgtttctctccatataactggaaacctagtggctttcttagattcttaataagttacatgcctgtgatgttaagttaacaatcacaatttaattcaatacacaagcaattggcacccacacagggatgctaggcattttaaagaggttcagagatatgagacataccttcaa

SEQ ID NO: 93944 - DNA, 601 bp, Human
cttcagggcctaggccacatgatggataatcaacagaaggggtggtcagcacaggtgatcacaggatgtaagtacacttaggagattctcacagttctcttttcttagtgactggaagagtaggttctgattcaaagtaagataaacctctaaaaaaggcaagatattttagctcagacggaaagatctttcactgccactgaaataaaatttgtaaattattcttcatgatcatacccagttaactccaaaataattcagaaattgcatttgttttatgcctaaaaaacatagttgtttyctaaatacgaagaggtgttagggttttctttccaccttgaccttcagaacatggaatctgatgaagcttaatattcttgtattctcttgttacccgtttctctccatataactggaaacctagtggctttcttagattcttaataagttacatgcctgtgatgttaagttaacaatcacaatttaattcaatacacaagcaattggcacccacacagggatgctaggcattttaaagaggttcagagatatgagacataccttcaaaggtttacgtcctcacagggaattttaagttcac

SEQ ID NO: 93945 - DNA, 601 bp, Human
attctcacagttctcttttcttagtgactggaagagtaggttctgattcaaagtaagataaacctctaaaaaaggcaagatattttagctcagacggaaagatctttcactgccactgaaataaaatttgtaaattattcttcatgatcatacccagttaactccaaaataattcagaaattgcatttgttttatgcctaaaaaacatagttgttttctaaatacgaagaggtgttagggttttctttccaccttgaccttcagaacatggaatctgatgaagcttaatattcttgtattmtcttgttacccgtttctctccatataactggaaacctagtggctttcttagattcttaataagttacatgcctgtgatgttaagttaacaatcacaatttaattcaatacacaagcaattggcacccacacagggatgctaggcattttaaagaggttcagagatatgagacataccttcaaaggtttacgtcctcacagggaattttaagttcacaagaaaaatataacaaggtagagcaagataaagatattaaagaaccaagtgctacagtgatcagagaagctatttcttgctgca

SEQ ID NO: 93946 - DNA, 601 bp, Human
aggcaagatattttagctcagacggaaagatctttcactgccactgaaataaaatttgtaaattattcttcatgatcatacccagttaactccaaaataattcagaaattgcatttgttttatgcctaaaaaacatagttgttttctaaatacgaagaggtgttagggttttctttccaccttgaccttcagaacatggaatctgatgaagcttaatattcttgtattctcttgttacccgtttctctccatataactggaaacctagtggctttcttagattcttaataagttacatgcytgtgatgttaagttaacaatcacaatttaattcaatacacaagcaattggcacccacacagggatgctaggcattttaaagaggttcagagatatgagacataccttcaaaggtttacgtcctcacagggaattttaagttcacaagaaaaatataacaaggtagagcaagataaagatattaaagaaccaagtgctacagtgatcagagaagctatttcttgctgcagagatccagggaaggattcctgggaagctgacatttctgctggtcctgaaaggagcagtaagaggataaaag

SEQ ID NO: 93947 - DNA, 601 bp, Human
ataccaacagtcaccatcatacttactgataaaatctaagaaattttcccattaatatctgaagcaacacaagaatgcctatattattaccattattttatcacatcctggaagttctggctaatggcataagacatgaaatggttataaaaggtttgcttatggaaaaggcaaatatattaataattatagatattatgctttcttcaaaaatagtggagaatcaaattacaaatccaataataaaactagaggtcctataatctggctggataccatatacaatatttagtggctttcscatatgttagcaataatgttagacaatataatggcaaacgtgtcactcagaataggaaaacaacaacagcagcaggaacagctatagtacatccagaagaaaatagcgacagagatggggaggaagttatgtggacaagattgttagtctccacagaacttacaatagcaaaaaaaaggaaaaagaaaatagtgtgcagtaataccagaataattaaccgaattcattgagtgatggtaaaattgcagagataataaaataaagtacatgctcgccatacaatgttaagaaaaaatgtac

SEQ ID NO: 93948 - DNA, 601 bp, Human
acatcctggaagttctggctaatggcataagacatgaaatggttataaaaggtttgcttatggaaaaggcaaatatattaataattatagatattatgctttcttcaaaaatagtggagaatcaaattacaaatccaataataaaactagaggtcctataatctggctggataccatatacaatatttagtggctttcccatatgttagcaataatgttagacaatataatggcaaacgtgtcactcagaataggaaaacaacaacagcagcaggaacagctatagtacatccagaagaaratagcgacagagatggggaggaagttatgtggacaagattgttagtctccacagaacttacaatagcaaaaaaaaggaaaaagaaaatagtgtgcagtaataccagaataattaaccgaattcattgagtgatggtaaaattgcagagataataaaataaagtacatgctcgccatacaatgttaagaaaaaatgtacaatattacactattttcagtgtatattgtatatgcattatgatcccaaacttattttttatgcagtaaaaatgatgagatcaagatgttattatcagacatg

SEQ ID NO: 93949 - DNA, 601 bp, Human
agctatgctgccgccttctccctaatccctgcaaacaggcagcgtgtgaggagtctgccagcacatcaagtgtgtctgcaaaatgcagacaaattgctgctctttattagaggtacggatgaaggactctgggaagctctgaaactacagggctttgggtttcttggctacttttttctcaagctctactttcagaaatacgatgttagtaagtggtacatttcactgccaacatccctcccttcctcctttcattcctcgttctttccctttcttcctcctcctcctcctccctcctttyttaaaaatttagaaataaaataagaccttcttattgctttttcttgctgattaggaaaaatagccagccagttctaagtttggtcctttgtgagaaatgtgtcctctgcctggcgtcagtcatgctctcatgtgaacattcccttgaatttgtcctgtttccagctcatcctctgctaccttgatgcattccaggaccacaatcattgacaattctttttttttttttttttttttttaactctttctcactctgctcttgtcttcgctttgtctaactttgattctgtggtcgctggtt

SEQ ID NO: 93950 - DNA, 601 bp, Human
ttacagaaaaagataacccttaaaacagaaaagatgatttctcctcctgctgcacatacaacacagtttggcaggggggactctattcatttcagtctctcaggaacccagaacctcatgatgctgccttctaaacaccaggcttcatagttcactgtggcaggatgaagaggaagcgaaaaacccaggactgactattcaattttctgcctagaagtgctgggtcatttctgcttactttttcattggcaaaagcaagcaccatggatcggtgggtgggggagtccaattatcttctggrcaaggaaggagaggcaagaagagcaacatctaacgtaatcatggatccgtgctataccaaatttggttctcaattgaagaatgcaatggtgaaaagttgcaatccatccaagatttattcatttattcattcagctctttagtatctacaatgaaccaggcactgtactcaatgctagaaatacagtggggagacaagacagaaatatgtattgcttttaaagaacttacagtttaggaggaggttacaagtaagtagatagctaaaaattcagagtgggatggaactatgacagagaaa

SEQ ID NO: 93951 - DNA, 601 bp, Human
gttgttctcatccattccacaagtgtttattgagtgtttatgcaaagcattggagatagtggtaaattacacagacaagatccctgtagcaaatgctgttggcgtcaccccctgcccgtgtcctctcagctctcaccaccccagcacttgactgcagagtcttgctgcaaccactcatgactctgcataaggaccttctctgggctgggggtggtggctcatgcctataattccagcactttgggaggccaaggtgggtggatcatgaggtcaggagatcaagaccatcctggctaacacrgtaaaacctcgtctctactaaaaatacaaaaattagccaggtgtggtggcacatgcctgtagtcctagctactggggaggctgaggcaggagaattgctggaggcagaggttgcagtgagctgagatcgcaccactgcactccagcctgggcaacagagtgagactctgtctcaaaaaaaaaaaaagaaaagaaaagaaaaaagaaaaaaaaaagaaacaaacaaaaaaaggagcttctcttagctggaagccttcagtcaatgacaggtgggagttggagggtaaatgacccagcttcc

SEQ ID NO: 93952 - DNA, 601 bp, Human
aaatggcaaagtaggggaaatgtaccaatgtcaggaggctgctcaattccaaaccatccaccctatgcttgttcatcctggccatataaggagctgtttcctgtcactttccatcctgacgtcagaccttgtcttgttgggcagtctctatcactgtctgtccagtgatccaaaaatgaccagccggctgaggcagcctggccagatggggcctggagggggaaaagtcaccttgactctcgctagctccatggattccaaggttaaagttcttaaccagcaaaggggaagtggagacttkgcaaagttagaacatgaagctcaagtagtcagggcttctaggcagctccctaggggcaaatttcagacacagctgatcatagtcactttgccaagatatcagagggatgatcctgcctgggcagtcttaaaggtgttctgttttacgggtttgatgtgtatgcgtgcgtaggtgtatcccgtgtgtttttggggaaggtggtaataaactctcccatgacagtcctataagacagggtcttgcttctgctaaatagcaagtcattgcaaccacttaaatatttttccaagccaatttgca

SEQ ID NO: 93953 - DNA, 601 bp, Human
gaaggtggttggggtgttgtctctggattggttggtttgcatttgaaaggcatgctcccaggcagggtatttaccatctgtaggaactgactcaccaggggtgggaggggccattcctccaggattagcacggccccagatgtcaaagcaccagaatccagaatataaaaaggcttgcttagtacagctgctcaagagtactaacccttcccctcaccttgaaggcactgttggtattgagagaagaaaactcccccagatgaacttcgtgattcttatcacaggaaattaagtctacatkaggcttagaaatgtctgtaaagtcatagtacaggatgtgtgaccaagcagacatattaaaataaaaatgggctaaaaatgtttccagacttaactcatgtttttcagctgagtaattagaactatttaccctaaatcagccaagtgtgcacctacctcgccatttaaaactttatatgaatattataatacattttttcaagtcctcatatgaatttcgtttaacacacggtgatgtgcccctttattcttctgtctttttcatggtgcctgctcaaacacatgcatagacatacaaaga

SEQ ID NO: 93954 - DNA, 601 bp, Human
tgtaggaactgactcaccaggggtgggaggggccattcctccaggattagcacggccccagatgtcaaagcaccagaatccagaatataaaaaggcttgcttagtacagctgctcaagagtactaacccttcccctcaccttgaaggcactgttggtattgagagaagaaaactcccccagatgaacttcgtgattcttatcacaggaaattaagtctacatgaggcttagaaatgtctgtaaagtcatagtacaggatgtgtgaccaagcagacatattaaaataaaaatgggctaaaawtgtttccagacttaactcatgtttttcagctgagtaattagaactatttaccctaaatcagccaagtgtgcacctacctcgccatttaaaactttatatgaatattataatacattttttcaagtcctcatatgaatttcgtttaacacacggtgatgtgcccctttattcttctgtctttttcatggtgcctgctcaaacacatgcatagacatacaaagacacatcctgtgatatgcacagacaggctgctgtcaaattatgtagacattcattgtcccgctgagagcttcttctgcc

SEQ ID NO: 93955 - DNA, 601 bp, Human
tatcagcctcctcaaaaatgattgaatgctgctctgatgttcatgaacttcagagcatcctgggccagaggagagtcagagaagaaagcaactggggtcaatgcatttctaatggttccaggggctccagaaggaaatattgctggatctctgacagcacgtggagtcttttaaaatgaaactcctgtacaaaggcataagaatgataccaaggacttccgggactgtggggaaagggtgggaggggggtgagggataaaaggctacacattgggtacggtgttgctgcttgggtgatgartgcaccaaaatctcagaaaccactaaagaacatattcatgtaaccaaacatcacctgttccccaaacaactattgaaataaaaagaaattttaagaaaaagaaactcctgcatttctgggggtaaaggtggtgcctggaatctactgagaaacatgcagccttggctgcagtccttcagggagcgcaggcagtagcatgttttagtaatcttgcaggagggaacagccatgccgggaaccaaggaagggagtcagtggtgagaaggttttgttgacaagatgcggaaaccttagcataac

SEQ ID NO: 93956 - DNA, 601 bp, Human
cgcaggcagtagcatgttttagtaatcttgcaggagggaacagccatgccgggaaccaaggaagggagtcagtggtgagaaggttttgttgacaagatgcggaaaccttagcataacacatcttaattttcttttttttttttttttttttttgaaactgagtctcactctgtcacccaggctggagtgcagtggtgtgatctcagctcaccacaacttctgcctcccaggttcaagtgattctcctgtttcagccccccgagtagttgggattacaggtgcacgccaccacacctggctmatttttggacttctagttgagacagggtttcaccatggcggccaggctggtctcaaactcctaacctcgtgatctgcctgcctcggcctcccaaagtgctgggattacagatgtgagccaccatgcccggccaacacatcttcatttttaattgatggccagaagctggatgatctaggcctgtcagggagcaagtagcagaacagggatgattaggagtattggaaagaacttgtctttgtagttattcttggcaggatttctgctgtatcctaatgcaggtgaactaggcacaagacg

SEQ ID NO: 93957 - DNA, 601 bp, Human
gttttcagaattgctgtgcttctcactaaaatagttaagtgtgagggaaaaggtaaaggatggaagtgctgaaacatgcatttagtagggggggttggaagaaagcacatttccttgcgtaggaagtagcaattcagacatttccctggcatggcatttgccttggctgggcatttgattctgccttttcactccctattgtcttttctctttattctttctctgggcttgtgccagtagtcgggtcagtggtctgcttccatgggaccctgcctgtgtaatacatatcttgtgcacctcscacgtagacagtgcctgtcatgagccactgccgtcttcgttggtttgaagctttcacgtagacctttatctttgtgcatctaattttggttgcaaacagtatgagtttagtggctaatgggtaaattgtttagacaagatacagtagactgtatgtgtgagcatatacattctgagactttgggctagaaaatttgtcttgtacaaaaaatgctatgattattaatttagtataaagacaccaagttatgactataaatagtattacagctaacaacaaagcaggtaactttgccatggg

SEQ ID NO: 93958 - DNA, 601 bp, Human
tgaaacatgcatttagtagggggggttggaagaaagcacatttccttgcgtaggaagtagcaattcagacatttccctggcatggcatttgccttggctgggcatttgattctgccttttcactccctattgtcttttctctttattctttctctgggcttgtgccagtagtcgggtcagtggtctgcttccatgggaccctgcctgtgtaatacatatcttgtgcacctcccacgtagacagtgcctgtcatgagccactgccgtcttcgttggtttgaagctttcacgtagacctttayctttgtgcatctaattttggttgcaaacagtatgagtttagtggctaatgggtaaattgtttagacaagatacagtagactgtatgtgtgagcatatacattctgagactttgggctagaaaatttgtcttgtacaaaaaatgctatgattattaatttagtataaagacaccaagttatgactataaatagtattacagctaacaacaaagcaggtaactttgccatgggattgatccattattgttataaaagtattttgtagacaaaagtggtgcagatactcacagaatatgaaga

SEQ ID NO: 93959 - DNA, 601 bp, Human
aacaaccaagtgcagagatgctaaaagctggtactcaccctcctcctgggcctcctctggaaccaaagcgcccaccacgaccacggcctctgtcacccctagaaatgcagattttattttgacctcattgaaggaatacccaccggccatatcatcttaggttggctactttcatccctcggaacctcccaacggtaggcaagagaccccactcacacttacacttctccccattccaaatggtgcccagttacacccccataacctcctctaagttaatccaacccccatcaagtaatgrtggggctcagtgagccctacacttaataacccataatcctgggccacacgaatcctaatacttcggaggctaaagattgctcatttcttcactaaggtacacatttatcgggcgtgtcctaatgtcaaggccttcgcactgaggatgaatgcggctcgctccagcattctcagcccggatgacgggggcgggggaaaggtggggagctcctccaggggcttgaggacaccccctcatcgcaacccttcagagacaaaggtgtcgaacccccctccccactcctgggcccgaaccccatcc

SEQ ID NO: 93960 - DNA, 601 bp, Human
tttaggcttggctttggataatagacaactgaaaattaaaagtcaagagccaaggcaatttccacactaccaaagctgccctttcctaaaactaaatcatcaaaaactcaccacttcaaatgtccctggagccacaatcagattatcaatcacattgtttatttttgtcaccagagaaaggatagatgcctgaaaaacagtatgaaacaatacttgaaaatgaaaaattataagcaatttctcagaatttgaatattttctcctaatcccttccatacaagctgactcaatactgacatarggctttaaaaacacttcattctggccttgaatatatgggaagagaacaactctttgtccccagtaaaaataagaatgcatatgtaatttgtttatatatccacctggctatctccacccacaatgagaaataaggagaacaattaaaccctttgtggatttcaggctctgttaacaccattcttaaccttaccaacagttactctttaccaatacttttaactgctttagagacatttctggaagacagccaaaagaacatacctgttcagcagaattgggagccaggtcctgattcctc

SEQ ID NO: 93961 - DNA, 601 bp, Human
cagctcactgcaacctccgcctcccgggttcgagcaattctcctgcctcagcctcctgagtagctgggattacaggtaaccgccatcatgccccactaattttttattttagtagagacggggtttcatcatgttggccaggatggtctccaactcctgacctcaggtgatctgcctgcctcagcctcccaaagtgctgggattacaggcgtgagccaccgcacccgaccaactctgcaattctttaagccaccctgtgtttctcatatcagcaaatcacttgtctaaaaatcactagaarcatgcaagatctgttttcttcaaaagcctatccccctccataaatattttctcagtcctttttaagtcctccaaatgctttcttggtcaccccatctgaaaattccactagcaagctgataaactatttccaaattacagagggagagagcaaagttcagaataaacctaagttcttcaattcccaggaagctgcatgtggaatagcaacaaactaagtaaactaaacagcaacaataccatgttttgaatatcccctaaattttccagcaatggaaaaaaaagaactaacaatggagtt

SEQ ID NO: 93962 - DNA, 601 bp, Human
gaaaacgaatcctcaagtccttcagtagtctgatgagaactttaactctgaaagtaatagtgacccaaacattaaaatcaatacgatcatgtatttccatgcctaaggtagaattgaagctgactatgctatttccagaactatacattctctgctttctctaaatcttaatttgcttccttaaggtaaaaataaaaatccagacacgaggtcacaggcaaaatagttctgtcagaggaagtatgggggtatcctgctattcactgcagttaaaaagtttatcttaatccaaatggttagrgagggactcacgtggactgagaagcattttcctcgaaccagcgggcatgtcggatggctgctaaggcactctgcaatactttgatatccactaaaaagacaagcatgatatgccaggatgaaacattttcattaaacaagctactcattaccactgctacagtcttaaaaacttggaaggagggcaggatagacggagtctcgctctgttgtccaggctggattgcgtacagtggcgtgatctcagctcactgcaacctccgcctcccgggttcgagcaattctcctgcctcagcctcct

SEQ ID NO: 93963 - DNA, 601 bp, Human
ttctgaaatggctgctcactcatttctctctactaccatgattaaatggtagcagtcatgagaagaaaacgggacactataactcagtaactactcatttcattgaatatacaaaaaaaaaaaaaaactttgaattttttctttttttttaaacaaatgtctctgagtcatgtaaatgttgaatttttattggattacttgtctaccaataaaatttcttttaagcttcaccaaatttcagactctggtgaatttcagagttactactactactactactactactactactactactacyagtaaataaggatgatgaggaactccaattgcccatctttacttactagtaggtcaaggatccagggtgtgaggggctcaaagccaggaaaacgaatcctcaagtccttcagtagtctgatgagaactttaactctgaaagtaatagtgacccaaacattaaaatcaatacgatcatgtatttccatgcctaaggtagaattgaagctgactatgctatttccagaactatacattctctgctttctctaaatcttaatttgcttccttaaggtaaaaataaaaatccagacacgaggtc

SEQ ID NO: 93964 - DNA, 601 bp, Human
actataagttcaagccactacaactggctaatttttttttttttctcttgtagagacagagtctcgctattttgcccaggctggtctcaaactcctggcttcaagtgatcctctggcctcagcctcccaaagtgctgggattacaggcatcaaactaaaaccttaaatgatcacgaggaaaactggtcattaaggtctaagtctagccaaaattttcatgttcagaagcaattctgaaatggctgctcactcatttctctctactaccatgattaaatggtagcagtcatgagaagaaaaygggacactataactcagtaactactcatttcattgaatatacaaaaaaaaaaaaaaactttgaattttttctttttttttaaacaaatgtctctgagtcatgtaaatgttgaatttttattggattacttgtctaccaataaaatttcttttaagcttcaccaaatttcagactctggtgaatttcagagttactactactactactactactactactactactactactagtaaataaggatgatgaggaactccaattgcccatctttacttactagtaggtcaaggatccagggtg

SEQ ID NO: 93965 - DNA, 601 bp, Human
cagcttctctgtaccagattacaatacaaaacccctgacccacagtggtcactcacagctggcatcaccctcctggccaaggatcttcctaaagccaccatgtgagaggattcggacgagagtctgagctgtatagcagaccatgtcctgaaggaaagcaaagtgagagtaagcaaggaaaatcaaaggaccttatttgagtaatacccttctgaaaacagagattaagacagctttttaaatctcaggaccaaagtctttcagaatccccaaattcctgacccgtaaagaccatattccrctttgcctgctgagcagcagtattcaaaagagtggggcaaaacaactcagttcatatctgtcccaatacctgctgttctagggtcatgactgtgtgtactctaaagttgccactctcacaggggtcagtgatacccactgaacctggcaggaacagtcctgcagccagaatctgcaagcagcgcctagaacacagggaggtatgaggtattaaaggaatgcacaaaatagtttacaaccaaccctaaacccaaagcatgctgtacctgtatgcaacgtttagggccaaaggctgtctggt

SEQ ID NO: 93966 - DNA, 601 bp, Human
ccatattcacacacttcaacgtgcctgtggattttcagaaaggatgtaaaacaaactgtcaacagccagaatgaccaggcctcttcgaggccagagtcgatgaaatttaagacctgactccagcctgtgagtgcgagagaaggaatgactcttacaccctagtaaggggatgcccatagcgggtagggagtcttcacagatgcacccacagaccccctacactgaggtctatgactccatgaatttggctgtgttttcatttttgataagcccctttccactgctaggcctcagtttccayatatgtgaagtgaggaatgcggactgtgttttctcttggcctccttccagctctgacagtctgtgaatctcctggaagccagctctgggtccagtcctgtcttggggaaattagaccagaaaggcacagagcatacacaagaacccaacagcatcttctgacacaagaccatactcccactggcacatagtatctttgcttacctaattatatgcatggacacacaaacacacacatgtacacaccaggcaagaaaactcacaaccgggtcaggcgcagtggcttgcgcctgtaaccaca

SEQ ID NO: 93967 - DNA, 601 bp, Human
ataacaacagaagcagtgatgagaagaaaacagtgagccaggagctgaagagctgtaaggagcgcaataagaagaatggcaggtggcagatgatcttccaaggcgctgggaagtcttagaaagaagaagaaactaaaatctagagataatggaaagcagagaggtcacttcctccatttccaggcccagaggaagttgaatttaggaaaaaaaaaaaaaaaaccacaatcactgcttgacaaggatataaggaatgctgtcccttcaggagagaacctgaagtttccagtaaaaaagatgaaaggaaacgtctggctgggcacagtggctcatgactgtaatcccaacactttggaaggccaatgcaggaggatcacttgaggcctagagtttgagaccagcttgggaaacacagagagaccacatctctacaagtaacttaaaaattaggccaggcgcggtggctcacgcctgtaattccagcactttgagaggccgaggcaggtggatcacctgagatcaggagttcgaaaccagcctggccaacatagtgaaaccccgtctctactaaaaatacaaaaattatccaggcatggtggcg

SEQ ID NO: 93968 - DNA, 601 bp, Human
aagaagacaaatctttttggaaatgaggagttgagaaaattgaaaggcccagatgttggatgaattgtctgtgcggatgctgaagccactgagaataacaacagaagcagtgatgagaagaaaacagtgagccaggagctgaagagctgtaaggagcgcaataagaagaatggcaggtggcagatgatcttccaaggcgctgggaagtcttagaaagaagaagaaactaaaatctagagataatggaaagcagagaggtcacttcctccatttccaggcccagaggaagttgaatttaggaaaaaaaaaaaaaaaaccacaatcactgcttgacaaggatataaggaatgctgtcccttcaggagagaacctgaagtttccagtaaaaaagatgaaaggaaacgtctggctgggcacagtggctcatgactgtaatcccaacactttggaaggccaatgcaggaggatcacttgaggcctagagtttgagaccagcttgggaaacacagagagaccacatctctacaagtaacttaaaaattaggccaggcgcggtggctcacgcctgtaattccagcactttgagaggccgaggcaggtg

SEQ ID NO: 93969 - DNA, 601 bp, Human
cagggtgtgaggctcaaggtttgaaccaacatttggatgcagacagagaagactcactgaatctctaaagggaacaaagctgattcacagaagaactaaaaaagacttttttttaagttacaaccacgtttaattataaaatactataagcactgccagtggaaggcaaggatggctactgtaacattatattgggggtgcattcaatcagtaaagagaaataaataagtattaagaaagaagaagcaggaagggtgcggtggctcacgcctgtaatctcaacgctttgggaggctgaggygggcggatcacttgaggtcaggagtttgagaccagcctggccaacatggtgaaaccctgcctctactaaaaatacaaaaattagccagatatggtggtgggagcctgtaatcccagctactcggtaggctgagacaggagaattgcttgaacctgggaggcggaggttgtggtgagcagagatcgcgccattgcactccagtctgggctacagagtgggactctgtctcaaaaaaagaaaaaaaaatacaaaaattagctcggtgtgatagtgcacacccgtagtcccaactacttggga

SEQ ID NO: 93970 - DNA, 601 bp, Human
atgctgcagggttggacccagtcagagccttctggggccaccctcctctttctcagaaagctggagaagctcccagtacttagctgctcatttgcacaacccttgtgtcttttcatttatccagctgggtcactagatcaggggaatggcaagggcatggagtatctgggtttttaggggcccttgacagggtatctctcataggcctgtgaaatcaatggcaacagtaaactggatgtcctgatcgaaggacctgttgccagataaacaagcacaaccaaaaagttgactgttgaacaayagttcaacatcaaaccagagaagggtgcctcaggcagggtgtgaggctcaaggtttgaaccaacatttggatgcagacagagaagactcactgaatctctaaagggaacaaagctgattcacagaagaactaaaaaagacttttttttaagttacaaccacgtttaattataaaatactataagcactgccagtggaaggcaaggatggctactgtaacattatattgggggtgcattcaatcagtaaagagaaataaataagtattaagaaagaagaagcaggaagggtgcggtggctc

SEQ ID NO: 93971 - DNA, 601 bp, Human
attcacatccaagctcttcatcttctcatcaagagagcccacatcctgaggagacaccaaagggaagggtagagttagaaactggggttcttgagaaagtagggagggaagaactgtcagctgctattctctcaaggcccttccctcagagagcagtggcacctgccccttctctaaagaagaaggctgcagccccaaaactgcaccgccacggggtgcctctccaaggagcaccagcagagaaaggtgggggggcctgagtcctagtgcttgccgttgtgtaaatacttccacgatggcygcttacaaaccacaaacaggttgtcgctgaatacaaagctggaaagaaatccacacaatcttctctcaccagcacaccactgcagctgctgtgggatcggcccaaggaatgccagcatctcagggagatgctgcagggttggacccagtcagagccttctggggccaccctcctctttctcagaaagctggagaagctcccagtacttagctgctcatttgcacaacccttgtgtcttttcatttatccagctgggtcactagatcaggggaatggcaagggcatggagtatctgggttt

SEQ ID NO: 93972 - DNA, 601 bp, Human
ccatctcagccaggcggctttacttcttcctgatcttcaggtctttcttcttcctgatttccttggccagctccccaatcaatctccagtactcattgaacttgagctccgagtcctgattcacatccaagctcttcatcttctcatcaagagagcccacatcctgaggagacaccaaagggaagggtagagttagaaactggggttcttgagaaagtagggagggaagaactgtcagctgctattctctcaaggcccttccctcagagagcagtggcacctgccccttctctaaagaagraggctgcagccccaaaactgcaccgccacggggtgcctctccaaggagcaccagcagagaaaggtgggggggcctgagtcctagtgcttgccgttgtgtaaatacttccacgatggccgcttacaaaccacaaacaggttgtcgctgaatacaaagctggaaagaaatccacacaatcttctctcaccagcacaccactgcagctgctgtgggatcggcccaaggaatgccagcatctcagggagatgctgcagggttggacccagtcagagccttctggggccaccctcctctttctca

SEQ ID NO: 93973 - DNA, 601 bp, Human; identical to SEQ ID NO: 34698

SEQ ID NO: 93974 - DNA, 601 bp, Human; identical to SEQ ID NO: 34697

SEQ ID NO: 93975 - DNA, 601 bp, Human; identical to SEQ ID NO: 34696

SEQ ID NO: 93976 - DNA, 601 bp, Human
aggagaccccggctcacctgtgtgctgatgacaagagccgcacccatcttgactggggtctttttctctcagcctgaagttttttaggctttatgaagcctgtggtcacctgagtgccagggaagagaaggagaggcaaagctgtcataaaaattaagagacgcagtaagaaaaggaatttggggttggcagtacgtgaaacctgccatgctgaagcaatgcccagctatgcagaaaaacctgccacagggtacccacccctggcactcctccctccttctcagctccttgtctgccccaccccaaacccacacctcccagccacagcccagagccctggccacacagacctgagaccatgcatctttttgacatatccttcacggttcccagggcatcattactcaggcagcgtctgtctcagaacctcagtgtgtgatcccggcccctgaagcagcccctctcccacccatgaggggcttccagctgctctgtgcaggtgagcagatccactctacccaaaggccatcctccttatctcttcccattcagaattctccgtgagactccagtgcccacgcgactttcttttctttttaaa

SEQ ID NO: 93977 - DNA, 601 bp, Human
aattaagagacgcagtaagaaaaggaatttggggttggcagtacgtgaaacctgccatgctgaagcaatgcccagctatgcagaaaaacctgccacagggtacccacccctggcactcctccctccttctcagctccttgtctgccccaccccaaacccacacctcccagccacagcccagagccctggccacacagacctgagaccatgcatctttttgacatatccttcacggttcccagggcatcattactcaggcagcgtctgtctcagaacctcagtgtgtgatcccggcccctgmagcagcccctctcccacccatgaggggcttccagctgctctgtgcaggtgagcagatccactctacccaaaggccatcctccttatctcttcccattcagaattctccgtgagactccagtgcccacgcgactttcttttctttttaaatttacatattatttgtttggggttagtttaaacgtgaacagggtcctacattcaaaactgtctccaagccaagaggttctgcttccccgagaccaaggcactgactggctgattgggtctcattctggaagtattctgttcacccacaaca

SEQ ID NO: 93978 - DNA, 601 bp, Human
gaactggtgctttaagaggtggccacgctgctggagttgttttcccaccccataaagctatgattgtgctccttgctgaggagtctctgccttgtggtcaacttcctgttctcttctggcttctcatctcccttttcttttttctccttaaaagactgtgaatattccataaatccaaagacaactgccagacaacagcatgtggaaacctcagaagggaaagggtgacatatctatgtctatgtattggccagttgtaagataagaactgctggtcccagaaagctaaggatatagttcrgaaagcagaactgaagttgtatatcttttggctgagctatacagaagggtgtgaaggcagggcacagtggctcttgcctgtaatctcagcactttgggaggccaagctaggaggattgcttgaggccaagggtttaagaccaacctgggcaacacagcaagaccctgtctctacaaaaaataaaataaaaattggccaggtgtggtagtatgtacctgtagtcctagctacttaggaggctgaggtgggaggatcatttgatctcaggagttggaggctgcagtgagccatgattgcacc

SEQ ID NO: 93979 - DNA, 601 bp, Human
gctgaggagtctctgccttgtggtcaacttcctgttctcttctggcttctcatctcccttttcttttttctccttaaaagactgtgaatattccataaatccaaagacaactgccagacaacagcatgtggaaacctcagaagggaaagggtgacatatctatgtctatgtattggccagttgtaagataagaactgctggtcccagaaagctaaggatatagttcggaaagcagaactgaagttgtatatcttttggctgagctatacagaagggtgtgaaggcagggcacagtggctcwtgcctgtaatctcagcactttgggaggccaagctaggaggattgcttgaggccaagggtttaagaccaacctgggcaacacagcaagaccctgtctctacaaaaaataaaataaaaattggccaggtgtggtagtatgtacctgtagtcctagctacttaggaggctgaggtgggaggatcatttgatctcaggagttggaggctgcagtgagccatgattgcacctctgcactccagcctgagtgacagagagagactctctcaagaaaaaaaaaagtgagtgaagttgtttggtctag

SEQ ID NO: 93980 - DNA, 601 bp, Human
cagaagggtgtgaaggcagggcacagtggctcttgcctgtaatctcagcactttgggaggccaagctaggaggattgcttgaggccaagggtttaagaccaacctgggcaacacagcaagaccctgtctctacaaaaaataaaataaaaattggccaggtgtggtagtatgtacctgtagtcctagctacttaggaggctgaggtgggaggatcatttgatctcaggagttggaggctgcagtgagccatgattgcacctctgcactccagcctgagtgacagagagagactctctcaagaaaaaaaaaagtgagtgaagttgtttggtctagaaagtttctaatacatcattcagaactgagctacctccacggacatgagcttccaatcaaaattcactaaacataagaggaaacaagtgaacaagaatagaagttaatggaagccacaaactgcagaatcaagctattaaggccaagtgaatggaattttcagatattaaaatgtagaatgaatactaagcaggagtaataaaaagatatccacatctcgacacatggtatcactgtttcacaaactgcagaatgccgaagacagagt

SEQ ID NO: 93981 - DNA, 601 bp, Human
aatgaagacatttatctgcaagcgtaaataattcctggtattccccttcactggcttccctgttaggagaatacacaatgacctgtgatcaagcatattctgatgtgtttcccctaaattttcttcctggtaaaatccttggagcaacactgaagaaaaagctagtaggaaaaaaatcactccattctcaaggccctaacacaatccctgcgacagggtatttcttccatatcccacatgaattatatgcaaagtatatatacatatatacgtatatacatatgtatatatgtatatataygtatatatatactttaattgtactctacaaataattttggatgtagatgctttcatttaatattacatcactaatttttatttatcacgtcatctcaaaaaaccatttaaaactgttccacactgaacaattgaagacatatttaaaagtacagaatattgtattataggccctcatgtagccataacccagattccagcattatcaagaccttaccacatttgtttcatctagcctttgtccccactaaggaattttaaagcaaacaccaaacatcatgccattctattccacacactt

SEQ ID NO: 93982 - DNA, 601 bp, Human
tatccaaattgccagcatcactactcttgcaatttggggccattatgaagtaaaataaggattctttgaatgcaagcactgcagtgccacaacagttgatctgatagcccagatgagtacaaagcgactaacatgggtggcacagacagtgtagacatgctagacaaatgtctgattcacatcccaggtggaacagggcgggacagtgcaagatttcatcattgtactcagaaaggcacacatttaattgttaatttctggaatttttcatttaatatttcagaccaagattgactttgcrtaactgaaatatactgatctttattagtctgccattgcttacgacatagatattacattaaaaacactgtgtattagtctattctcacattgctataaacaaccagagactgggtaaattataaagaaaagaggttgaattgactagttcctcatggttagggaggcctcaggaaacttacaatcatggtggaaggtgaaggctaagcaaggcatgccttgcatggcagcaggagagatgggggagggggaagtgccatacttttaaaccatcagatcccatgagaactcattcactatc

SEQ ID NO: 93983 - DNA, 601 bp, Human
tgcaatttggggccattatgaagtaaaataaggattctttgaatgcaagcactgcagtgccacaacagttgatctgatagcccagatgagtacaaagcgactaacatgggtggcacagacagtgtagacatgctagacaaatgtctgattcacatcccaggtggaacagggcgggacagtgcaagatttcatcattgtactcagaaaggcacacatttaattgttaatttctggaatttttcatttaatatttcagaccaagattgactttgcataactgaaatatactgatctttattartctgccattgcttacgacatagatattacattaaaaacactgtgtattagtctattctcacattgctataaacaaccagagactgggtaaattataaagaaaagaggttgaattgactagttcctcatggttagggaggcctcaggaaacttacaatcatggtggaaggtgaaggctaagcaaggcatgccttgcatggcagcaggagagatgggggagggggaagtgccatacttttaaaccatcagatcccatgagaactcattcactatcatgagaacagcataggggaaactgccc

SEQ ID NO: 93984 - DNA, 601 bp, Human
tggcacagacagtgtagacatgctagacaaatgtctgattcacatcccaggtggaacagggcgggacagtgcaagatttcatcattgtactcagaaaggcacacatttaattgttaatttctggaatttttcatttaatatttcagaccaagattgactttgcataactgaaatatactgatctttattagtctgccattgcttacgacatagatattacattaaaaacactgtgtattagtctattctcacattgctataaacaaccagagactgggtaaattataaagaaaagaggttkaattgactagttcctcatggttagggaggcctcaggaaacttacaatcatggtggaaggtgaaggctaagcaaggcatgccttgcatggcagcaggagagatgggggagggggaagtgccatacttttaaaccatcagatcccatgagaactcattcactatcatgagaacagcataggggaaactgcccccatgatccaatcacctcccaccaggtccctcccttgatacatgtggattacaataggagatgagatttgggtggggacaaagagccaaaccatatcattataccactgg

SEQ ID NO: 93985 - DNA, 601 bp, Human
ctaaacccagctgggcagccattaaatgtcgacattccaaaatctcctttgacttcatgtctcagattcaagtcaccctgttacaaagggtgggcacccaagaccttgggcagctccacctctgtggctcttcacagtacagcccctgcagctgctttcacaaactggcattgagtgtctgtgctttttcaaggtgaccagtgcaaactgtcagtgaacctaccattctggggtctacaggacagctcttctcacagctgtactagccagtgtcacagtggggactctctgtggggggtcygaccccacatgtcccttctgcactgccctagtagaggttcttcataagggctccacccctgcagcagactctgcctgtacatccagtcatttccatacatcctctgaaatcatggcagaggttcctaaacctcaattcttgccttctgcatgcctgtaggtccaacaccatgtgtaagctgccaaggcttgaggcttacacactctgaagcaatggcccaagctgtaccttggcccccaactgctggagctggggcagccgggttgcagagtgctgtgttccaggactgtgcagagcaac

SEQ ID NO: 93986 - DNA, 601 bp, Human
agaggtttaattggctcacagttctgcatggctagggaggtctcaggaatcttacaatcatggtggaaggcgaaggggaagcaaggcacaccttacatggcagcaggagtgagagagggaagtgtcacacttttaaaccatcagatcttatgagaactccctcactatcacgagaacagcatggggaaactgcccccataatccagtcatctcccaccaggtccctcccccaacatgtggggattacaattcgagatgagatttgggcagggacacagagccaaaccaaatcacactgcaaaaaaaaaaaaaaaaaggcaggactctagggggctggcctgcctcatttgctcattctttactgctatgtagccagagaggaaaatgttcacctgattgatgtggccatgcgtggctctgctctgcatttccaggacagcctgtaccacgggaccactggcatcctgtacatgagcgctgccgtcctacaagtacatgccacgattgtttctgagaaactgctggacccaagaatttactacattaattcggcagcctcggtgagtgggctggccaaggacagcagtcttgcctggaggat

SEQ ID NO: 93987 - DNA, 601 bp, Human
ctctggttaatacagacagccactgttggcagaattcatcacagattgcatacccttcccaccccttactcccctcagcacctcgaaaactttgctgctttacttgaatgatgagtcacattattttaagaagtcaatatgaatgtatagtacctacatttttacttggaaattgtacttcagtatgtgttatcagtcatacatagctcattaagaatgtaaatatttaaactacttttggatagatgtggttcaggggaacagatttgttgatgttgtgggtttgtgttagtaaattggytattttccaggtcatgttagtggtaggctttccatttcctgttgtgacatgttggtcataattttcagacggctcaggaagccagatttgatctctgtggtgggtcttatatcaaaccagtatcctgtggggtttggccactatcactgttttgtagaacttccaacttagtttggtagtcaaacttgtcagcagtgatctaaaatgtataatattttataataagtgttaatatttgttgaatgcattctgtgttttcaggctcttttccaagtaatttttgtgaattatctcaatttt

SEQ ID NO: 93988 - DNA, 601 bp, Human
ttttcacactaaccccacgaagtaggtactttcactaatcccgttttacattcgtagaaactgaggcacagaaaatttaactaacttgccctacagtaactgtcagaactgagactgaagcctgggagtatgatttcagagttcctgctctctgctgcaccatagtgtagtttagaatagtcaaaatgctagagaaaaacaaggagggacgtggcttgtaggttcaattataaaagcaatgtaaaattacagagagtctgggaaacagtgtttttaaaaggaatactcataatcttactaytctaataaacattttaattttttaaatatgcacattcacatctgtacataaacattgtagctgtgattcattttggttcttaaagataaatcttcagtgaagtttaatatggagattgaaccccactgcctcactttcattgttgaaatccagagagatttgatctgcaactttgactggaaccaagttaaataaatatatttcttgctatttcttgtgagaaataattgaacagtttctgtcttttaaaatcatgaagactatttagttttcaaagtttctgtcttccacagcaacttt

SEQ ID NO: 93989 - DNA, 601 bp, Human
tgctgcaccatagtgtagtttagaatagtcaaaatgctagagaaaaacaaggagggacgtggcttgtaggttcaattataaaagcaatgtaaaattacagagagtctgggaaacagtgtttttaaaaggaatactcataatcttactactctaataaacattttaattttttaaatatgcacattcacatctgtacataaacattgtagctgtgattcattttggttcttaaagataaatcttcagtgaagtttaatatggagattgaaccccactgcctcactttcattgttgaaatccagagagatttgatctgcaactttgactggaaccaagttaaataaatatatttcttgctatttcttgtgagaaataattgaacagtttctgtcttttaaaatcatgaagactatttagttttcaaagtttctgtcttccacagcaactttttattggtttattgttttatctttcttccttgttataatctgagtgttatatttgtatgtgtgtttattccgttgtcctcttgaaagcctctagcatttatacccgctgcccctgaggaatttgggtttttttgtctgtttttatttatttt

SEQ ID NO: 93990 - DNA, 601 bp, Human
acggacaaaagacatagtcatttcactgaagaggattacacatatagcaaatgagcacataaaaaatgttcagcatcattacccattagggagatgcagattaaagcaacaagatactaccgtacatctatcagaatagctaaaataagaaatagtgacaacaccaaatgctggcaacgaggtcaagaaactggatcactcatacattgttggtagaaatgtacaatggtacagccactctggaaaacaatttggcagtttctttaaaaaacaaatatgtgactactgtatgacccaactrttgtactctgacatttagcccaaagaaataaaggctattcattttcaaaaacctgtacatgcatgtttgtagcagctttattcatagtcaccaaaacatagaaacaagccagatgttcttcagtgggtgaatggttaaacaaactgtggcatatctgttatcatagactactctgataaaaaggaaggaactattgacacatgtaacaccctggatgaatctccagagaattgtgctgagaacaaagagttaatccccatatcatatcatttatataacattcttgaactggcaaaatta

SEQ ID NO: 93991 - DNA, 601 bp, Human
ttttttttttttgaggcagatcttgctcagttgcccaggctggagtgcagtgagtggtgtgatctcagctcactgcaacctctgcctcctgggctcaagtgattcttctgcctcggcctcctgagtagctgggattacaggcactcaccactatgcccggctaatttttgtatttttagtagagacggggtttcaccatgttggccatgctggtcttgaactcctgacctcaggtgatctgccctcctgggcctcttaaagtgccgagattacagctgtgagccactgcgcctggtctaaygtgacatattttgctaaccattgagtatacagtgttgagcaaaaattgagtgtcagacctcatgacacgttctacaatggcagacagatattaaataatcacagaaataaatttaatattcaactgtggtaagtgctgtaaaagagagctataagaactaataatgagaaaatttgatccagatagtaagtgggtcagcgaagctttgcttactaactgcatgactttgggcgagttatttacatgctttgtgcctcagttcctcatttttagtggggacaataatagcacctattcttt

SEQ ID NO: 93992 - DNA, 601 bp, Human
ttccatttctctaatgattagtgacgttgggcattttttcatctgcttgttggacagttgtatatcttaatttgagaagtatctgttcatgtccttgcctactttttttgtttgtttgttggagacggagtcttgctctgttgtcgcccaggctggagtgcagtggcgcaatctcggctcactgcaagctccgcctcctggtttcacgccattctcctgccccagcctccggagtagctgggactacaggcgcccaccaccacgcccggctaattttttttgtatttttagtagagacggkgtttcaccatgttagccaggatggtcttgatctcctgacctcgtgatccgcccacctaggcctcccaaagtgctggggttacaggcgtgagccaccgcgcccggccgtctttgcccactttttaataatgttgttttttgcttgttgaattgtttgcttcttgtagattgtagatattagacctttgtcagacgttagctagattaacagagaaagagacaagatccaaatcaccacacaatcagaaacaacagaggtgacattacaaccaatcccatggaaatacaaaagatccccaga

SEQ ID NO: 93993 - DNA, 601 bp, Human
gaaaagtacaggtcaatatccctgatgaacatagatgtaaaaaccttcaacaaaatattaagagagtgagttgttaaagagaagagggtatgatccaggcagagggagcaacaaaggccttggggcaggagtcaggaaagagcttgataggactgagagattgaaagatcagtgagtctagagtacttcaggaagtacatacttctcaaagtaagatatacaactggccaacaagcatgtgaaaaaatgctcaacatcactaatgattagcgaaatggaaatcaaaaccacagtgagacaycatctcacgccagtcagaatggctattaaaagaagctggggccaggcgcggtggctcaggcctgtaataccagcaatttgggaggccgaggcgggcggatcacgaggtcaggagattgagaccatggtgaaaccccgtctctactaaaaacacaaaaaattagccgggcgcagtggcgggcgcctgtagtcccaggtactcgggaggctgaggcagaagaatggcctgaacccaggaggcggagtttgcagtgagcagcgatcgcgccaatgcactccagcctgggtgacagagcgagac

SEQ ID NO: 93994 - DNA, 601 bp, Human
cttttatgtctgtggcttttacttacgtttcaaaatcatctatattgtcgtgtatagcaatagttaacgtattttcattgttggtgtagtgtcccattgtgtaaacatgcttcaatttatttagttattctacactgatatttcattatttggttgtttttttttttttttcatattttggctattgctaacagtgccactatgaattgtcatgtgcatatgttttagtgcacattatgtacacagttctgtatgatttatatcacagaatggaatgcttagatcatagaatatgtatatytcagcattatcagatactatcagagatacttccatttcttttttttttgtcaattaccctattcaaagatactaccaaagtggatatagcatgtacatttctactagcaatgtgtgagaatactagttactccacatcttcacctatacatgataacagtttttaaaaaattggctattccagtgtggttgcagtagtctctcattttggtttcaatttatgtttacttgatgatttatgagtttaaatgcctttttgtgtgtttattggctttttagattgcctcttttaaagcaccta

SEQ ID NO: 93995 - DNA, 601 bp, Human
tctcttaaaggaatcttttggtgaagatatcatcaattctaatgaaatccagctaatcttttcctttattctaagccagtctcagtcacttatgcctgcaatcccagcactttggaaggctgaggcaggaggattgctcgaggccaggagtttgaaaccaacctgggcaacaaagtgagactctgtctctacaataaaaatggaaaagaaaaaaaattagttttgattgcaccactgcactcctgctaggcaccagagcaaaaccccgtctcaaaaaccaaacaaacaccaccaccaccamcaacaacaacaacaaaaactttttcttttcctttattcttagtgtttttttttgttctgtttaacaagtcttcccatacctcaaggtcacaaagatattctcctgttttgttctagaagttttatttttgtgtattcacatttagatctgcctacctgcagttaattttttaaatatgatgtgggttaagagttcagattcatttttttcccatatgaataactagttgaccccacaccatttgttggaaaaaactttgctttttctaatgtactacagtgacatctttgtcatgtatca

SEQ ID NO: 93996 - DNA, 601 bp, Human
tttgaaaccaacctgggcaacaaagtgagactctgtctctacaataaaaatggaaaagaaaaaaaattagttttgattgcaccactgcactcctgctaggcaccagagcaaaaccccgtctcaaaaaccaaacaaacaccaccaccaccaccaacaacaacaacaaaaactttttcttttcctttattcttagtgtttttttttgttctgtttaacaagtcttcccatacctcaaggtcacaaagatattctcctgttttgttctagaagttttatttttgtgtattcacatttagatctrcctacctgcagttaattttttaaatatgatgtgggttaagagttcagattcatttttttcccatatgaataactagttgaccccacaccatttgttggaaaaaactttgctttttctaatgtactacagtgacatctttgtcatgtatcaagtggctatatttttgtagatctgtttctggactttctactgtgttacattgaaataattgtcttatccatatgccaatgcccaggatatatatgagttttgttttttaaatttgtttttgtcttttattgatttatagtctgtttgcat

SEQ ID NO: 93997 - DNA, 601 bp, Human
tattacatgtatccttgatttattagttctaggcattggtacttttaccacttcatggaaaatgcagggacttcagaatactttacctctttttacccctttctgcttccttaccattttctcaccaggaaataggtcaagaatgaaaatggttgagactattgggttttacctttctttgtttcacttcttttcagaatattgacacttcaagttctggctcccttggatatttactggtttaaaatacaatattttgctgttatttgtcatttgctgtctttatcacagatttttttttctaattttaatgacaaaattataaacaagaaaaatacatatattcataatttgaaacaggtgaaattaatagcatacccattttttctgtgtttaaatagctctttagccctttatgtgaggcagaaaattaactccaggaagtagaaagatataggaagagctgactccttccaccttcccacgttgccgtcaagtgctggtgatgtctttactcatggtcttcaacaggagagagtgccaagcagtaaggatggggcaagggcataaaaaggatctatttgtgttgctcttttatcag

SEQ ID NO: 93998 - DNA, 601 bp, Human
tttaatttttttgtagagatggggtatctcactatgttgctcaggctgatgtcgaactcctgggctcaagtgatcctcccatctcggccttccaaagtgttgggaagctgtctggctcacagtggtgaatacaagttttccaaaatttagtttttgcttgagagctcaaattttttttattggcaacaatatactgtcagttgttttacttgaaaagacaggttgagaaaatgtctggcaaaatctttagcctaaataactaaagtgagtgtgtcagtttttctttcaaagaaaaatggtktaccatgaaaaatgttcagcccacaactcaaatattcagataagtgcttttcctcaggacggaacattgtacaacagtatgagcgaaagtgttctgttcgttctttctactttgttacacagaatattaaaaagatgtgtactcaagagttgtgatttaataaaatgaatacttactgttttatcaagaacatttggaagtgaaacaggcttttgttttctgcaaattcatgttgatgaaaaatataacaactgcttttttttttcttttttttttttttgagatggagtctccctctgt

SEQ ID NO: 93999 - DNA, 601 bp, Human
atgtacaccaccacgcctggctaatttttgtctttttagtagagatggccaggctagtcttgaactcctgatttcaagtgatccgcccgcctcagcctcccaaagtgttgggattacaggcgtgagccaccgtgcctggccaatacaacaagttctagtaaattttggtgccactgttttgatttatgctagatatcaagctgtcttcctcactattgcttttgtactataaatgaaaggccaatacaatgaacaagacaaagaatgttatggtctgcttaataatggccatccccacaccgaattcccaaaacctgtaaatatgttacctttcatgttaaaatggactttgtgattaaatatctagagatggagtgattatcctggattatctgggtatctctgatgtaatcacaagggtccttaaaagagggaggcaggaggatcagagttagtggtagcagacatgataatggaaacaagaagtcatgtgagaaaaaggccataatccgaggaatgaaagtggcctttggaagctagaaaaggcgaggaaacagattctcccctgaagcctccaaaaggaacactgccctgctgacac

SEQ ID NO: 94000 - DNA, 601 bp, Human
tggtagcagacatgataatggaaacaagaagtcatgtgagaaaaaggccataatccgaggaatgaaagtggcctttggaagctagaaaaggcgaggaaacagattctcccctgaagcctccaaaaggaacactgccctgctgacacaccttgatcttagacttctggtctccagaactataagaaaataaatttgtgttgttttaagctactaagtttatggcagtgtgttacgataacagtaggaaacggacacggatatcttagtattatcgaaagtgttgtttttaaccttgtggacmcctgagaaagatttttggggtctctcgacaattcttgaccacactttgagaattctaagataagctagctgccaaatgcacactgggtacatgaataaggtgacttgttatattgtattaaaaactttaagagtgaagggtttatataaaaagggtaaaatgtacatatatgatttcccaattctcttcaaatattatatacacacacagaaaaaacattggaggaaaatacaccaaaataatgtgctttttcttcatgatggaatttggggatttataatttttctttatactttcagt

SEQ ID NO: 94001 - DNA, 601 bp, Human
tctggtctccagaactataagaaaataaatttgtgttgttttaagctactaagtttatggcagtgtgttacgataacagtaggaaacggacacggatatcttagtattatcgaaagtgttgtttttaaccttgtggacccctgagaaagatttttggggtctctcgacaattcttgaccacactttgagaattctaagataagctagctgccaaatgcacactgggtacatgaataaggtgacttgttatattgtattaaaaactttaagagtgaagggtttatataaaaagggtaaaatstacatatatgatttcccaattctcttcaaatattatatacacacacagaaaaaacattggaggaaaatacaccaaaataatgtgctttttcttcatgatggaatttggggatttataatttttctttatactttcagtattttccaaattgtcagcaatttggctgcagaattagaaaactgaatttaaacttccaggtcattccgaggtatatttgtatataggatagaacatattaatagtttaaacttgatgtataactaaatattttgtccatatggtaattgggccttctgttgt

SEQ ID NO: 94002 - DNA, 601 bp, Human
aaaagaatacggtagaagaaatgatggaagtgttgctatttaatattatatgtgagagtcctttatgataattttagcctgagtgcccaaagtttaaacttacttatactttctgcagctatcaaacagactacctacatcatgacattcagatagattatcctgggttcataaaaatcttatatggttggctgggcgtggtggctcatgcctgtaatgccaacactttgggaggctgaggtgggtggatggatctcttgatcccaggaattcgagaccagcctgggcaatatggcgaaaycctgtctctacaaaaaatagaaaaattagctggacatggtggtgcttgtctgtggtcctcaatatgcaggaggctgagatgggaagatcacttgagcctggggaggtcaaggctgcagttagccgagatcagccactgcactccagcctgggtgacagagcaagaccccatctcaagaaaaaaaaatcttatatagttaactttaggtcttagtaatgacttggattgcctaggagaaatggcagagtctaggactgagagagtagaaatacaagatgtggccagagtgtcttgtagtac

SEQ ID NO: 94003 - DNA, 601 bp, Human
aatgacattttacaggatacctgactagtcaagatcatgaaaactaggaaagactgaaaaactaagaccgaaggagttcagggagacaagatagctaaatgcaatgtggatcctgtattgggacctggaatagaaagaggacactcatggaaaaggtgctgaaatctatgtaaagtctggagtttacttaatatacaaatgtcaagtttcttagttttgacaaatgtatcatggaaatgtaacgtgttaacaattggggaaactatgaatgagaggtatttgggacatctctgtactatcwttgcaactttcataaatctaaaattattccaaaatgaagtttatttttaaaaatggactggagttaacttttaaataataaaagcaaaatgtgcttattgtagaaaatataaatgatgaaaaatataaggtagaaaatgaaaactacccataatcctaccacccagagataactgattatttggatatgtctttttctagacttaattctatgtgtatttcactcagcaaataattattagactcctttgtggaccagacatcttggtaggtgctaatgatagagcagtgaagaagaatg

SEQ ID NO: 94004 - DNA, 601 bp, Human
tagctaagcaaggtctaaataatacatgtaaagtttttggtacttttccccaagagtggtgggaaaccactgaagatttttgaatcaagggaatcatacgaactttgtaatttaagaagatcattcagaggccatgtgggcaaatggactgttaggtggtgagagtatggaggtaaatataatagttcagaaaagaaattatagtgtctaggactataggtagtgatagagagtagagagattcaaaatagatttaggagtaaaatcagccagatatactgattgttttgatgtagaatgwgggagtataaggataaatgttctgtatttctagcacatgcagttggtagtgccatttataaggcagagagtttttaatatataaaacactgccttatggtgcaagagcttaatcatttttaatggttgcataataatcagatacacaaatgtattttcagttcccagaaataaaacatctgttaatgtgtagtgaatatgatgttttgaaaattagtggtgaaaggctgggcgcggtggctcatgcctataatcccagcactttgggaggccgaagcgggcagattgcttgagcccaaga

SEQ ID NO: 94005 - DNA, 601 bp, Human
gcctgggccaattgtgtgatgtctgtgaaagcaaactcttcatatttttattcctgtgatatgttatttgggtaaccggatagctatattggaaactaaaacttcttatgtttatgaggtatgaatattataaaaccattttgttttttccatttattttctggcttgtcagttttaagaatttccacctcttctttctttagggcttcaataactttacaactaattgtgtagtttattgattgtcccccagaaaagctttgctgtatcttttttttttttctctgatgcattttgattyggagaatgactgacaatgcaagttaaggtttagtgccatatagtgtgtccaaatgtaaacttaaagcagcctgtattagtcccttctcatgatgctataaagaaatacgtgagactgggtaatttataaagaaaagagatgtaattggctcacagttctgcacgctgtacgcgaagcatagcgtcttctggggaggcctcaggaaacttacattcatggcggaagatgaaggagaagctagcatgtcttacatggccagagcaaaagcaaggagggcagtgagggaggtgctacacactt

SEQ ID NO: 94006 - DNA, 601 bp, Human
gatgctataaagaaatacgtgagactgggtaatttataaagaaaagagatgtaattggctcacagttctgcacgctgtacgcgaagcatagcgtcttctggggaggcctcaggaaacttacattcatggcggaagatgaaggagaagctagcatgtcttacatggccagagcaaaagcaaggagggcagtgagggaggtgctacacacttttaaagaaccagatctcatgagtactctataatgagatagcaccaagtggatggtgctaaacctttcatgtaggctccacaccatgatccrgttacctccctccaggccccgcctccaacattggggattacaatgcaacatgagatttgggtgaggatacagatccaaaccatattacaaccatactgatggattgtaaactacagtttttaacctgcttctattaattagaggggtaaaggttgtaattttttattaatgtttatctcatgtaagtggttttatttataagcattcttttaaaaatctttttggcttggtgcagtggacagtgttgggtgggcctggacaacgttgtaagacctatctctacaaaaaaagaaattaaaa

SEQ ID NO: 94007 - DNA, 601 bp, Human
ttcattatggaagaaattttaaaacatggaaacatatggagaagaatattgtgtaccttttcatcctggtcacttactttaattaattatcaattcatagccaattttgtttcatttctactccctcaattatgttgtaatctgaaacattgtgtcatttatataggtaggtagatatacatgtatattgtgtatttctaaaagattaagattcttttaaaggtcattattttaaaatatgaataattccttaaaatcaaatatcttgtgtttcccatttccccaattgtttcttaaaaarttgtattgctgtatcttttaagtctttttaaaaaaaattctgtaggtttccctctctccctttttccttactaaattgtatttgttgaagaaaacaggtcatttgtttcctagtttggttttttcctgattacatttttgagctataatttaacatgtttctctgctcctgtattttctataagttggtagatttaaaggcaaaaaattgtttaaaatttatttttattgttttaaaatttaagtacttctaatattgtagatttctcagatcattactgttacaaggggcggcttaaag

SEQ ID NO: 94008 - DNA, 601 bp, Human
agattaagattcttttaaaggtcattattttaaaatatgaataattccttaaaatcaaatatcttgtgtttcccatttccccaattgtttcttaaaaaattgtattgctgtatcttttaagtctttttaaaaaaaattctgtaggtttccctctctccctttttccttactaaattgtatttgttgaagaaaacaggtcatttgtttcctagtttggttttttcctgattacatttttgagctataatttaacatgtttctctgctcctgtattttctataagttggtagatttaaaggcaaaaaattgtttaaaatttatttttattgttttaaaatttaagtacttctaatattgtagatttctcagatcattactgttacaaggggcggcttaaaggtagaactcttaaaatattattatcatctattctgccttcctggtttgtagatacagagacatcccagagaggttgtgatttatccagatttccacatcaagttgagattacagtggagggtgcgttcgaaagtaaaaataacttctccttttgaattttgatggcttcatgtgtgctacttgtgattttggttctttagaa

SEQ ID NO: 94009 - DNA, 601 bp, Human
cacatcttccagtctaccttgtgcttttctaaattgtgattggacttaacctgtgtactgattcttttactttaagaaagtggcagttgtggaccccataaacacaagagatgtgtttacttctgaagttttaaagatttttaggtttattattacaaaagtaatatatttgtttaaacagtgtggaattatataaacactgaatgtactcctcaacctctctaccttatgtctcagtgataacaattgctaagggcttgatgtgttttattctaaacttaattctatacaaatataattwtatagatatatattatatacacacaattgtttatctttaaaaataattcaaatatggctacaaaacttttacaatatgaagcattgtcagtatttattttaccgggaggatttcccccatcagtgagtgctgactgtcattttcattctttatgatcaagttgtagatcaggaaaaacaagttaagagagtgcctacaaataccgggaaaacttgtggatagattttcattttttatgtaaagacatataagaacatgaatggtataaaaacaaaatcctttataaatgccatacaatta

SEQ ID NO: 94010 - DNA, 601 bp, Human
ccagtctaccttgtgcttttctaaattgtgattggacttaacctgtgtactgattcttttactttaagaaagtggcagttgtggaccccataaacacaagagatgtgtttacttctgaagttttaaagatttttaggtttattattacaaaagtaatatatttgtttaaacagtgtggaattatataaacactgaatgtactcctcaacctctctaccttatgtctcagtgataacaattgctaagggcttgatgtgttttattctaaacttaattctatacaaatataattatatagatatatattatatacacacaattgtttatctttaaaaataattcaaatatggctacaaaacttttacaatatgaagcattgtcagtatttattttaccgggaggatttcccccatcagtgagtgctgactgtcattttcattctttatgatcaagttgtagatcaggaaaaacaagttaagagagtgcctacaaataccgggaaaacttgtggatagattttcattttttatgtaaagacatataagaacatgaatggtataaaaacaaaatcctttataaatgccatacaattatatattta

SEQ ID NO: 94011 - DNA, 601 bp, Human
agtctaccttgtgcttttctaaattgtgattggacttaacctgtgtactgattcttttactttaagaaagtggcagttgtggaccccataaacacaagagatgtgtttacttctgaagttttaaagatttttaggtttattattacaaaagtaatatatttgtttaaacagtgtggaattatataaacactgaatgtactcctcaacctctctaccttatgtctcagtgataacaattgctaagggcttgatgtgttttattctaaacttaattctatacaaatataattatatagatatatattatatacacacaattgtttatctttaaaaataattcaaatatggctacaaaacttttacaatatgaagcattgtcagtatttattttaccgggaggatttcccccatcagtgagtgctgactgtcattttcattctttatgatcaagttgtagatcaggaaaaacaagttaagagagtgcctacaaataccgggaaaacttgtggatagattttcattttttatgtaaagacatataagaacatgaatggtataaaaacaaaatcctttataaatgccatacaattatatatttaga

SEQ ID NO: 94012 - DNA, 601 bp, Human
gcatttcaggaggagaatctcccagtctagaggaatcctctcagaggtagctataaaatattgaactctgatcttcaataagcattgtgcggtttttgtttttgtttttaatgacagttttaaacaagaaagttgctttatttctgaacttcataaaaatttctattaaagagacaatttctgaattttataacaatttctagaacagttgagtacctcactttgagacacatttttgctaaaagttaaaaacacaaaacccttatgagataaaataggaagctagtagagataggaaagycctctgcttagtaaacctcttttttgcgtagtttagacacatacaatagtaaagttacttagtacgttgatagttttctttctcctcaaaagctacaatgtcttactagctagttccttcaagaaaggaaacaagaagccgctggaggagattggtgagtgggataaaacactattcaactcttcagttattcggtttttaaatcctcaatgaaaggctgctgtattatagagtattttttttttatttttaatagacttagaaccaagtttcttgagaaacctttggcatattgtagtt

SEQ ID NO: 94013 - DNA, 601 bp, Human
tgaattttataacaatttctagaacagttgagtacctcactttgagacacatttttgctaaaagttaaaaacacaaaacccttatgagataaaataggaagctagtagagataggaaagtcctctgcttagtaaacctcttttttgcgtagtttagacacatacaatagtaaagttacttagtacgttgatagttttctttctcctcaaaagctacaatgtcttactagctagttccttcaagaaaggaaacaagaagccgctggaggagattggtgagtgggataaaacactattcaacycttcagttattcggtttttaaatcctcaatgaaaggctgctgtattatagagtattttttttttatttttaatagacttagaaccaagtttcttgagaaacctttggcatattgtagtttttttatggctatgactcacatgacattactgtataaaactagtacattctctcgtaaaaccacacaaacttactagagtgctgctctcatttttctacattagaaatgaaaaagggcattgtctgcattcaaaatttcctttttacatctctgtattactttttcccctttatatttatc

SEQ ID NO: 94014 - DNA, 601 bp, Human
tttaggggtagatttcctatatagaaacaatcaagctctctcaaaatgtctcttccttttttatcaggaaaaaagacttggcttatctggactgttagttttacactttttcttcttaatttgttcaagatgtttaagtagttttagaggtcaaatttctttcttctaccaaccctttataatggatttgatcttttgggcctgagcctccatttactccatgaggggcctttaacaattatttaaatatttaattgtttcattcagagtgagcatatatgtgtgtgtgtgtgtgtgtgtrtatatatatgtgtgtgtgtgcgtatatgtgtatatatatatatacatatacacacacatatggcactcctaggtgctgtggagaattataaaaatagtaatattaataatagttaatatttattagaatttcctgttagctggatactgtcctaagtgggtttttttgttgttgttgttgttgttgttgttgttgttttcttaagagagaggtatcactttttcacccaggctggagtgcagtggagtgattatagcaaatgcagccttgaactactgggcttagatcctccgtctcacc

SEQ ID NO: 94015 - DNA, 601 bp, Human
ggcactcctaggtgctgtggagaattataaaaatagtaatattaataatagttaatatttattagaatttcctgttagctggatactgtcctaagtgggtttttttgttgttgttgttgttgttgttgttgttgttttcttaagagagaggtatcactttttcacccaggctggagtgcagtggagtgattatagcaaatgcagccttgaactactgggcttagatcctccgtctcaccctccttggtacctgggactgcaggcttgcaacaccttgcctggctaatttaaaaaacaaaattttttttttttttagggagagtctcactatgttgtccaggctggtctccaactcctgggctcaagcaaccctcctgccttggcctcccaagtagctgagattacaggtgcgagccactgtgcctggcttgttctaagtgctttatgtgtatgaaattatttaaatcctcatcacaagtttatgaagtaggtactgttataatccccattttctagttgacaagactgaggtaaggaattgttaaggaaaagtcagaattccatccagatatttggctcatactttaatcatgaggctaaa

SEQ ID NO: 94016 - DNA, 601 bp, Human
ttaataatagttaatatttattagaatttcctgttagctggatactgtcctaagtgggtttttttgttgttgttgttgttgttgttgttgttgttttcttaagagagaggtatcactttttcacccaggctggagtgcagtggagtgattatagcaaatgcagccttgaactactgggcttagatcctccgtctcaccctccttggtacctgggactgcaggcttgcaacaccttgcctggctaatttaaaaaacaaaattttttttttttttagggagagtctcactatgttgtccaggstggtctccaactcctgggctcaagcaaccctcctgccttggcctcccaagtagctgagattacaggtgcgagccactgtgcctggcttgttctaagtgctttatgtgtatgaaattatttaaatcctcatcacaagtttatgaagtaggtactgttataatccccattttctagttgacaagactgaggtaaggaattgttaaggaaaagtcagaattccatccagatatttggctcatactttaatcatgaggctaaactgcttctctctacacgtatcttcatagtaacttgtgtttt

SEQ ID NO: 94017 - DNA, 601 bp, Human
tctagttgacaagactgaggtaaggaattgttaaggaaaagtcagaattccatccagatatttggctcatactttaatcatgaggctaaactgcttctctctacacgtatcttcatagtaacttgtgttttaagtctggtagaagcataagaagtttaaacacagacagaatcctgtggaagttagtaaatttctagtgaacgatagaaatgatagaaatctcttcttcccccaaagtcccaagaacagattagtctgcttttgacaagtgttatcaaagtagactgttctcacatacacrggggactcaatagggcattcctggtggatataataaaatgagtaaatgcgataacaggaggaaatgcctagtgtgttgctcttggattagttttgatacaacaaaggcagctttgttgtgagtcagtagagagggtagtgtagaaaggtggaagttggaagagtggcagatcctagaggactaatgatgggcttaaaccacaaaaagtgtcgctttgccattgaaataaaagtttggggtcttattttttcaagtttctccctgaaattatttcttgacattcattagctcagcagtgta

SEQ ID NO: 94018 - DNA, 601 bp, Human
ataaaatgagtaaatgcgataacaggaggaaatgcctagtgtgttgctcttggattagttttgatacaacaaaggcagctttgttgtgagtcagtagagagggtagtgtagaaaggtggaagttggaagagtggcagatcctagaggactaatgatgggcttaaaccacaaaaagtgtcgctttgccattgaaataaaagtttggggtcttattttttcaagtttctccctgaaattatttcttgacattcattagctcagcagtgtatctaaataaagcttttttgggtttctattatartagaggtttgttcctttttcttccctttgaaaagtatcattttttgcacattatttgaaaatccaggtgttatatgatattcttattgccagagggacattctgcaggctctttgtaaaatgattttaggattcagatacttattatatttttattggccctaatattttatccaactagaaaattaaacctcttcttaaaaattaatccatctaagtgtctgtaaattaaaggaacaactaaagattctttatttggtgtcagaaactccttgtttctacaacagtagtataaaacaaa

SEQ ID NO: 94019 - DNA, 601 bp, Human
acatgtaaaccaacaatgaaattattttagtgacttgagaatcaaagtgctagagtttgaatccctgttctactacttgctagcggtgtgaccttgggcctgtttaactcttgacaccttgttttccaaatttataaagtggagataataatatctgtcacattgtgttgttgtgaggattatatgaactaatatatgtaatgtcctgagaacaatgtctggtacacattaagttaattaaaattagctgttcttactgttattattagacatgagctagataacagtggcctctacatgkgaaagattattttaattctgatgtagttcagtttatctattttttttatttttgtcccttttgcattgatgtcatatctaaaaaacctgcctaactcaggatcacaaaaatttactcctgtattttataattttagctctttagatctaggatccatttttagctaatttttatatatggtgtgaggtaggggtacggtttcattcttttgcacgtgaatagccagttgtcccagcatcatttattcaaaagactattctttcctcactagaaaaaatatttctttaaagaataatgaat

SEQ ID NO: 94020 - DNA, 601 bp, Human
ccaggctcccttgaactcctgggctcagatgatatagcctcctgccacagcgtcctgattagctgggactacaggtgtgcaccactacacgtggctttcctgatgaaattttaaatacccaaatatttgagcagaaataatagcttgtgtttattgtttttctactatctgtcaagtatagtattaaatgttttacataatttgtctccagtccacatacaatactctagtagaagtgggtaacaaaaccaaggtactcaaagaggttaataagtaacttgcgctggatcacagaactaaygggaggcagggctggaatttgactctaggtctttctgacctcaaagtgcagtaaagtcatggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaac

SEQ ID NO: 94021 - DNA, 601 bp, Human
cagtccacatacaatactctagtagaagtgggtaacaaaaccaaggtactcaaagaggttaataagtaacttgcgctggatcacagaactaacgggaggcagggctggaatttgactctaggtctttctgacctcaaagtgcagtaaagtcatggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaactatggaattatcctaagtcctcttgaagcttcagctgttaaaattaattggttctgattaacactgtgctcaagatttacatttctaggagccacagtttgattggtctaacttggatctatgtgttttctttagctggggaggagaaggtatcttgattgataccttcaccaggactgcatgcagtgagggacagaagtttccttaa

SEQ ID NO: 94022 - DNA, 601 bp, Human
ggatctatgtgttttctttagctggggaggagaaggtatcttgattgataccttcaccaggactgcatgcagtgagggacagaagtttccttaaaataattgggttctgttataggaagaaggggaaggagataccaagtgggcaaaacaatcaggttctattacataaataataaacctaatgtgacgataataaatggataatatgattattttaagtttggaaatatacctggttattagtattggatatctggtagtggggttggagaaaaagtcgagaataagaaaagacttaaartcgtaaaaattaactggaaaagaggatggctgagcagatacatatatgttagataatgttcataatggcaaaccaacctgaagatttgtttaaattgtagtatgtagccaggtgtggtggtgcttgcctgcagtcccaactacttgggaggctgaggcaggatgattgcttgagcctaggtttgaggctacagtgagctatgtttccaccactgctttccagcctaggtggcagagcaagaccccatctctaaaaaaataaagtaaaatgaataaattataatatgttatgacaaatata

SEQ ID NO: 94023 - DNA, 601 bp, Human
tgtaaattagttcaaccattgtggaagacagtatggcgattcctcaaggatctagaaccagaaataccatttgacccagcagtcccattactgggtgtatacccaaaggattataaatcattctgctataaagacacatgcacacgtatgtttattatagcactatttacaatagcaaagacttgaaaccaacccaaaaagccatcaatggtagactggataaagaaaatgtggcacatatataccatggaatactatgcagccataaaaaagaatgagatcgtgtcctttgcagggacawggatgaagctggaagccatcattctcagcaaactaacacagaaatagaaagccaaacactgcatgttctcacttataagtgggagttgaacaatgagagcacatggacacagggaggggaacatcacacaccgaggcctgttggagggtgggggacaaggggagggagagcattaggacaaatacataatgcatttggggtttaaaacctaaacgatgggttggtaagtgcagcaaaccaccatggcacatgtgcacctatgtaacaaacctgcacattctgaacatgtatcccagaact

SEQ ID NO: 94024 - DNA, 601 bp, Human
ttaacatatatgtaattttttgtacttatctcattttagcctatataagttatatatattttgtttgtttgtttgtttgttttgtttgagatggagtcttgctctgtcacccaggctagagtgcagtggtgcaatctcggctcactgcaaccttcgcctcctgcattcaagcgattctcctgcctcagcctcctgaatagctgggattacaggcacctgccaccgcgcccagctaattttttttatttttagtagagacagggtttcaccatcttggccaggctggtcttgaactcctgaycttgtgatccacgtgccttagcctcccaaagtgctgggattacaagcgggagccaccgcgcccggctgtaagttatatcttacacaaatctaggtttcattcagagaattatatgcaaagaaacagtgcaataggattattttaaagccattgttattgttagaaaacataatacctttaaaattccttttcacattagaaatatagtggcttctccccagtttaggatagaaattttccttttcttctccttctttatactattcagatttgcatgtttgacagaacaaattataagag

SEQ ID NO: 94025 - DNA, 601 bp, Human
agttatatatattttgtttgtttgtttgtttgttttgtttgagatggagtcttgctctgtcacccaggctagagtgcagtggtgcaatctcggctcactgcaaccttcgcctcctgcattcaagcgattctcctgcctcagcctcctgaatagctgggattacaggcacctgccaccgcgcccagctaattttttttatttttagtagagacagggtttcaccatcttggccaggctggtcttgaactcctgaccttgtgatccacgtgccttagcctcccaaagtgctgggattacaagygggagccaccgcgcccggctgtaagttatatcttacacaaatctaggtttcattcagagaattatatgcaaagaaacagtgcaataggattattttaaagccattgttattgttagaaaacataatacctttaaaattccttttcacattagaaatatagtggcttctccccagtttaggatagaaattttccttttcttctccttctttatactattcagatttgcatgtttgacagaacaaattataagagaaaatatttgaaatgtcacatactaaagtaaatgtttgaatgtttga

SEQ ID NO: 94026 - DNA, 601 bp, Human
ctggtcttgaactcctgaccttgtgatccacgtgccttagcctcccaaagtgctgggattacaagcgggagccaccgcgcccggctgtaagttatatcttacacaaatctaggtttcattcagagaattatatgcaaagaaacagtgcaataggattattttaaagccattgttattgttagaaaacataatacctttaaaattccttttcacattagaaatatagtggcttctccccagtttaggatagaaattttccttttcttctccttctttatactattcagatttgcatgtttgrcagaacaaattataagagaaaatatttgaaatgtcacatactaaagtaaatgtttgaatgtttgaaaattttctggttttcagagattttgaattgctgaatcgttgtgtaaattaagatgttgagtagtttccacagagtaattatttgaaagtcactgaaagcaagacacatgcctaatgtaaatgtttattgcactactgtacctttttctacctcataaaaatgagaatagcagtctgtacttttccacttcgtcattcgtaagtctttgcagaaattcatattttgtttgcttat

SEQ ID NO: 94027 - DNA, 601 bp, Human
ggcatttgcattttctaaatgatcaattttaatattatatggaaagcagagtcagagattctcacatatgtcaagatattataagtattcctgttatatttattctccaattgctttttctcaagaaaatgtgtggcctttcagctagcttttcaaagtggaagttactacataacattaggatgggagggtggggaagagctttattaaagctttaagattgagcttttgagtatgtgttgtatgtaaatgaaagtgggcattgatgcagggattgggcctttaaacctttggccaagawtggtatcaattattattattattattttttggagtacttctgctaaaacactgaaatcagtgtgccactctccttttagaagttttacacctttccaaggtacacttttttttttggagacgagttttgctctgtcgcccaggctggagtgcattggcgcaatcacagcccacttcagcctctgtttcccagactccagcagtccttccacttcagcctcccgagtagctgggattacaggtgcacaccaccatgcccagctagtttttgtagagatggggttttgccatgttgcccagg

SEQ ID NO: 94028 - DNA, 601 bp, Human
atcctgcccttcacctgttttgtaaataaagttttatcagaacacattcagactcattcatgaacatattgtctatgatttattttctgctactatggcagaattgagttgttgcaactgtgtggcatccaaagcctaaaatatttactctctggctctttgccaacccgttttagattatgagcactttggcattattatgtttttgttttctttctatagcacacagtaagatgttctgcccacattgtgcataatttatgggtttattcaaggatttatgcaagtgtagctgcaagaraaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttgcatttctttttatgtgttagcttgagcttattttcatatttaaaagccaattgtatttctttttcttgagctatcttttaatgtcct

SEQ ID NO: 94029 - DNA, 601 bp, Human
aggatttatgcaagtgtagctgcaagaaaaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttgcatttctttttatgtgttagcttgagcttattttcatatttaaaagccaattgtatttctttttcttgagctatcttttaatgtccttcctgatacatttctgaagtctgtgatactcatataagatatatggtgaacatgtgtcaaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaa

SEQ ID NO: 94030 - DNA, 601 bp, Human
caaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgmaggctaattgttgacactcgggcttgactttaagagaacatgccataatcttttggccttacttccaagttttggataatttttcttaacacatttttctctaattgcaatgatttcaagtgatattatttcttttttttaaatttttttactatttattgatcactcttgggtgtttctcggagagggggatttggcagggtcataggacaatagtggagggaaggtcagcagataaacatgtgaacaaaggtctctggttttcctaggcagaggaccctgcggccttccacagtgttt

SEQ ID NO: 94031 - DNA, 601 bp, Human
ttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgcaggctaattgttgacactcgggcttgactttaagagaacatgccataatcttttggccttacttccaagttttggataatttttcttaacacatttttctctaattgcaatgatttcaagtgatattatttctttttttwaaatttttttactatttattgatcactcttgggtgtttctcggagagggggatttggcagggtcataggacaatagtggagggaaggtcagcagataaacatgtgaacaaaggtctctggttttcctaggcagaggaccctgcggccttccacagtgtttgtgtccctgggtacttgagattagggagtggtgatgactcttaatgagcatgctgccttcaagcatctgtttaacaaagcacatcttgcaccgcccttaatccctttaaccctgagttgacatagcacatgtttcagaga

SEQ ID NO: 94032 - DNA, 601 bp, Human
ggggcggctgccgggcgggggcgccccccacctcccagactgggtggccgggcggagaagctcctcacttcccagatggggcggctgccgggcggaggggctcctcacttctcagatggggtcgcggctgggcagaggtgctcctcacctcccagacagggtggcggctgggcagagacgctcctcacctcccagacggggcagccgggcagaggcgctcctcacatcccagagggggcggccgggcagaggcgctccccacgtcccagacgatgggcggccgggcagagacgctcctcayttcctagacgggatggcggcggggaagaggcgctcctcacttcctagatgggatggcggccgggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagc

SEQ ID NO: 94033 - DNA, 601 bp, Human
tcccagatggggcggctgccgggcggaggggctcctcacttctcagatggggtcgcggctgggcagaggtgctcctcacctcccagacagggtggcggctgggcagagacgctcctcacctcccagacggggcagccgggcagaggcgctcctcacatcccagagggggcggccgggcagaggcgctccccacgtcccagacgatgggcggccgggcagagacgctcctcacttcctagacgggatggcggcggggaagaggcgctcctcacttcctagatgggatggcggccgggaagargtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggccgaggcgggcagatcactcgaggtcaggagctgg

SEQ ID NO: 94034 - DNA, 601 bp, Human
ctcacttcctagatgggatggcggccgggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggcygaggcgggcagatcactcgaggtcaggagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggatta

SEQ ID NO: 94035 - DNA, 601 bp, Human
ggaagaggtgctcctcacttcctagactgggcggccgggcagaggggcttctcacatcccagacgatgggcagtcaggcagagacgctcctcacttcctagacggggtggcggccgggcagaggctgcaatctcagcactttgggaggccaaggcaggcggctggcaggtggaggttgtagcgagccgagatcacgccactgcactccagcctgggcaacattgagcactgagtgagcgagactccgtctgcaatcccggcaccttgggaggccgaggcgggcagatcactcgaggtcagkagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttc

SEQ ID NO: 94036 - DNA, 601 bp, Human
tccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttctaagaaggtcacttagctcactgttgtctcttctaaaacrtactcatctttccttttctcttctgtaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacgggtaagtgtttttagtaaaaatttttaaaaacatagtgcataattagatcttttaataatatatttctgccaatgatctcaggctgccaaatgtttacatttaatataagtaaat

SEQ ID NO: 94037 - DNA, 601 bp, Human; identical to SEQ ID NO: 23340

SEQ ID NO: 94038 - DNA, 601 bp, Human; identical to SEQ ID NO: 23341

SEQ ID NO: 94039 - DNA, 601 bp, Human; identical to SEQ ID NO: 23342

SEQ ID NO: 94040 - DNA, 601 bp, Human; identical to SEQ ID NO: 23343

SEQ ID NO: 94041 - DNA, 601 bp, Human; identical to SEQ ID NO: 23344

SEQ ID NO: 94042 - DNA, 601 bp, Human; identical to SEQ ID NO: 23345

SEQ ID NO: 94043 - DNA, 601 bp, Human; identical to SEQ ID NO: 23346

SEQ ID NO: 94044 - DNA, 601 bp, Human; identical to SEQ ID NO: 23347

SEQ ID NO: 94045 - DNA, 601 bp, Human; identical to SEQ ID NO: 23348

SEQ ID NO: 94046 - DNA, 601 bp, Human; identical to SEQ ID NO: 23349

SEQ ID NO: 94047 - DNA, 601 bp, Human; identical to SEQ ID NO: 23350

SEQ ID NO: 94048 - DNA, 601 bp, Human; identical to SEQ ID NO: 23351

SEQ ID NO: 94049 - DNA, 601 bp, Human; identical to SEQ ID NO: 23352

SEQ ID NO: 94050 - DNA, 601 bp, Human; identical to SEQ ID NO: 23353

SEQ ID NO: 94051 - DNA, 601 bp, Human; identical to SEQ ID NO: 23354

SEQ ID NO: 94052 - DNA, 601 bp, Human; identical to SEQ ID NO: 23355

SEQ ID NO: 94053 - DNA, 601 bp, Human; identical to SEQ ID NO: 23356

SEQ ID NO: 94054 - DNA, 601 bp, Human; identical to SEQ ID NO: 23357

SEQ ID NO: 94055 - DNA, 601 bp, Human; identical to SEQ ID NO: 23358

SEQ ID NO: 94056 - DNA, 601 bp, Human; identical to SEQ ID NO: 23359

SEQ ID NO: 94057 - DNA, 601 bp, Human; identical to SEQ ID NO: 23360

SEQ ID NO: 94058 - DNA, 601 bp, Human; identical to SEQ ID NO: 23361

SEQ ID NO: 94059 - DNA, 601 bp, Human; identical to SEQ ID NO: 23362

SEQ ID NO: 94060 - DNA, 601 bp, Human; identical to SEQ ID NO: 23363

SEQ ID NO: 94061 - DNA, 601 bp, Human; identical to SEQ ID NO: 23364

SEQ ID NO: 94062 - DNA, 601 bp, Human; identical to SEQ ID NO: 23365

SEQ ID NO: 94063 - DNA, 601 bp, Human; identical to SEQ ID NO: 23366

SEQ ID NO: 94064 - DNA, 601 bp, Human; identical to SEQ ID NO: 23367

SEQ ID NO: 94065 - DNA, 601 bp, Human; identical to SEQ ID NO: 23368

SEQ ID NO: 94066 - DNA, 601 bp, Human; identical to SEQ ID NO: 36537

SEQ ID NO: 94067 - DNA, 601 bp, Human; identical to SEQ ID NO: 36538

SEQ ID NO: 94068 - DNA, 601 bp, Human
aagtttagaagtcataaaataatgggatttttataatactgttgacaatcagtattttgtaaactaaaaattcctttggttaataactattactattccttatgctttttctactatgatttttttttactttgttaatactgctctttcattgccaaaaatgattgcaaatgccccttttaatttgtgtggattgagtgctcacaagagtgttcctacagacttattgaccccttctagaaatttcctactgttgagcaccactaaagatgcctgctggtctgctgaccaagtgaacagraacagggtattagacatgagttgctttttgagaaaaatctgcttttgtgggaaatacagtcgaaaatgattctgattgacttaattataaattaccaaggaaaaaaataaggataactgtatttacaacttagtcatttacaaaaatatgtcttccatcaacctccttttctccttgtcctgaaaacttcaatttgatctttaccatcttaaaatagtatacttctcaatgccttgctagtttattaaaaaaggacaaatagtatgtctgatagaaaaataggccaacatctagataagt

SEQ ID NO: 94069 - DNA, 601 bp, Human
ccttttaatttgtgtggattgagtgctcacaagagtgttcctacagacttattgaccccttctagaaatttcctactgttgagcaccactaaagatgcctgctggtctgctgaccaagtgaacaggaacagggtattagacatgagttgctttttgagaaaaatctgcttttgtgggaaatacagtcgaaaatgattctgattgacttaattataaattaccaaggaaaaaaataaggataactgtatttacaacttagtcatttacaaaaatatgtcttccatcaacctccttttctccytgtcctgaaaacttcaatttgatctttaccatcttaaaatagtatacttctcaatgccttgctagtttattaaaaaaggacaaatagtatgtctgatagaaaaataggccaacatctagataagtttcacacttgtttaggtaattgtgtaaaagtatggatagagataaccatactgtcaaagtggtgtattaaaacatattgaacttgttcattctatcacttaataatttggaaacctagctgcccagtaccatgtaagccactgtagaaaaccctaaaagaacataaaatgccatg

SEQ ID NO: 94070 - DNA, 601 bp, Human
gataactgtcaacaaatagagtactaataataatcactgtaataccttatgtttatacagcacgtagaagaatacagaggacttgtgcatcaaacatctcagttaatcctcagaacaatttgagtgttcccatttgactacttgaggtgacatagccaataagagctggagccaggactcagacataggccatcatttctaagtaaaattatttttctaaggaaaacattacacatattagaaggatgcattcctcaggggtaaggacaatatttgtctttttttccagcagccagttatktgtcacataattgatcctgaatttagcatatttagtcaggaaatgggatttgacaataaaattagactttctatgcctgtagattttgagacttataaaaaagttatcattggtatcattagattttagaatggcagattggaggaattgaatctacttttaattggccaaattctattatttttactcaagattagagacacctctttgctcatctaattttaaaatatgctattgttattgataagcagtttgatgttttaaacctttagtcctgaataactatgtggttatactttc

SEQ ID NO: 94071 - DNA, 601 bp, Human
tccagcagccagttatgtgtcacataattgatcctgaatttagcatatttagtcaggaaatgggatttgacaataaaattagactttctatgcctgtagattttgagacttataaaaaagttatcattggtatcattagattttagaatggcagattggaggaattgaatctacttttaattggccaaattctattatttttactcaagattagagacacctctttgctcatctaattttaaaatatgctattgttattgataagcagtttgatgttttaaacctttagtcctgaataacyatgtggttatactttctatagttttctataaatgctgtatttacataggcaactgccattattagttgcctaagggatcatttctgctactatacggtatagaatcagaactggactcttaacattgtaaatttttttgtaagtcataagaaaaagtctagttcttctggtagacagaaaatagctgggaaaactgatttactgtttgatatatgtgattcttcttgggtttagccacctttcctaattttccaatattttattttccagttttgtgagactgtgaagataattattcgt

SEQ ID NO: 94072 - DNA, 601 bp, Human
ctctcagattcagaataattttgcatgtttccatgcagcccccatttcttcctaccctttctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaaatcctgtctgttcacccactaatgatccagagttggggaggtaaataaacagtgctcttgggagtaggttccttttctttatttgytatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttcagctagaaagtcaccttcaccactatctgcagtctttaaagattcattcacatacacaaaagagagcaacagcaatgttagccag

SEQ ID NO: 94073 - DNA, 601 bp, Human
ttcatcaatcaaccctttcatcctgcagccagaagggcatttgtagttctgaaagtgaagggagaaaattacagtaaggatctatctctcagattcagaataattttgcatgtttccatgcagcccccatttcttcctaccctttctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaartcctgtctgttcacccactaatgatccagagttggggaggtaaataaacagtgctcttgggagtaggttccttttctttatttgctatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttc

SEQ ID NO: 94074 - DNA, 601 bp, Human
ggtgctattccctctcaaaggaaacgctaattaaatgatccttggtgaaactcaggctgagggctcagaggtgtggtgatgtaatgggctttggaattagacagggactgaacatttgcttttgaaatttactatctatgtaccgttggaaaatttacttaatatctctgaattttttttcttcaactgtggagtgaggaaaataatacctacttttaggtagatgatggatataacacttttctctgcatatagtagacactcagtgcataactatcgccttccttttccctctactcaraaacaaggacatctgggaccacagccacatacttacctccagtcgtttcatatcaaccaactgagctctaacatttttctgcagaagctggatatgctgtactttttctatgactttgcgcttcaggacttcaattctgcttctcagatcctctgacactcggttgtaggtattatcacggtctgaaatcgaaaatatggttattgaagtagctgctgagtgatttgtctgtaattgccagcaaaaaagaaaggaagaaaggaaggaaggagaaagaaagaaagaaagaaagaaagaaag

SEQ ID NO: 94075 - DNA, 601 bp, Human
ctgtgtggtactctctccttgtccctggacttacatttcctgacacctcttcaaatgtgccccagtctgggttgttaggcctcgcgttcccagagcctgggctatctggcctaaaacttccagattcagagtgccattgtccagtactaccagatacagagctctcagaggtccagtgcccagcacttccgcgttcagagctgccaggattccaggttccggtactaccaggtctagggctcccagggttttggtttccagtacttccagttccagagctcccagagttccagcttccagyacttccaggtccagagctcccaggtttccaggttgcagtccctccagtcccagagctcccagggtttcggtttccagtacttccaggtccagagctcccagagttccagcttccagcactgctagggttcctggggctttccgtctctgatccggttccataagaggtggagcctcctcgagtaatctcatttccaccaggtctctctaactccattctcatctgcggcatgtctgttaatgccttccactctgggggtaccttctgaagctggctcttaaaatttccgggaaccaagtc

SEQ ID NO: 94076 - DNA, 601 bp, Human
tgggaaaaaaataagtgtgcattacaacgtctagtggaagagtttaaaggatagattttcatttatatttaggaaagaatgtttctcttgccttcctggatttgctccatagcaaaagacataaatacatattgtaattataaattgtgcattgtaattataagttgtaaattctactacaaaggtcagctatggttagattcagtgagttttaccttaaaatattggcttaaaacaattcaaatcaaatggataaaacaactttttgctttccaatggcattatgattttgggtggtatrggaagagaagttctcaaaccaatagtcttcaaggttgcagagagaagcttctgtctgccactttcctgatgtactgaatggcccttggtatatctttataaaaatgttaaaacccacagagctatttaaagataaaaaaaaccttacataactttatttttcaaagactaatatgtctcaggtacatttagctacagtacaaaggataagaaaatagcacctaggaattttttaggttgtagagaatctcaactgctttaccttttgtattttctctccacttctctagcaaagaagaca

SEQ ID NO: 94077 - DNA, 601 bp, Human
atttgatataatgaaaataatttacgaagacaaaataaatgacaagtggtcataaaaatgcaaataaagtcaatcattttattattatatatttaggaacaaagttgaaatgttatctcctcaaataaacaatttttaaataactctgatatcagtaatttggaaatacagtcctaaatgagttttaatttccattgaaggctaaatgtccttaatagaagacttgaaatcaataaatatagtaagagaaaaaaggaagaaactttcagagaatttctgaaactttgtgggtcaatagaarttagcagttaattttctacaaatcatcctcagggtaaagtgagtcatattctgtttccgcagggtgctctggtctgacctgtttggctccccccaggtggtgttgctgtccttctccaattgtgagtctgttgaatgggattatcttcatagtggttttcttcatggaataccaccgggttttccaagtggcccaaataatgccattatcataaccattaggagtagatgcttttgagtaagtgccacctaaaacaagtcgtagatgtacatatcattattctggaatctttttacctct

SEQ ID NO: 94078 - DNA, 601 bp, Human; identical to SEQ ID NO: 94077

SEQ ID NO: 94079 - DNA, 601 bp, Human
gccggcgctgcggtcttcctccgactcactagcatttccttaaaacgcccaagagagacaaacacatgagagtcatcaatatctatcacagtcttttaaaaatcttaacgttgcaaccaggtcacatgtaaatgacaatattagttggcaatccaagtgagtttttttttttaaatacctcgatgaagtattattccatcatactactcactacatggtggttgctctacctcaagaagttatctgtttgaaagtcaatctgacaggtgctcttcctaagtagctgcaactaaagaaggcrgacaaacgcttcagtgcccctcagtaggtgaaggcagtatgcttcatcttccaccggcagggggcagacctgagccacgggaggctgctgcagcgccggctcagaaattttgcagtcaactccaagtgtggtcctcccacccgcgggagcagcggcagcccggggacttggaagaaatgcacattctccactccggaaacgctggagtggcggcagcagtctgagttgtaacaagcccttatgggaattccaaggttgaccagtaccgtcctcaatgctaccaggtaaacacgcttataa

SEQ ID NO: 94080 - DNA, 601 bp, Human
tcaaagaaaccataggcatttcaaaaacctctttctaaactttggtttaaaaaaaatcagttcaccacaaacagaaatataaatcgaggctgtagccagctgctggtcatgtccttggcagtcttttgtgcaaaataaggcatatttgagctccacattaactaaaacaaaaagaaaaagaaatatattgaaataatccccccaaaatcaaaagggctcgactcttgccctgagatatccagcacagcctgcaggctaatggcactaggcctgcaagtgcagggctggggtctcaactcaygttttcaaacaaagcaacgagtaccagatgctgctcacagtgttcattgtcaaagagttacccttaaattagaattattttttccaacttgtaaggaaaaaagaaacccttataactaaacatgcaaatttcttctgcttactaaatttgtcttaataaaatgaaagaaaatgtatttattcctttcccccaatagttccctcatttattaaaagaaaaaagaagactggatataatagcattctctaaaattatcgtttaaaatttcatttttctatcagatttaaattaactttatta

SEQ ID NO: 94081 - DNA, 601 bp, Human
aacacacaagatcattgcagatagtgctaagtgctgtgtaggaaatggaacagtctgactccatggaagcgtactttagattggaaggccgggtctccactatatcgctagcaccggactcacagtagatgctcagttggtatttatgaatgaatgaatggccagaggctctccagtttatatgtcctattgggaagtagtgtagggtaacttacccaaagttacccagttggcaaatggtacatttgaacccagacttcagagttcacgctcttaaccgttttgctgtctgatcgctgggaaatactccagaacggtggctgtcactttgccttccaagttaacaatgtgaaataactctgaatttacagagaaccaaaggctttccaattaaaatgaaaaaaccgaaaaaccccaccaaacctaccgtggattgtaattccaggatagtacttgagctttcatgatgttctcatggccttctggggatgccagattgggaaagaagtccaggtagctaaagtgaaaatagtgagccttagtttccacttgagttgtctgaagttctttctctatctgggaggcctggcttggcttctcc

SEQ ID NO: 94082 - DNA, 601 bp, Human
gtccctttatgcatagatgcagccagtgtccaagttaaaattgtgttgcttctccttgagcagtccttccttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgtgtccacgttgcctcttgtagaacgtgtttagaaggaatgacrtggctgttagtggctttgtaagtgcatagtactatacagagattagacaaccacttaactacttaagtggtttcatcacttctgtacctgaaaggtgtggcagagaatagcgatcattctggccctggattggccaaagtaattatgccaaagtcactggatatttttgctagggaagtggtccaagagaagtggtaccaaattgttgaaggcctctggctcataactttagaagagacatctgtgtgtgttcttaaatgacgtcatgaggtgtgttgtttgtttgttttaaactgaatg

SEQ ID NO: 94083 - DNA, 601 bp, Human
tgtttaggaagttaaaaaatctaaagccctgtggatatagttcattcagtgcagtaattatctttcagatgccaagtacagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgcttatcaaaagcggcattaaacttactaaacttgagtcaaacktaaatcttcatagatagtaccatttacttctgaaatcttgttcctgggagaaaaatgtggactggaagttaactttcttttatccacctattcactcctttttcttcacagttaactccttaggggaaaaaatgtatagttcttgaccatgtgcttatgtttgtaaagcaatgatgtttccttaacgtgagtggttgtgacatagatcactgttatcttcataattacctgggagcttttcatccaagtgtggatttactaaaataattagtctgaattgatgcttattaaagagctgaa

SEQ ID NO: 94084 - DNA, 601 bp, Human
caggcacatgccaccatgcctagctaatttttgtatttttaatagagacggggtttcaccatgttggccagatggtctcgatctcttgacctcgtgatccgcccacctcggcctcccaaagtgctgggattacagacatgagcctctgcgccaggccaagagtgtcttatatatccccacttttttgaaaaatttgctgtctaaaggatgatcatgatttgggacgaatgagcacagctttcaactagatgacaagaaagatgaatacaaagagtgctgagttccattagtcaagacaagkttgccatagaatgtctttaataaaataaaacaaaagccttttgcgttattttgcaccgaggattgtgttaaaaacaaagttgcattatggtttccagattggcatccttgtttttttctatcattttaggcccctttcaggctgttatcagcatagcatatccaggattgctttggccttgctcagtgggtatgtgcgttctttgaagttcttacctgacagatgtgggcagctggctttacacaaggaagagttgtttaaagagctttggtatggaaacaaagttactaaacttgacag

SEQ ID NO: 94085 - DNA, 601 bp, Human
gtccaaattagagctgttttgggtttctgccctttgcagatcctttgaggttttctttatagacagatgactccttctgggggaattgagcgtgactctgattgagatttggttcagttaccacatactgaaagcttcctgtgggccaggcactaggttgcactggggacctgggaggaaggcctagcccttaaagtttccagcctctaggtattgggagacgagggaaaatggggacaagatatttatggcctgtccttattgagagcttagaaaaagctgtgttaattctgctttgggygttcgatctcacagggaagatggcatttgagatatgtgacttggcgagcttacactgtgcgcttgccatttttctaagcgttcatttatttaattcttaatgcaagcctaggaagtgggtacagttatgatcctgaagttattaacccaagttatgaacctgactgagggttggagctgggatttgaatcaagatctgtctgattgcaaaggctatggctttttttttttttgtcgtcatgctggctgtgtttcttcccttaaaagataagtgggagtgtgcccttggctttcttattta

SEQ ID NO: 94086 - DNA, 601 bp, Human
atctttgccagccatggtggctcacgcctgtaattccagctttgggaggctggggtgggtggatcgcttgagctcaggagtttgacaccagcctggtcaacatggtgaaacccctctttactaaaaatacaaaagttaaccaggcttggtggtgtatgcctgtaatcccagctaatccggaggctgaggggcaggaatcgcttgaacccaggagggcagaggttgcagctagctgagattgtgcctctgcactccagcctgggctgagagtgagaccgtctcaaaaaaaaaaaaaaaaaaatccttctatgaattctgtgtttccccctaagaacttctgtcctaacttgatcacttcttattgtgagctatttgtttattagtgttgaaaattctgtgctaatactatcaactgtaccttcccttccaccaccccactctctgctccaagtctttcatgtcctcaatacctgtcgtgcaaactatgcatttctgggttaactgggtactattttagtcttttagttccatcactcagcatttacaatatagtagaaaaatggaagaaatggaaaggtacgtactcgagaaatcagtgtta

SEQ ID NO: 94087 - DNA, 601 bp, Human
acatccctgtctatctggttgtcatgagaacacctcaaactcagcatgttccacactgtatttaccgtttaccttctcatccccactgactgtggcttctggatcttgggaatggcccttgcaccaagttggcaagctggaaatcctaaacttgtctttcactccccattttccgtaacctttcacatctactcagtccatttaaatcagcagcatctcctatgcccttttgcttcttagtattctatcgtatcctaagtataggtcctttcccttccagactattgtagtagcaccgtgwctcaactttctgtctctattttttctgcctgcttctctcaccctttggactatactttatacagtttccagagatatttttctaaaaattgaaatttgatatcatttcttggtttaaaaacattcattggctctctagatcttacggataggttcgtggcccaaattcttaggccagcagcaaaactcttcagagtcaggccacaccgcatctttccagcctcagcttctttcacccctctcgtaccccttcctcttcagccatttgatgcccccagaagccccttatagctttatcaca

SEQ ID NO: 94088 - DNA, 601 bp, Human
gcaccgtgtctcaactttctgtctctattttttctgcctgcttctctcaccctttggactatactttatacagtttccagagatatttttctaaaaattgaaatttgatatcatttcttggtttaaaaacattcattggctctctagatcttacggataggttcgtggcccaaattcttaggccagcagcaaaactcttcagagtcaggccacaccgcatctttccagcctcagcttctttcacccctctcgtaccccttcctcttcagccatttgatgcccccagaagccccttatagckttatcacactgtactttcacccaagttccctacagctcaaagtgtactttgcgttatctgcttttcagactccagggcttgcctcagtgatcagttccctgtgctcctcaccctccccttttgataggatgctttatagattacctttcatacagtgttcgatgcagttagaggtagtatactgcccaggagttaagagtgtgaaccctagatttgccatctgaaagtcatgtgtccttcagtgatgcatttaacctctctgtgcctcaaatttctccctctggggtatgttaggagtat

SEQ ID NO: 94089 - DNA, 601 bp, Human
tgagatgctcagtacacttgcaacgagagatgttaaataggtagttgagtctggagctcaggggagagggccaggctgcagatataaatttggcagtcagcttattgttgtgacatagaacagtaaggagtaatttcttctgattaaagagatttggtaaacctttccaaaagagaagacgtttgagcaaaactttgaagaatgagcataatttccaaaggcagagtaagggaaaaatagaaaatatttttcatccaagtctcacagcctttcccctggcctcttcttgagtttaagaagytgctgacctggttgataatctcttatcactggtatagccacttaggttctttattgaaaaggaaccagaacagattacacactaactgataaaccacgttctactgtttctcatcgttcacagattgaaaattccagttggatcatcaaggtgcagaatgctaaacttgttcttctcccctgttctgtatctggtgtgaattggatgtgttgattttcgtatggaggctttttcacatgctgtcatctccactaaagatggaacactttggagaagttttacttctgttgttaatgactt

SEQ ID NO: 94090 - DNA, 601 bp, Human
catgttttgagtgataaccttgatttttataaattatacaagcatgactatcaaggctggtttatcagttttcaacaactttacaagtctgaacaagtagaaaattatttcaaaagaaccttgtttggatctcacataaactacaggtagctttctgtatatgaaaaaatttttaagtacagaaaaatacagataatataaataccccagtatggagtaactaaatgttaataatttgttagaagactcgttttaaatctttctttaataaaacaagtaaaacttcactaataatttatgrcatgtctgtactccatatctgctgattcatacgccctccttttttttttgttttttttttaactccccggaggaatttaatgtgaactatttccgtttttttctagatcacttaatgtagtgtcatggtgtatggatgacttaacatgtttttgagacctatcaactgttgaaatacagatctagttcattcttttaaagagttgtatagtattccttcatgagattttagaatttttattgtaagtaagagaattctttatatattttcaattctggccattcatctgttatataaact

SEQ ID NO: 94091 - DNA, 601 bp, Human
ttgtatagtattccttcatgagattttagaatttttattgtaagtaagagaattctttatatattttcaattctggccattcatctgttatataaactgcaaatatcttagttttccaggctgttccttactaactttgtattttttttcaggtagctttcctgagtttgatcttaggaattcttaaaatacagtagcatgtcttccagtttagttttcccacccatggaggtggtggcaggctgagttttgtttctttctgctctgaaagacctaggaaactagtgaattgagtaagcascctgcaagtctggtatagtctatttcaatcaagttggcttctggtgtgcctttgatggcatcatcagtgagagttcttggtgttgatttctcttgctgcaataacaggtgtgatgtttctcagtagctggctggctcccgaggataccaggagaatactttattaatttaaaacactgcattctaagagttcttcaggaaagttatgtgtctatgggtagggttgtttttatgtggttatttcaaaataagagctatacaatcaggctttctgctggaatattggaatataatgtctgcc

SEQ ID NO: 94092 - DNA, 601 bp, Human
atttttaagaaaacttctccagtgtccttattcttgagttcatggttatttaacagctcactctcttcgaatatctgttagtatggtatctttcattttttagggagggggcaactttaaaaaaaaacaccatagaataattatgatgaaagcattattgacacagtgagcatttttaataccttcaacctgtatataagcagcacaaatttagagtgatttcagatccgggttttgaagtaggtgtctgtttacaggaaatgcagcagaatcagagtacaatgacctctgaggaagtctygtattcatgcagcatacatttttactatgtttgtggcactgttctagtttggaggatctggtgatgaataggacagacaccccccccccccaccccgccccccactccatgtggaaacaggaaaggaacaaacaaaatatgtcctatgcagaagatgaaaagggtgtaatgctggaacaggagcagcagtagtctcagtatttattcacccagagcctggatgtgcttacagagggtgcatagaggaagaatacagccattgtgtgaagtagatggaagcatggcatggctatttgttca

SEQ ID NO: 94093 - DNA, 601 bp, Human
agcagtagtctcagtatttattcacccagagcctggatgtgcttacagagggtgcatagaggaagaatacagccattgtgtgaagtagatggaagcatggcatggctatttgttcattcagcaaatatattattgagcatctgttctatgcctgcaagtgctctaggtgctgatgatcagtaatgaacaagagggacaaaaaagtctgtgttgatggagtttccattctagaaggggaagatttacataaacaagaaaagaaataatgtggggattggtgcactgcagatgggtatggaamgcagaaagcaataggatactttttaatgtaaatagactgtcaaagggtaaaatttaaaaatattaataagatatccaacagattttgctttagaatgtccgtgtccctccattttagtgtatttttcccacatagagagtctactgtattgaaacctcaagcacacttttattgtcttaacaaaatccatcaaaagtcataggcttctggagacagattattaccttcccagaaggtaatctttttagagttgaagtgaaatatggtaatttgttttttggagaggctgtgaaaaggaga

SEQ ID NO: 94094 - DNA, 601 bp, Human
gtgaacctacattgacatgtcattgttagccagagtccgtagtctgcgttagtattcatttctagtgttgtacattctgtgagtttttacaaatgtataatgacatgtatccaccattataatatcagagtagtttcagttttactgtcctaaaactgctctatgctccttgtgttctttcctcccttaaattctatcaacaccgtatttatttatttatttatttattttgataacagagtcttgctccatcacacaggctggagtgcagtggagcgatcttcgctcactgtaaccttcrcctcctgggttcaaactgttctcctgcctcagccccccgagttgctgggattacaggtgtgtgcccccacacctagccaatttttgtagttttattagagatgtggtttcaccatactggccaggctggtctcgaactcctgatgtcaagtgatccgcccccccgccccactcagcctcccaaagtgctggattataggcgtgagccaccatgcctggccaacaccttatctttttattgtctctgtagttttgccttttccagaatgtcatagagtaaaatcatacagtatgctacctt

SEQ ID NO: 94095 - DNA, 601 bp, Human
gctccttgtgttctttcctcccttaaattctatcaacaccgtatttatttatttatttatttattttgataacagagtcttgctccatcacacaggctggagtgcagtggagcgatcttcgctcactgtaaccttcgcctcctgggttcaaactgttctcctgcctcagccccccgagttgctgggattacaggtgtgtgcccccacacctagccaatttttgtagttttattagagatgtggtttcaccatactggccaggctggtctcgaactcctgatgtcaagtgatccgcccccccgccccactcagcctcccaaagtgctggattataggcgtgagccaccatgcctggccaacaccttatctttttattgtctctgtagttttgccttttccagaatgtcatagagtaaaatcatacagtatgctaccttttcatactgactgctttcactcaggaatatgcatttaaggctcctccgtgtcttttcatggctttatagctcatttctttttagcactgagcactatttcagtgtctggatataccacagtttattttatccactcacaaaatgcttctgcattttggcagtta

SEQ ID NO: 94096 - DNA, 601 bp, Human
agagacgctccccacttcccagacggggtggcggccgggcagaggctgcaatctcagcactctgggaggccaaggcaggcggctgggaggtggaggttgtagcgagccgagatcacgccactgcactccagcctgggcaccaccgagcactgagtgaacgagactccgcctgcaatcccggcacgtcgggaggccgaggccggcggatcacttgcggttaggggctggagaccggcctggccaacacagcgaaaccccgtctccaccaaaaccagtcaggcgtggcggcgcgagcctgcartcgcaggcactctgtatttgccttgtaaaacagatcaattctagcccctcttactgtcttactcttacctcttattgccttaaacacaatttaaaatgacaaaaatccaagcacagtgggtcctgggggaaggtagaggaaataaattatactgtgtttagctttatctaaataccttttacagcatgtcaaggaattcattttcagttcattagtgctgtttcataagcatcttcagcaaactcacacaaatgttcacagatgagtatatgcataatctaggacataaagggcattgtt

SEQ ID NO: 94097 - DNA, 601 bp, Human
agattgagatctttattctatgccagccacagtgctggggctacagagatggataaggtataatccttgtctcaggagcttagagtctcattgaaaagtttttcaaaacacacatttgaatgattttgttgagtcaacattacgtatttgtttgtgaacacataagcgcacaccctttccccaccttcacttcctgtttccttgcaaatgcaaagacaagagtaaaggacttgcctagaggaaacacagaaatactgatttacaggtgaaaaatatgtaaatttgaaaaggtgttgaaaargacctaagtttttgtagccacctgactaataaacacagagatcacatgtccaccatagatgggtaaatgaaaaaaagcaagtttcaggttaataggaatagtattatttcattatttgttagcccctatcccttgcacatgtgtgtatgtattgtttgtgtaaacatagatgatgtggaaagatctcccatattgttaatattagttatctcaggggacaaaggaaagcttattcctgtttatacatcttttattgtttggtttaagaagcatgttttacttttttaattaaaaaatcta

SEQ ID NO: 94098 - DNA, 601 bp, Human
tgtggaaagatctcccatattgttaatattagttatctcaggggacaaaggaaagcttattcctgtttatacatcttttattgtttggtttaagaagcatgttttacttttttaattaaaaaatctaataaagtaggaagtgaataaataatagtaataaaaagtatcttcaggccactgagcctgttgcagtcttcccagtagcgtgagtaattagtaccgtctgtaatgcttcaggtgtggactgcccagcaggactctgaacttcttgctacagcctaaggtgatactaagttttctrtagcaacactataatgttgagagttactgtgtttatagaccattaacacctcaaagtctttcttccatctgctcctcttggcacactgctctagataatcattttggaatgagtttagtcctttacgctctccctgttagatttcatattgttactgtggaaatcagtatttagcatgggtaagaactggccttagatgcaagccatctggttacagatcctcactaccactatcatgaaaacttggacaagtaacttgtctccccaagcctcagttttctcatctgcaaaacagcaata

SEQ ID NO: 94099 - DNA, 601 bp, Human
taattttactttgtgggagaaagctaaatggagttattttcttatttaagctaaatgatttctgacattaagctcataccatttccagtgattggccactgcactttactgattgtgaaacgccaagagagatgagggctgagcaaattggaatatactcaagggtgtcagtttggtgcatgtctgatggttttctcttctgtctgggagtgcatgtattttccaaaatccaccttttgaaaaatactggtaaagtgcccaaattgagaattggatttcagaattaaggagatgtcagtgrtgggttggagtttaaatgtattttagaaatggaataaacttttagctcattagaacttctccatccaagaaggagctgtgggggagtgtgtatttatcttgtaaatatcaagtgactcagtgtcacagaggcttctgcatcaatagaagctactgctcatttgaaatgagtatctctctggctttttccatgatagattttgattgtgatacacttggctattcatttgacacctaaaagaaaatgattcacctctttggaaagatataaggtgtttcattatctgatcgtttctgcaaa

SEQ ID NO: 94100 - DNA, 601 bp, Human
tattttagaaatggaataaacttttagctcattagaacttctccatccaagaaggagctgtgggggagtgtgtatttatcttgtaaatatcaagtgactcagtgtcacagaggcttctgcatcaatagaagctactgctcatttgaaatgagtatctctctggctttttccatgatagattttgattgtgatacacttggctattcatttgacacctaaaagaaaatgattcacctctttggaaagatataaggtgtttcattatctgatcgtttctgcaaactcttattccctgcatctsgtctctctcattatggtgcacccatgccagctctccccctgtgcttctcttgagtctgcaagacctgatcttcgaatcaagttattatcttgaagtcaggagggtcgaagccagcattgattgaggggcttctatgtgctggacctgcacatgtactatctcatgtcatttctcttacctgccctgtaagggatgcattgtcacctccattttactaagaagtagactggtggtcatagcatcgtgaaactagcaaataacagagccaagatgtggatcattctgactggctctgaagcc

SEQ ID NO: 94101 - DNA, 601 bp, Human
atcaagtgactcagtgtcacagaggcttctgcatcaatagaagctactgctcatttgaaatgagtatctctctggctttttccatgatagattttgattgtgatacacttggctattcatttgacacctaaaagaaaatgattcacctctttggaaagatataaggtgtttcattatctgatcgtttctgcaaactcttattccctgcatctcgtctctctcattatggtgcacccatgccagctctccccctgtgcttctcttgagtctgcaagacctgatcttcgaatcaagttattaycttgaagtcaggagggtcgaagccagcattgattgaggggcttctatgtgctggacctgcacatgtactatctcatgtcatttctcttacctgccctgtaagggatgcattgtcacctccattttactaagaagtagactggtggtcatagcatcgtgaaactagcaaataacagagccaagatgtggatcattctgactggctctgaagcccatgctctttgaactgcagcactctggagaaaggaaggaactgggattttggcatttctgtatcctctggatatgtatggtttaaatt

SEQ ID NO: 94102 - DNA, 601 bp, Human
ctttccccccctcgatttccatgcctgtatcaaatttgagcaagtttgtcagtagatgaaaattaccaatttttataggaagaatagggaatgcagcatggttttctgaataaaagaatctcagtaggtggttgtacaatgttagtgtgttttctgatataaaatataaatatgtatgggtgggtgtatgtgtatgtctctatctctctcttttttttttgagacagtctcactttgtcgcccaggctggagtgcagtggcgcgatctctgctcactgcaacctccacctcccagattcargcaattctcttgcctcagcctcccgagtagctaggattacaggtgcgtgccaccacacctggtaatttttgtatttttagtagagacagggtttcaccatgttggctaggctggtctcaaactcctgacctcaagtgatccgcctgcctcggcctcccaaagtgctgggattacaggcatgagccaccgcgccaggcatctccgtctctctttcaggaagatccattgtttccccatcataggaatttttaaaaagtaaaagcgaactctgcctttgttctgatttatgattgcttactc

SEQ ID NO: 94103 - DNA, 601 bp, Human
gtgggtgtatgtgtatgtctctatctctctcttttttttttgagacagtctcactttgtcgcccaggctggagtgcagtggcgcgatctctgctcactgcaacctccacctcccagattcaagcaattctcttgcctcagcctcccgagtagctaggattacaggtgcgtgccaccacacctggtaatttttgtatttttagtagagacagggtttcaccatgttggctaggctggtctcaaactcctgacctcaagtgatccgcctgcctcggcctcccaaagtgctgggattacaggcrtgagccaccgcgccaggcatctccgtctctctttcaggaagatccattgtttccccatcataggaatttttaaaaagtaaaagcgaactctgcctttgttctgatttatgattgcttactcaaggaagaccaagactttgtggttgtggccttcctttggcagataaagtaaggcacagagtgtggcacagtcatcaagggtcacttggatggtcatggcagcactgctatttgaagctagtggcttggctcctgatccagtgctctttctgtcatactaaactgcctcagtagtgttag

SEQ ID NO: 94104 - DNA, 601 bp, Human
aggaggataccagtcgacaggcagtgcagattatccaaaagccagcctccccttctccccagatatgcacatggccaagcttggttttacccactctcttcaaagattagtggatttgaggtcgggaaacctgaacaggaagaccagttgtgctgtttaaccagtcagctgaattttgaccaacctattaacctttctaggttcttgttttctcacttgtaaggtagggagaatagtgtctaccttacagaatatatacaaatactgcagaatcaacagcatggtacaagagtggtacatwtgtacgttcgttgttcttccactagctttgacaaaaaccggctagtttttgaagaaggtggattgcataatacttgaattgactgtttagaaataaattacccctatattttatttatttatggacctttgctaattttgagaagaaatttgtgttttctcttccttgtgtaatattcatttgttttatagtgaaaagttgccagtacattttcaggtataatctttaaaaaggtggccaccacatcagcttaaaatactgctagcattgccctgcccaccacccaaagtgtcactacat

SEQ ID NO: 94105 - DNA, 601 bp, Human
gataccagtcgacaggcagtgcagattatccaaaagccagcctccccttctccccagatatgcacatggccaagcttggttttacccactctcttcaaagattagtggatttgaggtcgggaaacctgaacaggaagaccagttgtgctgtttaaccagtcagctgaattttgaccaacctattaacctttctaggttcttgttttctcacttgtaaggtagggagaatagtgtctaccttacagaatatatacaaatactgcagaatcaacagcatggtacaagagtggtacatttgtaygttcgttgttcttccactagctttgacaaaaaccggctagtttttgaagaaggtggattgcataatacttgaattgactgtttagaaataaattacccctatattttatttatttatggacctttgctaattttgagaagaaatttgtgttttctcttccttgtgtaatattcatttgttttatagtgaaaagttgccagtacattttcaggtataatctttaaaaaggtggccaccacatcagcttaaaatactgctagcattgccctgcccaccacccaaagtgtcactacatacctg

SEQ ID NO: 94106 - DNA, 601 bp, Human
aaaactcccttttataaacttaggtggtaaagtaacagttggacacaggcataacctaaactttttgtgtcagtggattataatatgtgggctttcccaaagagttgctttaggccctggccccttggacctgtgatttgaatccttttctttgtcctttacatgggtgctcgtctcatctcatttttattgtagccccttctgaggtttgtgctttttggatgaggtcacatggtagatagggggtgcagggggctttctgtttgcattcactggcccagaatactgtggttttggcccsttgctccatgatacatactatcaactagagatggttttgaattatttaatctggacctcagcaaaataggtacacttaaatagagattgaagaaagggaggttggaattttttcctcctgagatttcaaatgtaaggaataaagaactttttgaattaacgaattgttttgaggcagtggggatcttcccatttgttctagctttacaaaattaaatctattttctgaactgtacggtgggaaaatatttttaaggtacataatttctgaaaatgtctttgtggtaagctgttagtggtt

SEQ ID NO: 94107 - DNA, 601 bp, Human
gctttgaatgttggaagagaagaaggtgcaaacctgttagctaacgcaaaaaatgcaaattagcacccagaatgtgagctattaaaacattaagttctggtctcagtctcattggggagaaaaagcaaacatgtcagaaggagcttaggagtcttggagttgacagtctcccaataaagtaaggtgcccacagtaggaactgtggtatgaaatggtgtttcagcaggaactgcagtgttaggaggtatagtacagcacagattttccaggtgtgtaccctgggccagcagcagcagcagcycacttggggacctgttagaaattggagtgctcattctcactgcagccctgctaacacaaaaattccggaggtggggtccagcagtctgtgttgtagcaaacattcgtggtgactctgatactcactgaagtttgagaacttttccctccagaattcttatttaaattttattatatttatatatttatttatttttgacaaagtctctctctgtcacccaggctggagtgcagtggtgccattttagctcactgcaacctccacctcctgggttcaaatgattcttgtgcctcagcttcc

SEQ ID NO: 94108 - DNA, 601 bp, Human
tatgatgcagacgaaagtgatccgtgatctgttaccgttatgatgcaggcgaaagtgatctgtgatctgttaccattatgatgcaggtccatgatctgttaccattatgatgcagacgaaagtgatctgtgatctgttaccattatgatgcaggcgaaagtgatccgtgatctgttacaattatgatgcaggcgaaagtgatccgtgatctgttaccattatgatgcaggcgaaagtgatctgtgatctgtgatctgttaccattatgatgcaggcgaaagtgatccgtgatctgttaccrttatgatgcaggtgaaggtggtccgtgatctgttaccattatgatgcaggtccatgatctgttaccattatgatgcagacgaaagtgattcgtgatctgttaccattatgatgcaggtgaaagtgatccgtgatctgttaccattatgatgcaggcaaaagtgatttgtgatctcgtagcattatgatgcaggcaaaagtgatctgtgatctgttaccattatgtatgcaggcaaaagtgatctgtgatctgttaccattatgatgcagtatgaaagtgatctgtgatctgttaccatta

SEQ ID NO: 94109 - DNA, 601 bp, Human
tgatccgtgatctgttaccgttatgatgcaggcgaaagtgatctgtgatctgttaccattatgatgcaggtccatgatctgttaccattatgatgcagacgaaagtgatctgtgatctgttaccattatgatgcaggcgaaagtgatccgtgatctgttacaattatgatgcaggcgaaagtgatccgtgatctgttaccattatgatgcaggcgaaagtgatctgtgatctgtgatctgttaccattatgatgcaggcgaaagtgatccgtgatctgttaccattatgatgcaggtgaargtggtccgtgatctgttaccattatgatgcaggtccatgatctgttaccattatgatgcagacgaaagtgattcgtgatctgttaccattatgatgcaggtgaaagtgatccgtgatctgttaccattatgatgcaggcaaaagtgatttgtgatctcgtagcattatgatgcaggcaaaagtgatctgtgatctgttaccattatgtatgcaggcaaaagtgatctgtgatctgttaccattatgatgcagtatgaaagtgatctgtgatctgttaccattatgatgcaggcgaaagtg

SEQ ID NO: 94110 - DNA, 601 bp, Human
atgatctgttaccattatgatgcagacgaaagtgatctgtgatctgttaccattatgatgcaggcgaaagtgatccgtgatctgttacaattatgatgcaggcgaaagtgatccgtgatctgttaccattatgatgcaggcgaaagtgatctgtgatctgtgatctgttaccattatgatgcaggcgaaagtgatccgtgatctgttaccattatgatgcaggtgaaggtggtccgtgatctgttaccattatgatgcaggtccatgatctgttaccattatgatgcagacgaaagtgatycgtgatctgttaccattatgatgcaggtgaaagtgatccgtgatctgttaccattatgatgcaggcaaaagtgatttgtgatctcgtagcattatgatgcaggcaaaagtgatctgtgatctgttaccattatgtatgcaggcaaaagtgatctgtgatctgttaccattatgatgcagtatgaaagtgatctgtgatctgttaccattatgatgcaggcgaaagtgatctgtgatctgttaccattatgatgctggtgaaagtgatctgtgatctgttaccattatgatgcaggcgaaa

SEQ ID NO: 94111 - DNA, 601 bp, Human
tttgcttgggttctcagaagcagcatttaactgcatttaatcaagtcatcattactccaaggggtgtgtgtgtatgttttaagtagcgtatcttctgtgtttcttctctgttcaggcaactctgatcttaatgatccaatgttttatgaccccaaaggccctttcttaacaggatcccagtttgcaatctgtaatacaacaggcattgtatcacaaagcattaatgtagatgagtagtgacctggcttccaggctgtcttctggtaacaggcttctgtttagtgtagtatcagcagatacrttttaaaagtaggatagatggttcatttaagagggctttatcatcagtattcacttgaataccagagatactggtgaataccatttggtgtagcgtaacagtgcttaaactttttggtctcaggacccctttaaattcttaaaaatgaagatgcagctgggcacagtggcaggcacctatagtcctagctactcaggaggctaaggcgggaggatcacttgagcccaggagttggaggccagtctggacaacatagcaagaccccatctcttgaaaaaaagtgaaagtgaaataaattta

SEQ ID NO: 94112 - DNA, 601 bp, Human
atactggtgaataccatttggtgtagcgtaacagtgcttaaactttttggtctcaggacccctttaaattcttaaaaatgaagatgcagctgggcacagtggcaggcacctatagtcctagctactcaggaggctaaggcgggaggatcacttgagcccaggagttggaggccagtctggacaacatagcaagaccccatctcttgaaaaaaagtgaaagtgaaataaatttaagttaatggcaaactcttttatagtctgccatggtaaaaagtacataatttctgtcacaatttgcacrtatggagctgaaagaactaatgattagcaacattctgtcatgtttttataaagttcccactaacaggatagagcaaattgaatttgacatgagatgatagtagctgagaaatacaaactctttgatgtgagttaggggccatgttatgcaggatgtggatactgagatactccagaagtttatgaagtttcacagaatctgggtgtcccaagtcctcactgtggctggctgatgtaggagcccacaagccaaggagagctggtgatgaaaaacacccccatttgctgttccaggctggta

SEQ ID NO: 94113 - DNA, 601 bp, Human
ttcttttggtgaatgcatatgaagaaaaactgctgtcaccacagatatgtagttggaaaaggggagagtatgtttaattgctttttcagataaatctgaacattcttcgatactacaccaaaacttgacaagtgttactttcttcaaggttattagtatgatgtggaatctgaagccatgtctgtgactttttgaacattgtttcactaaaacacatcagtctctgttgtactttgaatggattttgtgatatcatgcatggattgtttggaaaccatttgctgagtgttgcagagcttccaaatgttggcatattgcattgtacactcacaaaaaaatcacattcatttcttttcctgatgatctcattggaaaagtctgtaagtatttgcagaaccatgaagctctggttggcagatgaaagtattccacaattataatttttacctaaaagcctgtattttatcattgacagtaactactgtaaattgtttttctctagagtcaaagccaggtttgagccctggcactcttgtttaatacgctggccatgggacccaggtgagcccacttagcgcctttctgagcccttatcttgttt

SEQ ID NO: 94114 - DNA, 601 bp, Human
aaggttattagtatgatgtggaatctgaagccatgtctgtgactttttgaacattgtttcactaaaacacatcagtctctgttgtactttgaatggattttgtgatatcatgcatggattgtttggaaaccatttgctgagtgttgcagagcttccaaatgttggcatattgcattgtacactcacaaaaaaatcacattcatttcttttcctgatgatctcattggaaaagtctgtaagtatttgcagaaccatgaagctctggttggcagatgaaagtattccacaattataatttttrcctaaaagcctgtattttatcattgacagtaactactgtaaattgtttttctctagagtcaaagccaggtttgagccctggcactcttgtttaatacgctggccatgggacccaggtgagcccacttagcgcctttctgagcccttatcttgtttgtttttttttttgttttttctttttttttaagagactgggtcttgctctgtcacccaggctggagttcagtggtgctatcatagctctctgcagcctccatctcccaggcctaagcagtccttccacctcaatctcagcctctca

SEQ ID NO: 94115 - DNA, 601 bp, Human
aatgttggcatattgcattgtacactcacaaaaaaatcacattcatttcttttcctgatgatctcattggaaaagtctgtaagtatttgcagaaccatgaagctctggttggcagatgaaagtattccacaattataatttttacctaaaagcctgtattttatcattgacagtaactactgtaaattgtttttctctagagtcaaagccaggtttgagccctggcactcttgtttaatacgctggccatgggacccaggtgagcccacttagcgcctttctgagcccttatcttgtttgkttttttttttgttttttctttttttttaagagactgggtcttgctctgtcacccaggctggagttcagtggtgctatcatagctctctgcagcctccatctcccaggcctaagcagtccttccacctcaatctcagcctctcaagtagctgggactataggctaccatgcccagctaatttttttgtggtagagatggggtcttgctttgtcgcccaggttggtcttgaactcaagtgatcctcccgccttggcctcccaaagtgctggtgttacagttgtgagccaccatgcctggcag

SEQ ID NO: 94116 - DNA, 601 bp, Human
gaagttgtctcagggaacttaactagatgtgtgggttagccaaagccttgtagcaaagtaacatattttaaagcagccatcatttgataggagtaggcccagctgtactctaggaagtaggctgaagggagccacttggggtaggaaggcacctccctccatgcagtgggtgtgactcatccacaggatcctctgtgtgagatttctctaggttcttagggaaaaaaaagggggagtataagctgataccgttttccctgctgtgtgagtgtcctgattgtaaaaattttctagctttatrttggcaaaattgtatttcaaggattaccttgattagctatatgagaaatgggttggagagaagctacaacagttccttaaatgttcttaaacatcttagattattctatttaattcctgaagagatcatttggatatgttttcttgagcaaaacaggcagatggtgttgctacccagtttcccaattctgtaaggcctgtagcagacatttacggtaggcttgcagtagtgaaagatccatggactaggaatcagaagactgggtcctcggccttattcccagctctgtcatgcgtgatt

SEQ ID NO: 94117 - DNA, 601 bp, Human
tgaagggagccacttggggtaggaaggcacctccctccatgcagtgggtgtgactcatccacaggatcctctgtgtgagatttctctaggttcttagggaaaaaaaagggggagtataagctgataccgttttccctgctgtgtgagtgtcctgattgtaaaaattttctagctttatgttggcaaaattgtatttcaaggattaccttgattagctatatgagaaatgggttggagagaagctacaacagttccttaaatgttcttaaacatcttagattattctatttaattcctgaaragatcatttggatatgttttcttgagcaaaacaggcagatggtgttgctacccagtttcccaattctgtaaggcctgtagcagacatttacggtaggcttgcagtagtgaaagatccatggactaggaatcagaagactgggtcctcggccttattcccagctctgtcatgcgtgattttgtggctcttaggttggtgacctgcaaaatggagatgttggtcatccttgcttacttcaccaggggcgtccatcctaagacataagagaatgccggtaaattgctttacaaccaaagtaca

SEQ ID NO: 94118 - DNA, 601 bp, Human; identical to SEQ ID NO: 31187

SEQ ID NO: 94119 - DNA, 601 bp, Human; identical to SEQ ID NO: 31188

SEQ ID NO: 94120 - DNA, 601 bp, Human; identical to SEQ ID NO: 31189

SEQ ID NO: 94121 - DNA, 601 bp, Human; identical to SEQ ID NO: 31190

SEQ ID NO: 94122 - DNA, 601 bp, Human; identical to SEQ ID NO: 31191

SEQ ID NO: 94123 - DNA, 601 bp, Human; identical to SEQ ID NO: 32547

SEQ ID NO: 94124 - DNA, 601 bp, Human; identical to SEQ ID NO: 32546

SEQ ID NO: 94125 - DNA, 601 bp, Human; identical to SEQ ID NO: 32545

SEQ ID NO: 94126 - DNA, 601 bp, Human
gctttctttttatctttcaggaaagaaaccaaagagacagactctccagcaggcagggggcgccagtgagtgagctaggcatagagtcttgtggagagaattatggtgtcatagaggcttagaatcttggcattagcagggaagggaacccatctggttcagaaggctttggcttctgatagtcatggactcactaggctgctgaggaagatcaataatacctactggaatcagtcatgagaagtcaagcatggaaattgtgaattgtgtgtgtggccagaccaggtaacacagagaaacmttgtcttttgggtcctctctccatggctttttcatgtgttcattagttcattacgtatttacctactgagacccatgcaatgccattcagtgtgttggatgagaggattccaggattcatcctatctttcaggaaaaagctcctgcttctatttaagaggaagacatgggagccactgggggtggggatagtgagaatgcctgtgtttatggaactaacagaccacaaaagtgagacaattgggaaaataataaccactataaaaatgtaatgggaagtacaggggatccaagaaagcct

SEQ ID NO: 94127 - DNA, 601 bp, Human
tgggggtggggatagtgagaatgcctgtgtttatggaactaacagaccacaaaagtgagacaattgggaaaataataaccactataaaaatgtaatgggaagtacaggggatccaagaaagcctttcagggagatggaggttttgggttaaggaagttttcctcgaggagtgatgtgtaagcagagacttcaggtttgaacgatattcagtgagcatgtggggacagagacccaggaagggtggtttaagctgggaaagagcacattcaaagacctggaaagaggtgagaaaattcagcakgtgtctgctctgagccagtctggtgcctgagggaacagtgtttggacatgaggctgggcctgtgggcagagggagaaggtgccttgccagagccctcctggtggtttgggctctgtatcaatcctctctgaatagagcaataagagctaggaagatggccctggccttgcaccacaagtgtttgacatgattaggcagatttcctgaggcaggctgtgcacagcatggttgggaaggaagggaaatggagcttggagagaatatttatttatttgtttgtttctttttatttatttattg

SEQ ID NO: 94128 - DNA, 601 bp, Human
agaggcttttctcacaatcccaaggatgccagaggctggaaggtggttgccacctcacctcagcagttgtcactccaaatcccacacccatcctaccctaccagtgacagggctctgacaggcctggcacctccctgacatgggtttgtggctttgtgagctgagtccacagagggggtacaggctcatttcccgtgcttctacatttccttgaggaggctagataacaacctgctcactgtctgctgtttcctggccacttctagaccctctattctgctctgggaccacaacagtggcrttcatcctctcatcatgtgccataggagggaccagggcggaaaccattaggggcttctccaggggctgcatacctgggctgaggcccagggacgttcccagaagagcttggacttcctgggaggaggaagatgggtagatagaagtaaagcaagagttgtttggattttctctatacctggaagaatcaggaaatgataaaactgctgagtggttgagtttgaggacacctaccaggtccagttcccccttcctcacccccaccactgcccctttatagaggaagaggtacaagcccaga

SEQ ID NO: 94129 - DNA, 601 bp, Human
gataacaacctgctcactgtctgctgtttcctggccacttctagaccctctattctgctctgggaccacaacagtggcgttcatcctctcatcatgtgccataggagggaccagggcggaaaccattaggggcttctccaggggctgcatacctgggctgaggcccagggacgttcccagaagagcttggacttcctgggaggaggaagatgggtagatagaagtaaagcaagagttgtttggattttctctatacctggaagaatcaggaaatgataaaactgctgagtggttgagtttsaggacacctaccaggtccagttcccccttcctcacccccaccactgcccctttatagaggaagaggtacaagcccagagagatgaagagaactgcacaatcccttaggcttgggagttgcagaaccaggcctggaactcaagtcctgccatgccaagagcactgtacttttcatttcatcttgctgtaaccaccacagtgctccgtgcatgggacaaaatgatgcattcaggaagcgtgtgacagttggtcactctaagtgcaagagtttcattgcacctgggtccatgggtgccacatt

SEQ ID NO: 94130 - DNA, 601 bp, Human
tagaagtaaagcaagagttgtttggattttctctatacctggaagaatcaggaaatgataaaactgctgagtggttgagtttgaggacacctaccaggtccagttcccccttcctcacccccaccactgcccctttatagaggaagaggtacaagcccagagagatgaagagaactgcacaatcccttaggcttgggagttgcagaaccaggcctggaactcaagtcctgccatgccaagagcactgtacttttcatttcatcttgctgtaaccaccacagtgctccgtgcatgggacaaratgatgcattcaggaagcgtgtgacagttggtcactctaagtgcaagagtttcattgcacctgggtccatgggtgccacattagagacaagaacaagcacatgctctggagtgggatagagcttggcttgaatcacttacaagcaactgaggtggatttttgaacttcagtggtcctcatatgaagtgaagtggactaaaaatgtctacctcaggctggtagccgttataacattagctgatgtttgtgaagtgcctgacacttgactcaggatctggagactgagggtcaaactgtttg

SEQ ID NO: 94131 - DNA, 601 bp, Human
ctaaggaaaatcctactctttgaaagttttgtggtagtttttatctaaataaatctctacaattacattattacctttgtgcaaacaggcatttcggaaatggaaaaacatgttgagctatggaaggggaggaagatgtccttctcaaagggagagaagatattttagaactacatagtacccctcaccccccccttttttttttttttattaaatcagtatagctgtgccagaatctcaggatccggtgtaggggtttcataaaactccataggatatcctgacacatatccctcccccrgttgagagtccctaagttagtgttttataatactttccctcacatagtgttagcattcagagccagtcattgctgctgctgatggactttgaactcagtctcttatttcaaagaattagtattttctgcttggttggtgaatctatgacacgagttctcctctaggtggcaagctcaccattgtgttctcagggactatcacagtagtgtcagtttaggtactcaataaatagttgttggatgaatacataataccttaatacttaatgattccttcaacataccaggtgtggttaggga

SEQ ID NO: 94132 - DNA, 601 bp, Human
gaattcactgcctctgttcacatactggttaggttgcaaaggcaagcctaaagtgtcgataacagaccacccaaccagtatgtatgcattgggttaagttcagtttcatggaagaactgtagaaggccatggcattttttattactcttcttgctactttttagtccttttaaaattttcatccaaggttttcatcttgactttgttttcatacagttatgtctggacacattgcttcaacatagaacgcacatgaacaatgtggaggtctaggctggaatgggggcccagttgaccactkttgctctagctggtaggcattaatactatctccatgcatgtcagttagaggagctgccatattgtccttagcttatcttctttgattgttaaatcataacattgcaatgcttaacttctgatatgaatgactacagtcttaagtcttaatcattcttttttttttttttttttttgagacggagtcttgctctgtcaggaggctggagtgcagtgggcgatctccgctcattgcaagctccgccttccgggttcacgccattcttctgcctcagcctcccgagtagctgggactacaggc

SEQ ID NO: 94133 - DNA, 601 bp, Human
attcagtggcacacatagaatgtgaacggttggtaatgacaaggtactgataccaggttgtctgcttagtattaggatgtacaaagctattaattcataaataagacatggtttcttctctcatggagccctcaggctaaggaggcaggcatgtaacaatagggtaacatatgttacaggcgtcctgccggaaacccatacagattacagtggtaatgcaggagggagcagccaactctattggccaaaagtattgaggagtgaggtgctcagtcaggaaaggctttgtagttagtgatgrtgacttgaaaagcagataggtagggagaagaggagagactggcattgctgacagaactggcatagccaagctgcacaagataaaccaaactatcctatgcatagaaaagctgtccagtagattagggtgtgggagctgttctgggagacagcaggagagtcagagtgaggccaggaaatagacagctgtgatggttaattttaggtgtcaacttgactggattaaggacatctagaaacctggtaaaatgttattttggggagtgtctgtttccagaggatattggggtgtgaatccaag

SEQ ID NO: 94134 - DNA, 601 bp, Human
gtctcatcaaagataaccaaattgttcagttagtatttcgagtgtagtactcatagaacacataggtatcctgtggatagatgctgcgcttggccttttagcaatgactaggatgccaggcaaataagtaaaaagtagaggtctttggaggggcaggggcaggtggcaaggggggcagagaatgtgagagttggaaggtgaggttacagatgatctagtctgagctttcattcttacagacgaatgaagcctggagtggctgtgatacagacgttgaatcaaaactatttgcattggtatytggcagtgttttggtttttctgagcctatcatgacatacaagggtactgtttatttatttatttatttattttgagatggaatttcgctcctgttgcccaggctggagtgcaatggctgcgaccttggcccactgcaacctccgcctcccaggttcaagcgattctcctgcctcagcctcccgattagctggaattacaggcatgcgccaccacgcccggctaattttgtatttttagtagagacagggtttctccatgttggtcaggctggtctcgaactcctgacctcaggtgatccg

SEQ ID NO: 94135 - DNA, 601 bp, Human
cagggtttctccatgttggtcaggctggtctcgaactcctgacctcaggtgatccgcccaccttggcctcccaaagtgctgggattacaggcgtgagtcaccgcgcccggccagtactatttttgttagtgttatccaaggcagaagattctgaacaattgtggttataatttactgaggactatgaaaattgactgaaaatcttaacggaagttatttcaatagtaatccattggaatgttaattttaatcactagtgttggcaagtaaaaatactttacaggtgataatacactaaagsaagaacaagctcatctgggagagagaacccaggactagaccttggaaactgtagttctaaacccaaatcttaccccttctggctgtggcccttcagatgggtcacttaaactatctgggcttttgtggcttcatatgtagaatgagagtgttatattaaagagatgaccaagattttttccagctttattttttatttttttaaagaggcttgtgaggagctatttttcagctttaaattgtagtttgtgtgggtcacaagagttaaagctccttggaaattttatggttaagccataca

SEQ ID NO: 94136 - DNA, 601 bp, Human
gagttagtttatgaaattgaatgcttcccttgagacctaatgccaaatagaaatttagatgtcttgtcggggctgattaacagaaaaagtaattatcaatcagttcacaggaaattatcattagctgtcttactgatactggttctctgtgagcgatcctctttataatttgtagagatgatttatttctaaaggaatggcaatgtgaataaaggtttctatatgttttagttgagaagagccctagagatcagctgtgtgtctcttgttttataattgtgaaaattgaggctcttggaargcacatgatttgcccagggtcagtggcaagccaagattagagagtggctcttctctttttctggtgaactttctactgcatttgacattccttgttttgtgattaacagaagtcagcatccggtattgtagctgtccctttcagcgaatggctccttggaagcaaacctgccagtggttatcaagctccttacatacccagcaccgacccccaggactggcttacccaaaagcagaccttggagaacagtcaggtctgttgctgcttttattgtttctacagtagacacagcagtaggtg

SEQ ID NO: 94137 - DNA, 601 bp, Human
agctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggtgagcataaacatcaaaatagcactggtttgagttttatttatttattcatttattttgagatggggtctctgtcactcaggctggagtgcagtggtgcgatctcagctcattgcaacctccccttccgaggctccagccatccccctgccygcactacagcctcctgagtagctgggaccataggtgtgcaccaccatgcctggctaattttttgtatttttggtagagatggggttttggcctgggctggtctctgaactcctgagcttaagcgatctgcccgtcttggtctcctaaactgctgggattacaggcgtgatccaccacacccagcctagagtttcatatttcataatcccaaaccttgcaaaccggccagccagatccttaaatatgttaaatactaaatttggaatggaggatttatgatttttttgtgcattttccagg

SEQ ID NO: 94138 - DNA, 601 bp, Human
gttggtctcatgcctccttgttttcatgaagcaacctactcttttcttttattgcaggaagtattacttaattcacctctacaggaggaacataacttccccccagaccattatggcctccctgcagtttgtgatctctttgcctgtatgcagcttaaagttgataaagagaagtggttatatcgaactcctctacaggtgggtacatgccaccagcatgaaaattagattatagctatttataaaataaatgttttgtcttacatatgaagtcatacttggctcactgaaccatatcccwtttaatagtatgtatattaggcaagtgagggtgggacgggggagctcataaaaagttgatgtattttaattgaatttgctttattaactaactaggcatacttcaaaatgaactttcaagatgtaaccgttgggaattttcagatcccatgtggattctagtagtttatatacctacctcgaaggtgggtttggttccaggccactgcaataaagcaaatatcccaataaagagagctacacaaatactttggtttcccattgcatataaaagttgtatataatacactatagttaagtc

SEQ ID NO: 94139 - DNA, 601 bp, Human
ttttcatgaagcaacctactcttttcttttattgcaggaagtattacttaattcacctctacaggaggaacataacttccccccagaccattatggcctccctgcagtttgtgatctctttgcctgtatgcagcttaaagttgataaagagaagtggttatatcgaactcctctacaggtgggtacatgccaccagcatgaaaattagattatagctatttataaaataaatgttttgtcttacatatgaagtcatacttggctcactgaaccatatcccttttaatagtatgtatattargcaagtgagggtgggacgggggagctcataaaaagttgatgtattttaattgaatttgctttattaactaactaggcatacttcaaaatgaactttcaagatgtaaccgttgggaattttcagatcccatgtggattctagtagtttatatacctacctcgaaggtgggtttggttccaggccactgcaataaagcaaatatcccaataaagagagctacacaaatactttggtttcccattgcatataaaagttgtatataatacactatagttaagtctgcaataacattatgtctta

SEQ ID NO: 94140 - DNA, 601 bp, Human
tcaatgggtgtagtattttgaaaggaatgtttttttctgagcagtagttctcaacagagggcttaaaatattcagtaaaccatgctgtgaacaggtgcgctgtcatccaagctttgttgttccatttctagagcacaggcagagtagatttagcataattctcaagggctctaggattgaagcactggcttcaacttagccaccagtggccaggtgcagtggctcaggcctgcaattccagcactttgggaggcagaggtaggaagattgcttgagccaaggagtttaacaccagcctggscaacatacagagaccctgtctgtacaaaaattaacaaattagctgggtatggtggagcgtgctatagtcccagctactcaggaggctgaggtgggagaatcttgtgtctgggaggtcaaggctgcagtgtgctataatagctctgctgcggtcttgcctggttgacagagggagaccctgtctcaaaaaaaaaaaaaaaaaaaaaaaaaagagtcactggctgtgttagtccctaacaagagagtccatctgtcctttgaagccaggcattcacttatctctctagctatcagttctaga

SEQ ID NO: 94141 - DNA, 601 bp, Human
tagcataattctcaagggctctaggattgaagcactggcttcaacttagccaccagtggccaggtgcagtggctcaggcctgcaattccagcactttgggaggcagaggtaggaagattgcttgagccaaggagtttaacaccagcctgggcaacatacagagaccctgtctgtacaaaaattaacaaattagctgggtatggtggagcgtgctatagtcccagctactcaggaggctgaggtgggagaatcttgtgtctgggaggtcaaggctgcagtgtgctataatagctctgctgcrgtcttgcctggttgacagagggagaccctgtctcaaaaaaaaaaaaaaaaaaaaaaaaaagagtcactggctgtgttagtccctaacaagagagtccatctgtcctttgaagccaggcattcacttatctctctagctatcagttctagatgactacttcttccaataggaagttgttttgtctgcactgaaaatgttgagtgtagccaacttcatttacgatcttggctagatattctggataacttgctacttcaccttgcatttttgctatggagatggcttctttccttaaacctc

SEQ ID NO: 94142 - DNA, 601 bp, Human
agtttaatcatttctggcttttgatttaaagaagagtgagagatggggactattccttttagttgaacacttagatgcaattgtagggttaataattggcctaatttcaatcttgttttgtctcagggaacagggaggcctgaggagagagaagagaaatagggaaaggctgtttggtgggcattcaggacatttattgatgaaaagtttaccatctttaatgggcatagttcatgacacaaatgcttaatttgtaaaaaatacaatgtaacaagggtatacctgtattgggaaatgagtyggagctttaaggcagggaaaatttgcttttattcttcattgaagtaacttatcatctgtgggtgtctctttacagatgtgaaggaatggacaagagttgagcagcctttctgctgattatcacacatcatgagctgagtgactgcagcttgccaaatctttgtgtttctgggtctgaccaattagcttagttcttctcctgcctaattttgaactagtaaagcaaagtgagtcatcagattatgagttactgtttaaaagaaaaatgctgtttattcatgctgaggtgattcagttccct

SEQ ID NO: 94143 - DNA, 601 bp, Human
tggaacttgggtctgtctggctttggaaggctgaagacaaaccgcagtaaagaactttgcacccccaacaccggcgcttactatgggctcatggcaggccggcccaccagccacaactagggaacagccaagcgcgtttaaaagccaaaggtagaacttctgcagctgcacagtttctgagtttccatttaacaagaaccttggcctggtgcaagcagaggcctgagctccccaggctgccagccccgcagaggcaggcccgcctggaaggaggctccacagcccaattcctccattgccyaaacgagatcagggtggcccttgccatccccgaggggaaaccgggcccacacgcccccttcctgagagcggaccggcgcgagccaccaggatgccaagagcccctgcagccccgacttctccaccaggcgccagctcaggccccttcctcggcgcgccggcaccctagcccggggacccacacggtaggcagcgggaccccggggctgggaccacgagcacgcgcccctcggccgcccgccctggcacaagggacggctgcggagacccaggcgaggggcccgctgtccccagcacagcc

SEQ ID NO: 94144 - DNA, 601 bp, Human; identical to SEQ ID NO: 27849

SEQ ID NO: 94145 - DNA, 601 bp, Human; identical to SEQ ID NO: 27848

SEQ ID NO: 94146 - DNA, 601 bp, Human; identical to SEQ ID NO: 27847

SEQ ID NO: 94147 - DNA, 601 bp, Human; identical to SEQ ID NO: 27846

SEQ ID NO: 94148 - DNA, 601 bp, Human; identical to SEQ ID NO: 27845

SEQ ID NO: 94149 - DNA, 601 bp, Human; identical to SEQ ID NO: 27844

SEQ ID NO: 94150 - DNA, 601 bp, Human; identical to SEQ ID NO: 27843

SEQ ID NO: 94151 - DNA, 601 bp, Human; identical to SEQ ID NO: 27842

SEQ ID NO: 94152 - DNA, 601 bp, Human; identical to SEQ ID NO: 27841

SEQ ID NO: 94153 - DNA, 601 bp, Human; identical to SEQ ID NO: 27840

SEQ ID NO: 94154 - DNA, 601 bp, Human; identical to SEQ ID NO: 27839

SEQ ID NO: 94155 - DNA, 601 bp, Human; identical to SEQ ID NO: 27838

SEQ ID NO: 94156 - DNA, 601 bp, Human; identical to SEQ ID NO: 27837

SEQ ID NO: 94157 - DNA, 601 bp, Human; identical to SEQ ID NO: 27836

SEQ ID NO: 94158 - DNA, 601 bp, Human; identical to SEQ ID NO: 27835

SEQ ID NO: 94159 - DNA, 601 bp, Human; identical to SEQ ID NO: 27834

SEQ ID NO: 94160 - DNA, 601 bp, Human; identical to SEQ ID NO: 27833

SEQ ID NO: 94161 - DNA, 601 bp, Human; identical to SEQ ID NO: 27832

SEQ ID NO: 94162 - DNA, 601 bp, Human; identical to SEQ ID NO: 27831

SEQ ID NO: 94163 - DNA, 601 bp, Human
caactgcgttccccaggctgatctcaaacatctaggctcgagcaatccccctgcggcagcctcccaaaccactgggactacaggtgtgagccactgtgcgcagccagaaatgcacacgtttaccaaaccctcccggtgattctaggagccgtattcgggaccgccagcccgcattcccgtggactctctaggagccgtattcgggaccgccagcccgcattcccgtggactgcggcatgagcaccaccccactgacgtccagcgtgagtcacccgagatcacggcctgatgcagaaccacmctcagacacccgccctgtggagcacaacacaaggagcagcggggagccctgaaggggcccaggcatggcaggcaacccagcacgtgaggaaacctgccctctaccaggcccacagccaaggccaacgcaggagactaggggtcgacccccacagcgaggacggctccatccaccttcctggccatcagcctccggctgctcagagaggacgctcgcaccagcccctctccaactcacagggccctccacaagtacacgatcacgtcggatcttcacacgcagttggggagaagagctccg

SEQ ID NO: 94164 - DNA, 601 bp, Human
cccatggtttcactgacccaccccagccagcctgcccagcctcctctcctaagacataagaagccctacatggggaagagggtgaccaggccactctctcctggggctcagccagggtttatccaagcccggggcgaggctgaagagccctctgaggactgcaggacgtcagcaccctgtccttagggaagggcccacacaaaggacgtctgacctcaacgccaggagctcacagcccagagcccacaggcctgagggccccaggacactggtcagaaacaaggcaggcatgggacagccmgaagcgcccccctgaaggcagtcaggaacagtggccacaagcccctcacatccccatcgaccaaaaccccagtgtcagcaagcaagtcccatggtgggagagcagcggtccactaggccagagagacccaagggaagctgctgtgggaaggatcaccaaggcgggggcaccacctagtggcagcagctcctccacacccacggggcctcgggcctcggcaagccccaaatcccagcaaagcctgggcccgaaggcaagcagacgccagcccacccggcacaggcccagggcactcccagc

SEQ ID NO: 94165 - DNA, 601 bp, Human
actggtttaccaccctcggtgaaaagattctttctcccactgaattatctggacactttgacaacaatcaacactgtattcttcaatcatttctgaacattctactctgttctcctgatttacatgtctatacttaataccacagtgtctcaatttatgcaatttacaacgtgtcttgaaattggccagtgtaagctgtataacttgttcttttttgaaactgttatggctataacaatttataggtactttacattcccatagaaattttagaaattgtcagccgggcacagtggctcaygcctgtaatcccagcactttgggaggccaaggcgggtggatcacttgaggtcaggagttcaagaccagcctgaccaacatggcgaaaccctgtctctacaaaaatacaaaaattagccaagcatggtggtccatgcctgtagtcccagctactggggaggctgaggcagaattgcttgaacccaggaggcaaaggttgcagtaagccaagatcgcaccattgcactccagcctgggcgacagagtaagattccgtctcaaaaaaaaaaaaaaaaaagaaattttagagatcagttcatca

SEQ ID NO: 94166 - DNA, 601 bp, Human
atggtgaaacctgtctctattaaaatacaaaaattagccgggtgtggtggtgcacgcctggaaccccagctactcaggaggctgaggctggaggattgcttgaacctgggaggcggaggttgcagtgagccaagatcatgccactatactccagcctgggcgacagagcaagattccatctccaaaaaaataaataaataataaagtatctgttaaaagtcttttgaccattttttaaactatggtaatcttactaatttgtaagagttccttctctatcctggagcacatctttggtcasatacatgttaatatctcgcaaatattttcctagtctatggtctgccttttcactgtatcttttgagagcagaagttttcaattttgatgaagtctaatttatcaattttttcatttatggttcatgttcgttgtattgtaagacctctttgccaaaccctagcttccagattttgtgacttttacacataggtctatgcgtcatttgagttaaatcttgtgtccagcatgagacaggtgttaaggctcatcctcaccacgaagagcctactggtttaccaccctcggtgaaaagattctt

SEQ ID NO: 94167 - DNA, 601 bp, Human
ttttcatcaaatgtgaaactccttgaccctctgcagcctgcactgaccccacatgctgccactcctcacagcactcctgtgacgtaacaaagacccaggaggtgcacgcagccgtggccgtaggccttccataaactcaggggatgggtccctccccaaatgaaggctggcttaaacagcacccccaggccactctccaattcagtccaagtcgccactaaggaattttccttcccctcacagctaatccgaagagctgaccgtctgctgttgacaggccagcttgagtgaggtatgatcygcgcacgtgaacagtttgacaagagcagtgtcatgagctttgctgcgtgtacacctgtgcggcgatcacatccattacgccaaagggtatttctagcaccccataagaccccaatcatatcccagcacgagactccagggatcactgacctgctttctatcactgttgctcagttttacctttttaaaaagttcaaatcaatgggatggtatagtaagtataaactcagtaagtctggcttccttcactcagcaagagagaccctttcatgtttccaagcaccgccgctgccgcgcatta

SEQ ID NO: 94168 - DNA, 601 bp, Human
gagaggggcacaggctgcaccccagccagggccgtcgccaaagcgaggcagctgtcaggaagctctctgctggccttgctttgggggtctcgctgggatagtgcaggaccccaggggggccctgtcacagcagccaagagcactggaggctccgcccatacatcaccaccaactgcaaggcacagagacgccctcgctcggtcctccactcttcaaaggctcagcacacgcctactgcacgtctggctcaggggcgctaaagggagaccccagctcttaactcacaatgctcaggattgasaggatgcgtttacggaaaaccaacacaaccccaaggcagaaagcggccaggactcagccacaggaggagctggggttgagaagaggagagatggcaggcaccgtgctcggacggagctgggaacctggctcacgccccaccctggcctgcacctctggagggcagcacactcgccactctccagctccagggtcctgggacctgcacaccacagacgcacaggcctgagggatccttctccctccagatcatgggctccacaagagcagctcatggtgaacgaatgaacaaacgaaaagg

SEQ ID NO: 94169 - DNA, 601 bp, Human
accaccctacgctaacatagcacgcggggcgcccacccaaccaccccacacccgccccgggccgcctgccaccctggaatgcagggtggacacttgcgttcacctggaacctcttctccacctcatccacatcctcctcaggactccccaccagacgaaagtcccatggcaacagccggatcttgttctccactgggcccccgacaccaggcaccaggcctgcacacagggggtctaaggaaggttcgctggcctggctcggagccctgctcctcagcacctggctgtgtaacagagcccyagggtccacacacagctgccagtgaaggtctctgcattctgcccaggtaagacacgcacacggtacttccgatcgtgggagatcagagctctctgcacctggataacagtggaaacatcgtcaaacaaaagccaggaaagtcagatcacttagtccacatgagccgccccacaggctggtgctgactggcttgtgatgaagtgatcatctcacagcacttctgtgaacgcaagcccgctctccccaccgcggctctgcacaaacggtgctaccacgaggaccgcctgcttcatgcacacg

SEQ ID NO: 94170 - DNA, 601 bp, Human
tccatgaagccaagggtctcagagctcttcccacgcctgccctccatcctccacccctcccggggcgcacccacgacaggtggagggtgaagagcgggaccaaggcctgccggccaggtgtgcaccaccctacgctaacatagcacgcggggcgcccacccaaccaccccacacccgccccgggccgcctgccaccctggaatgcagggtggacacttgcgttcacctggaacctcttctccacctcatccacatcctcctcaggactccccaccagacgaaagtcccatggcaacagcckgatcttgttctccactgggcccccgacaccaggcaccaggcctgcacacagggggtctaaggaaggttcgctggcctggctcggagccctgctcctcagcacctggctgtgtaacagagccccagggtccacacacagctgccagtgaaggtctctgcattctgcccaggtaagacacgcacacggtacttccgatcgtgggagatcagagctctctgcacctggataacagtggaaacatcgtcaaacaaaagccaggaaagtcagatcacttagtccacatgagccgccccacaggct

SEQ ID NO: 94171 - DNA, 601 bp, Human
gactaaggaatggaatacctaactgctctccaagaaaggagtttgttacttctgggtcacagattccacacgttcacctttctggccttcatacctcacgtgtcacagccaagactcctaggaggtcccctgcctgccgtcatgaagggcgcctgcagcctggtgcgccacccccacatgccctgcacgcggcaaaccgctcaataaggactgcagtgaacactttctttaaatcattgatggttttcttaatcatcttagaatcactctgctacacggatgtccctggagtttcgattcmtaaatcagcagtcttccactccgcatccgcgcccccgcagtgccccgcctggcacgggcaggggtgcctcccagacaacggaaaccagacgagggccaggccaggcagacacaccgggcagccactgaactgctgggccaagacctccagcctcccaaacccagattcctggtcctaggagacggctttctcagctgcagcccagactccgcggtaaggccacaacccaacccaccacccacctaggtgcttcccaacgccatgctggccagcagggcccacactccgcaccatccaggt

SEQ ID NO: 94172 - DNA, 601 bp, Human
gtggatttgtgccaggaagagccagcaggagctgaccagccccatggaagcctccaggccggctgcctgctctcatctcccaagagcccgcctttgcttctgccagccactcacgctctccacaggctgcagccaggtacacaccccccttcaagcaacaaaaccactgcctgagcacctggcctgctctaagcccagggctgagacaagggggagccagccacacacaacaccaggagcgctggcatcgccggagcaaggagcccgtgatggccgtccacccgggacagcaatcgcgctmtgcggcacgaggctttcaacagaggcgagtgcttcctgggggtcaagagcatggaacacacacttcaggccccctctccaggctgcaggccaacaggcgtccatgagacagacactccctgatgtgtcccactcagttctcctgccgctgagtgactctcccagggaggcccagagccacatgctcttggtagcccctactcctccaggtgttaaagcaggtgcccatgtacagtccacaagcacaggccatcaggctgggcaaggatgggcaaggaaccaggcccctgccctttgaggc

SEQ ID NO: 94173 - DNA, 601 bp, Human
cccctcactgggcaggccagccctagggctcctctaggagccatgcaggcctgacatcggctgctgtctgacacctccttctggctacatcactgacacttcaaacacacattcccaaaacagagttcacaacccctccctgcctgagagccaaaactggtcctagcccccgggtcccagcccccaggtcccagcccccaggccccagcctgtgactgaccccatctccctgcacccacagggcccatcagcccctcctctaagagcaggcctgggaacaggcccaggacggggcaaccayacccagttctgccccacaagcgcccccgctcatcccaaggtccaccatgagtttgggtttttttttttttttttggaggaagggttatctttatatttttatttttaaaaatagagatagggtctcacagtgttgcccaggctggtcttgaactcccaggctcaagcgatcctcccacttcaggctcccaaagtgctgggattacaggtgtgagccaaggcacccagcccagcgtggatttgtgccaggaagagccagcaggagctgaccagccccatggaagcctccaggccggctgcc

SEQ ID NO: 94174 - DNA, 601 bp, Human
tgttttcattgtttaaagctgtctgtgtgtgtgcactacgtgggcagactgtgctgtgctcgtcacagcgtcgccagagccagcccaaagcctggcaaacggcaggtctccaaataaatgttcagatgaacaaacaaacgagcgtctccaaaatcacagtgctacccacagacactgtggtcacaaaggaacaggcattcacctgaagaggaaacagaaaaacagggagagtctggccttcaacacgaaccctcttcagaagtcagaaggcctcgggctccctgctcacaggaacagtgcrgctcaattctaactctcactacaacgcggctgactccacggctcctactccatgaggctctcaactgacaacaggaaacaccgcccaccctccccacacttcggggctgctgaaacctgcagcgggtcagacagccccagggacttccaccagcagggtcctgccaaggcgccaggtcctcgccctgcgaattcagtgaggaaagaggccccttcacaattggcggatgtgctcctccctgatgaagaccttctgcggctcctgtgacctgcaggacgcggtccaaaccaccctcaggac

SEQ ID NO: 94175 - DNA, 601 bp, Human
tttgggctggacgcagtggctcatactgataatcccagcactttgggaggccgaggaaggcagatcacctgaagttaggagttcaagaccatcctggccaacatgccaaaaccccatctctactaaaaaaacaaatacaataatacaaaaattagccaggcgtgctgatgcgcacctgtagtcccagctactcgggaggctgaggcaggagaatcgcttgaacctgggaggctgaggttgcagcaagcagagatcatgccactgcactccagcctgggcaacacagcaagactctgtctcaaaaaaaaaaaaaaaagtatttgaatctaaagctcaagcttagaaaacttacagataacttagcagtgacccctactgggttatctatgccacttcagctaagctctcgtaaacaataaaaacacctaaactaaaagaaatgcttgtaatagctaccaatgacactcttttcaactcagtctactaaaaatacctacttttcttatccgagtcaataaaaagtgagctttgatttaaaggaacctagttgatacctgcattttgtaattgcaatcctaataaaaggcaaaatactcctgag

SEQ ID NO: 94176 - DNA, 601 bp, Human
tttgttgaatggaacagacgtgatcacaatatgtgctcctgggaaccctcggctaccagaaaaaaaggcgagacagaaatgagcacttctcaaccctgggagcaaatttataagggttttatcccttcaaaattattaccaaggggtaacacggccgcgggtaactccagattcctccggaaaacctcactgtgcactgccaaggctccagccagagcaggtgctgagccgcgatccgggagacgccagtctcaccctaggctctcttccacaaccaccctcaggcaaggccacaccgtcrcccaactgtcccaaatctggaaaggaagaaaccaccatgatgctgtgtgggcagcaaaaggctctgcatgggaaagaaaagctgcagggaaaaggcagcaaggctctgcatggattttttttttttttttttttttttttgagtcgggttcttgctctatcacctaggctggagtgcagtggcatgatctcggctcactgcagcctcggcctcctgggctcaggtgatcctcctgacttggcctctcgagttgttgggaccatgggtgcgtgccaccatgcctggctaatttttttgtgt

SEQ ID NO: 94177 - DNA, 601 bp, Human
gagcctcttcccaggggcagggaggctggaaaccctaacccaaccctcagtcagaacagggactcacacgccccacagggagcccaaactgaggctgacaggtgcaggctcacaaaccatcggcccaagccacgccccagcatactcacttgcccaagcaaccggggtgagacaagggccacccagctccgacagccaccacgtcctggagagaaagcgtccccgcccagaggacggtccttgtcctagaacagcaaggccctccaactcttggtcctcaaagcccttccccgcctccgcmcccagcaccacattgctgtgctgagtttcagcacagggaccgtgcgtcctgctctctgctgcatctcccagccagtatacaccacggtacgtcataagccctcaacaaatatttgttgaatggaacagacgtgatcacaatatgtgctcctgggaaccctcggctaccagaaaaaaaggcgagacagaaatgagcacttctcaaccctgggagcaaatttataagggttttatcccttcaaaattattaccaaggggtaacacggccgcgggtaactccagattcctccggaaaacctca

SEQ ID NO: 94178 - DNA, 601 bp, Human
tggaagtgctccaaacagtggttcatgtttttgatggagacaaaagcaactcctcacagtacaaatagacccggagctcagcactcgtggaggagggtggagcctcttcccaggggcagggaggctggaaaccctaacccaaccctcagtcagaacagggactcacacgccccacagggagcccaaactgaggctgacaggtgcaggctcacaaaccatcggcccaagccacgccccagcatactcacttgcccaagcaaccggggtgagacaagggccacccagctccgacagccaccaygtcctggagagaaagcgtccccgcccagaggacggtccttgtcctagaacagcaaggccctccaactcttggtcctcaaagcccttccccgcctccgcccccagcaccacattgctgtgctgagtttcagcacagggaccgtgcgtcctgctctctgctgcatctcccagccagtatacaccacggtacgtcataagccctcaacaaatatttgttgaatggaacagacgtgatcacaatatgtgctcctgggaaccctcggctaccagaaaaaaaggcgagacagaaatgagcacttct

SEQ ID NO: 94179 - DNA, 601 bp, Human
ttaaataaaattaatttggcaagggttgtcagtaaatggaagtgctccaaacagtggttcatgtttttgatggagacaaaagcaactcctcacagtacaaatagacccggagctcagcactcgtggaggagggtggagcctcttcccaggggcagggaggctggaaaccctaacccaaccctcagtcagaacagggactcacacgccccacagggagcccaaactgaggctgacaggtgcaggctcacaaaccatcggcccaagccacgccccagcatactcacttgcccaagcaaccggsgtgagacaagggccacccagctccgacagccaccacgtcctggagagaaagcgtccccgcccagaggacggtccttgtcctagaacagcaaggccctccaactcttggtcctcaaagcccttccccgcctccgcccccagcaccacattgctgtgctgagtttcagcacagggaccgtgcgtcctgctctctgctgcatctcccagccagtatacaccacggtacgtcataagccctcaacaaatatttgttgaatggaacagacgtgatcacaatatgtgctcctgggaaccctcggct

SEQ ID NO: 94180 - DNA, 601 bp, Human
gtaattaggtttaaaattccatttcatgggataatcagacttcaaaaaactcaattttagttttaatcagattttaacaaggatattaagtccatttcgtttagaaaaggaaaaaactgtgaacttaacacaaaatgtattcaagcttagccctgggagataattaaataaaattaatttggcaagggttgtcagtaaatggaagtgctccaaacagtggttcatgtttttgatggagacaaaagcaactcctcacagtacaaatagacccggagctcagcactcgtggaggagggtggarcctcttcccaggggcagggaggctggaaaccctaacccaaccctcagtcagaacagggactcacacgccccacagggagcccaaactgaggctgacaggtgcaggctcacaaaccatcggcccaagccacgccccagcatactcacttgcccaagcaaccggggtgagacaagggccacccagctccgacagccaccacgtcctggagagaaagcgtccccgcccagaggacggtccttgtcctagaacagcaaggccctccaactcttggtcctcaaagcccttccccgcctccgcccc

SEQ ID NO: 94181 - DNA, 601 bp, Human
cacaaatgactgcatgacgtatgattccattcccacataattccagacgaaacaaaaccacggtgacagccagactgagggcaagtacgctgggagcctgttacctccacctgccactaggaagtcgcaacaggcagcatgagtccagacacaatagcaaacagccctcctggaaaagtgggatttctcaaagaacaggaacatggccctttggaaatttcttgtttatttcacctaatggtcatttagagtttgtttttacttttttaataatacaaatgtatctaaaactagggtggaggctaacacctgtaatcccaccattttgggaggctgaggcaggcggatcacttgagctcaggagttcgagaccagtctggccaacatggtgaaaccccgtctctactaaaaatacaaaaattagctgggcgtggtggcaagtgtctgtagtcccacctgctccagaggctcaggtgggagaatggcttgagcccaggaggcagagactgcagtaagccatgattgtgccactacactccagcctgggccacaaagcaagactctgtctcaaaaaaattaaaaaaaattaagccgggtgcgg

SEQ ID NO: 94182 - DNA, 601 bp, Human
tggtatatccgttcgatataacaaggacaaccgatacaagcaacaaatgtgaatgaatgcttttcagaaaacattctgccagtgaaatcaccagacacaaatgactgcatgacgtatgattccattcccacataattccagacgaaacaaaaccacggtgacagccagactgagggcaagtacgctgggagcctgttacctccacctgccactaggaagtcgcaacaggcagcatgagtccagacacaatagcaaacagccctcctggaaaagtgggatttctcaaagaacaggaacatgrccctttggaaatttcttgtttatttcacctaatggtcatttagagtttgtttttacttttttaataatacaaatgtatctaaaactagggtggaggctaacacctgtaatcccaccattttgggaggctgaggcaggcggatcacttgagctcaggagttcgagaccagtctggccaacatggtgaaaccccgtctctactaaaaatacaaaaattagctgggcgtggtggcaagtgtctgtagtcccacctgctccagaggctcaggtgggagaatggcttgagcccaggaggcagaga

SEQ ID NO: 94183 - DNA, 601 bp, Human
catcattagtcaccagggcaacaggaatgaaggccacaaggaaataccgcacacacccaccaggatggctaaagtgaaggtggccaatgaatgcattcgggatgcggggccagcggaattcaatgaaagagctcgggatgtggggccagcggaattctcacacacgggtggccaggggacagaattaggcagccactttggctcatcagctttttctaaaattaaaacataccatatcacccagaggccccactcctaggtattatcccaagagacaggaaaacatacataaagagacttsaatacaaatgttcacagaatctttatctgcaagagcaaaaaaccggattaaaaattatggtatatccgttcgatataacaaggacaaccgatacaagcaacaaatgtgaatgaatgcttttcagaaaacattctgccagtgaaatcaccagacacaaatgactgcatgacgtatgattccattcccacataattccagacgaaacaaaaccacggtgacagccagactgagggcaagtacgctgggagcctgttacctccacctgccactaggaagtcgcaacaggcagcatgagtccag

SEQ ID NO: 94184 - DNA, 601 bp, Human
ttcaaatgggaaacagacatacgtattgtggggcaggaaagcgaccctcaactgtgaccacactacacacaaaaattaactcaaaattaacagtaaagttaaagctagaaagtttctaaaagcttgggttaggcagatacaaaaaacacaaaccataaagaaaatgaattgataaatcagacttagcaaaattaaaagtttttacccttcaaaagacactaagaaaatgaaaaggaagccacgtaccgggagaaaatattcaccatacatctgacaaaagactctgtcatgaatatatatrgtactctgccaactcagaagatgacagtccaattaaaaaatggggaaaagactttgaaaagacacttcacaaaagaagatatatggccgtcaagttaagtacatgagtagatgttcaacatcattagtcaccagggcaacaggaatgaaggccacaaggaaataccgcacacacccaccaggatggctaaagtgaaggtggccaatgaatgcattcgggatgcggggccagcggaattcaatgaaagagctcgggatgtggggccagcggaattctcacacacgggtggccaggggacag

SEQ ID NO: 94185 - DNA, 601 bp, Human
aacagaatattactcagccttagaaagaaaggacattttggcacatgccacaacatggatgatccctgaggacattatgttaagtgaaataagccagtcacataaggacaaatatttcatgattctccttctatgaggtccctactgtagtaaaaaatcacagaggcaggaagcagaatggtgggtcctagagccaacgggggagcacagggagcgagcgtttaatgggtacagagtttggctttgggaagataaagttttggaggtggatggtggtgatggttgcacagcaatatgaatrttcttaaagctactgaactgtacacttaaaaacagttaacagtcaattttattgtatatgtatttgacccaatacaacaaatcggggaaaagaaaagcatcctcctcaacctgatgaacagtatctcgcaagaccctaaaactaacctcatgcttcaggaaaatctaaacgctttccctctaaggctgacaaggccaggacagccattctcaccatgcccaggtaaaactgcactggaggtcccagtgagtgcactaaggcaagaaaaaataaacgaaataaaaagtaaatggggggaaa

SEQ ID NO: 94186 - DNA, 601 bp, Human
gttatcatttgaaagaatacaaccacgagtatttgttgacaataataaaactcaagctgccaaacacatatctaaattcttaaaaatttgtatctaccaccacaagcttgatggattcctaacgtttaaagacttttcaataacttgtggtgattagcttgtaatttctttaataaggcataataaaagacctacataattcagtgcgtcgatattttcaaatgagcaatgtatgatgttacataaccatgcatggataaaggtccattcaaagtgcaagagaccaatgaattttagtacracagtttgaaaagattattccgtaccacaactaaccttccagaaaccactacgtgtggaacacttgctgttaagatgtcaacaccgcccaaagccatctagacgttcaatgcaatccctatcaagacctaactaaatattttgcagacataggaaaatctatcctaaaattcatatggaatctcaagggacccaaaggtccctcgccaaagcaatcttgaaaagttagaacaaagttgaaagagtcacactttaagtcaaaacttactacaaagccacagtaatcaaaacagtgtggtgc

SEQ ID NO: 94187 - DNA, 601 bp, Human
gccctttttatgtaaaatattttacttaaaaactaactgaccaacaatagttactcaggcttgagcatctggtagacattttctcaaaaacgaattaaataaacgttatcatttgaaagaatacaaccacgagtatttgttgacaataataaaactcaagctgccaaacacatatctaaattcttaaaaatttgtatctaccaccacaagcttgatggattcctaacgtttaaagacttttcaataacttgtggtgattagcttgtaatttctttaataaggcataataaaagacctacayaattcagtgcgtcgatattttcaaatgagcaatgtatgatgttacataaccatgcatggataaaggtccattcaaagtgcaagagaccaatgaattttagtacgacagtttgaaaagattattccgtaccacaactaaccttccagaaaccactacgtgtggaacacttgctgttaagatgtcaacaccgcccaaagccatctagacgttcaatgcaatccctatcaagacctaactaaatattttgcagacataggaaaatctatcctaaaattcatatggaatctcaagggacccaaa

SEQ ID NO: 94188 - DNA, 601 bp, Human
aaacaaggaataataataataagctattatttgccttttttcttctaactgtgctgacatttgaactgaagatacaaaagcactgatgggtataacacgttagcaaaacaaaccaggggcaccacgtggggtctcgctatgctgcccaggctggactgcaatggctactgacaggcacaatcacagctcccaacagccacaaactcctgggcccaagccatcctcccacctcaactttccgagcagctggaactacaggagtactgggcccagttaaaatattcacttcattaaatcttawccccttgataagatctcaacattctgtgtgaagaaatagaaagcacatgtaagacatttctggtgcatactaaagtgcgatggttggtcttccatgtttgagttgtgaactgaactagccctttttatgtaaaatattttacttaaaaactaactgaccaacaatagttactcaggcttgagcatctggtagacattttctcaaaaacgaattaaataaacgttatcatttgaaagaatacaaccacgagtatttgttgacaataataaaactcaagctgccaaacacatatctaaattc

SEQ ID NO: 94189 - DNA, 601 bp, Human
acacttaaaaaatatgtttaatgaaatggtattcactaaatctgtgtgttaatagcaaaaagaaaaaattggcaacaactgtagtgtatgctaataaggaaatagttaaaatatgtgcattctacgatggaataatggctactaaagagtaaacaccagacatttcaagtaactcaatccaagggaaaataatataacaatacaggccgtatgatgccatttgttatgtacgtaagacgtccatgcacataaaaattatgtaaggacttatagcaaactgctaatgttaacctgggatacrgcagaatttgaaaaagcagagaaatccaagaaagtttcactttaattctgtactgtttgagctttctttgtagtgaggatggatttacattatcctgtacaatatttttgaaaagcatgtcacagagctgtaggatcacatgtgagtccaacttgtgagcctcttctcgccttgagggactaagcgctaggacaacagttcactaagtgtggtctgcagacaccattctaggcagtcttgtaacatcaaaactattttctttttctttttttttttttttctctgagacggactctcgct

SEQ ID NO: 94190 - DNA, 601 bp, Human
aaaatcgaaataacaggcgagaatgcgtcctctacctccatttgtcatctaagccaccggactcacccccacccccagcctacctgttcaggaggcccttgggccagggtgggcagcattttcagagcccttgaccccagtcggtccattagggagggtgcctgagagcctgaaagctaccagggcagacagatgagcctgcaggcaggaagcactgtcatctgaaacatctgtcacagaaagcactgtgctaagaatacagcagctgactttaagtaaagggcaaaaatcggaaacactracaacatcaatgaatgttatcagaaaaatgggcaatcttaagtactgttaacagaagtataattttggaacgtaatttggcaaaaattattaaagtgttaaatattcatactctatgtcttagcattcccatcaataaaaagaatgtttcagatacacttaaaaaatatgtttaatgaaatggtattcactaaatctgtgtgttaatagcaaaaagaaaaaattggcaacaactgtagtgtatgctaataaggaaatagttaaaatatgtgcattctacgatggaataatggctactaaa

SEQ ID NO: 94191 - DNA, 601 bp, Human
agactcactcgaacccaggaggcggaggtttcagtgagccaagatcacaccatgccactccagcctgggaaacaagagtgaaactccatctcaaaaaataaataaataataaaaataaaatataatgtaccactcatctccccaaaacagggctgaacctcaaaagcactctgttgtccaaaagcagggccaggacaagggtgaagcaagagagatgccggcgtacaaactttcaggaggtgattgctcggagaatctcactcttggggtgtgcagtgtagatcccacactctctcgcctccccctagtcccagccctgggcaaaagatgacagcaatttaagaataaacacagtacaattccatttatttacaattcaagaacacacaaaactaatttatggtaatagaaatcagaacagtgcttgtctcccgggggtaggaattgattgaagggacgagaaggaacttccagaggtaatggaaactttctgcagcctgacggaggcagtgatgacacaggtggtacattttcaatactcactcaattatatacataagatctgtccatttcactgtatgtaattattatctcaaaaaaa

SEQ ID NO: 94192 - DNA, 601 bp, Human
gggaattgaacaatgagaacacatggacacaggaaggggaacatcacacaccggggactgtcgtggggtggggggagcggggagggacagcattaggagatatacctaatgctaaatgacgagttaatcggtgcagcacaccaacatggcacatgtatacatatgtaacaaacctgcacgttgtgcacatgtaccctaaaacttaaagtataataataataaaaaaataaaaataaaaataaaaataaaaaacaaagctattaagcaaaagaaagaactcagccgggcgcagtggctcacrcctgtaatcctggcactttgggaggccgaggcgggtggatcacgaggtcaggaaatcgagaccatcctggccaacacagtgaaaccccatctctactaaaaaaatacaaaaaattagccaggcgtggtggcgggcgcctgtagtcccagctactcgggaggctgaggcaggagaatggcatgaatccgggaggcggagcttgcagtgagtggagatcgcgccactgcactccagcctgggcaacagagcgagactctgtctcaaataaaaattttaaaataaaaaaaaaagaaagggctc

SEQ ID NO: 94193 - DNA, 601 bp, Human
tgctgtacttttcatctgtagaatttctatgtggtttctccttatagtttctttttattgatattctgcttctactgattgattgctttctccaccatgtatgaattatactttcttgcttcttgcatgtcttccgaattttgcggcaactctggaatcagattctctgcccttgccagggctggctgctggtgctgccagctgtagttgttttttacttgtttcatgacttttctgaactaattctgtaatgtttgtgtctctgttctatgcagccactgacgtttccacacgttagccrtgagaaatacaaattaaaaagcacataagatttaaaaaatgctaaatatcattaattatcagggaaatgcaaatcaaaaccacagtgagataccaccttaatcctgccagaatggccataatttaaaagtcaaaaaataacagatgttggcgtggatgtggtggaaaaaggaacacttttacattgctcgtgggaatggaaactagtacaatcactacagaaaacagtacaaagattccttcgagaactgaaagtagagctaccgtttgagacagcaatcctacagaggaaaagaagtca

SEQ ID NO: 94194 - DNA, 601 bp, Human
gctgtccatggggactgagattctaaggggccatgtccgtgcatgttgcgcacaggctcggaaaggcctgtgaaggccctgggttctccctcctgctcaccttgaagctctgagcaagcaggaaatgagggcaaaggcagagtggccaccacctggcccagcgtgcaccggagctcctcatcaaggactcaccagttctaggtatctcaggaaatctctggctaatattcattctgagactggcctttgcttaagaccgagcatctagcctaaagcatgccgaacttccagacaagcattrgaggcaaacaaaaaactgtccacagatcacagagacttgatggccatggttaatttacgactgagagttttcaaatgtgaaatgtctagtgaggttttgtaataaaaatagtgcaactgtcaaggaaactgggcttgtttctgtagcatctgaaacaaagcaaaatgccaatgagaaaattagacaaaatatctctggggataataattgttgtcagattgttcactgctaacgtataatattaaacattatcttatattaaatataatattaaatattgatcttgtatcctgcaactct

SEQ ID NO: 94195 - DNA, 601 bp, Human
gactcaccagaacgctgacacagaaaagctaagaaatgagctgtccatggggactgagattctaaggggccatgtccgtgcatgttgcgcacaggctcggaaaggcctgtgaaggccctgggttctccctcctgctcaccttgaagctctgagcaagcaggaaatgagggcaaaggcagagtggccaccacctggcccagcgtgcaccggagctcctcatcaaggactcaccagttctaggtatctcaggaaatctctggctaatattcattctgagactggcctttgcttaagaccgagyatctagcctaaagcatgccgaacttccagacaagcattagaggcaaacaaaaaactgtccacagatcacagagacttgatggccatggttaatttacgactgagagttttcaaatgtgaaatgtctagtgaggttttgtaataaaaatagtgcaactgtcaaggaaactgggcttgtttctgtagcatctgaaacaaagcaaaatgccaatgagaaaattagacaaaatatctctggggataataattgttgtcagattgttcactgctaacgtataatattaaacattatcttatatta

SEQ ID NO: 94196 - DNA, 601 bp, Human
ctcccagggcaaaaacttggttggggaatgagtctgtcaaccacttcaacatcacaaatgcctgagtgacagcagtggcaaacaaaagactcaccagaacgctgacacagaaaagctaagaaatgagctgtccatggggactgagattctaaggggccatgtccgtgcatgttgcgcacaggctcggaaaggcctgtgaaggccctgggttctccctcctgctcaccttgaagctctgagcaagcaggaaatgagggcaaaggcagagtggccaccacctggcccagcgtgcaccggagcycctcatcaaggactcaccagttctaggtatctcaggaaatctctggctaatattcattctgagactggcctttgcttaagaccgagcatctagcctaaagcatgccgaacttccagacaagcattagaggcaaacaaaaaactgtccacagatcacagagacttgatggccatggttaatttacgactgagagttttcaaatgtgaaatgtctagtgaggttttgtaataaaaatagtgcaactgtcaaggaaactgggcttgtttctgtagcatctgaaacaaagcaaaatgccaatga

SEQ ID NO: 94197 - DNA, 601 bp, Human
ctcccctaatctctcccagggcaaaaacttggttggggaatgagtctgtcaaccacttcaacatcacaaatgcctgagtgacagcagtggcaaacaaaagactcaccagaacgctgacacagaaaagctaagaaatgagctgtccatggggactgagattctaaggggccatgtccgtgcatgttgcgcacaggctcggaaaggcctgtgaaggccctgggttctccctcctgctcaccttgaagctctgagcaagcaggaaatgagggcaaaggcagagtggccaccacctggcccagcrtgcaccggagctcctcatcaaggactcaccagttctaggtatctcaggaaatctctggctaatattcattctgagactggcctttgcttaagaccgagcatctagcctaaagcatgccgaacttccagacaagcattagaggcaaacaaaaaactgtccacagatcacagagacttgatggccatggttaatttacgactgagagttttcaaatgtgaaatgtctagtgaggttttgtaataaaaatagtgcaactgtcaaggaaactgggcttgtttctgtagcatctgaaacaaagca

SEQ ID NO: 94198 - DNA, 601 bp, Human
tcttaggccgagcatggtggctcacgcctgtaatcccagcactttgggaggccaaggtgggtggatcacctgaggtcaggagtttgagaccagcctggccaacatggtgaaacctcatccctactaaaaatacaaaaaattagctgggcgtggtggcaggcacctgtaattccagctactcgggaggctgaggcaagagaatcgcttgaacctgggaggcggaggtcacagtgagccaagatcgtgccactgcactccagactgggcaacaagagcaaaactccgtctcaaaaaaaaaaagaaagaaaagaaagaaagtcctgtcttgatttcacctcccctaatctctcccagggcaaaaacttggttggggaatgagtctgtcaaccacttcaacatcacaaatgcctgagtgacagcagtggcaaacaaaagactcaccagaacgctgacacagaaaagctaagaaatgagctgtccatggggactgagattctaaggggccatgtccgtgcatgttgcgcacaggctcggaaaggcctgtgaaggccctgggttctccctcctgctcaccttgaagctctgagcaagcaggaaatga

SEQ ID NO: 94199 - DNA, 601 bp, Human
ccaattaaaagtcctgtcttaggccgagcatggtggctcacgcctgtaatcccagcactttgggaggccaaggtgggtggatcacctgaggtcaggagtttgagaccagcctggccaacatggtgaaacctcatccctactaaaaatacaaaaaattagctgggcgtggtggcaggcacctgtaattccagctactcgggaggctgaggcaagagaatcgcttgaacctgggaggcggaggtcacagtgagccaagatcgtgccactgcactccagactgggcaacaagagcaaaactccrtctcaaaaaaaaaaaaaaagaaaagaaagaaagtcctgtcttgatttcacctcccctaatctctcccagggcaaaaacttggttggggaatgagtctgtcaaccacttcaacatcacaaatgcctgagtgacagcagtggcaaacaaaagactcaccagaacgctgacacagaaaagctaagaaatgagctgtccatggggactgagattctaaggggccatgtccgtgcatgttgcgcacaggctcggaaaggcctgtgaaggccctgggttctccctcctgctcaccttgaagctctg

SEQ ID NO: 94200 - DNA, 601 bp, Human
ggcatctctcaaaataccattcccaaagaagagttattacttgacccatctgggtcacttactaccttaagatcccaattaaaagtcctgtcttaggccgagcatggtggctcacgcctgtaatcccagcactttgggaggccaaggtgggtggatcacctgaggtcaggagtttgagaccagcctggccaacatggtgaaacctcatccctactaaaaatacaaaaaattagctgggcgtggtggcaggcacctgtaattccagctactcgggaggctgaggcaagagaatcgcttgaamctgggaggcggaggtcacagtgagccaagatcgtgccactgcactccagactgggcaacaagagcaaaactccgtctcaaaaaaaaaaaaaaagaaaagaaagaaagtcctgtcttgatttcacctcccctaatctctcccagggcaaaaacttggttggggaatgagtctgtcaaccacttcaacatcacaaatgcctgagtgacagcagtggcaaacaaaagactcaccagaacgctgacacagaaaagctaagaaatgagctgtccatggggactgagattctaaggggccatgtcc

SEQ ID NO: 94201 - DNA, 601 bp, Human
ccttcaagtgctctccctgatatcaggcagtaacaacatagtgttacagccacaatttcaatgacctaaaatgattagccacattacttctttaatttgaatctggcactttctaggccactggttctcaagtggcctagtgctatgcattcatgtacagcagatgtattcatgaggttttatgaaattaaaaatggttcactctatctcagacttacccagtctcttcatttgatatgctttggtatattccgggaatattttgtctcaacattgtacatctcaagactgttttcttcayaaaaattatgttcacccatttcaatgaatcagatgttaacatccactgacttctttgaaacaggctgaattattatccttagtaatattttgtctaattttttaatcgcctttttatctttgttttggatgccacagaaacaacccaatttcctcattagttgcattactattaaaaccacatcagacatttcatgtttgaaaattatataaaacctcatcaggcatttcacacttaaaaattatcagtaagaaattaaccattgccatcaagtctttgtcatctgtgaaaagtttctgc

SEQ ID NO: 94202 - DNA, 601 bp, Human
tcagcaaagtcacaggacactgtcaaaacactaaaactatactgtctctatacacgagaatccagcaaagtcacaggacactgtcaacatagtaaactatactgtctctatacacgagaatccagcaaagtcacaggacactgtcaacatagtaaactatactgtgtctatacaataacagcaaatattggaaaggtgacagtcttcaaaattctactcaaattatcatcaataatacaaaattcttaggattaaatttatcaaaagataggcaagagctcctctaaaaaacatacgctartaataactgtttgcttggtgagctgtgtggccagggttgtgaaatcagaagagacacccagccttctccaggtgaactgtgaatcgctaatatgttattaaaagacgtatttcagaaatggtgcgcttcagtggaaatccctggagatctgtcaatgccttcacattccataatatgttttaatgtcaggagaaacacagaccaaaatgcttatgaaatagtctggtcaagtttttctgtatccgagtccttcaagtgctctccctgatatcaggcagtaacaacatagtgttacagcca

SEQ ID NO: 94203 - DNA, 601 bp, Human
tgctttactgtgcactaaattccaatgctgctgtctagaagcacaaagccatcctgattcccgcttcgtatgtaacctattctcatccttctgaaggtgtgtaggatgctgtctttaccctgatatttggggtccagcaacatgccatggcaatggtctttgatcacagacgttcatccactggactgggtacttggtggctccttcagtctagaagaggatgacgctcaagagagggtttttcaattgtttcattatgctgtcctccccgccgtttctttgcggtacttgttgaatgtgstccacagaacccgatcctcagagtgtattccgtttctcctgtttgatcttttttttctttccggatctccttaacttttccaacacttacactgattttttccccatatctgttcatgtagttttaacttcccagaactcttcttgttcactgaatgtgcttcttccagaggacatttttcttgtttcattatcttctcttgttaaaataaccacttttatctcactgaggatgcttatgagaggtttcttcctggaagttttatccttgcataatttccatttcctctacactgttttt

SEQ ID NO: 94204 - DNA, 601 bp, Human
gcaactctagaccacattgctttactgtgcactaaattccaatgctgctgtctagaagcacaaagccatcctgattcccgcttcgtatgtaacctattctcatccttctgaaggtgtgtaggatgctgtctttaccctgatatttggggtccagcaacatgccatggcaatggtctttgatcacagacgttcatccactggactgggtacttggtggctccttcagtctagaagaggatgacgctcaagagagggtttttcaattgtttcattatgctgtcctccccgccgtttctttgcsgtacttgttgaatgtggtccacagaacccgatcctcagagtgtattccgtttctcctgtttgatcttttttttctttccggatctccttaacttttccaacacttacactgattttttccccatatctgttcatgtagttttaacttcccagaactcttcttgttcactgaatgtgcttcttccagaggacatttttcttgtttcattatcttctcttgttaaaataaccacttttatctcactgaggatgcttatgagaggtttcttcctggaagttttatccttgcataatttccatt

SEQ ID NO: 94205 - DNA, 601 bp, Human
ggagactttctcggcaccacttcctgctctgaggactgagcaccatctgcccgggcacaggcatcatcttcagctgcttctcccccagtgacggatatcctgctccctgcgttccaatccttcctcagtcatcagtctctctcttccttagtacaatgcaccctccagtagctttctgaaaaaagatttgagggagataatttgtttttaagatagggtctcactctgccacccaggctggggtgcagtggtatggtcatagctcactgtggcctccacctcgtgggctcaagcgatcctyctgcctcagccctccgtaccctgagtacctaggactacaagcaggccagcacacccagctgctgctgctattgttgctgttgttggacagatggggtctcactctcctataccattacccataatggtctccaactcctgcgctcaagtgatcctcccacctcagccactgaaagtgctgggattacaggtatgaagcaccatgcctggccaggatgactgacttttttaaagactttgcaaatctccattgtgcctttagtctgctctctcatgcgactgttagtttcactgggtatag

SEQ ID NO: 94206 - DNA, 601 bp, Human
gtctggctgagccccgcgtctagctgagcacagctgggtgctcaaccactcacactgaggccacaaaggaaaccatggtgacttccaactccttcctactttgtgcttcccctcaagctaacaggagaaggggtttttcacttgcttagctgtctgtttatcgctcattccaccctggctctttaaactgttcaaatctcctctggagatgtccatgctcacccggcatcgggctgcctggcaatctcgtctttggggagactttctcggcaccacttcctgctctgaggactgagcaccrtctgcccgggcacaggcatcatcttcagctgcttctcccccagtgacggatatcctgctccctgcgttccaatccttcctcagtcatcagtctctctcttccttagtacaatgcaccctccagtagctttctgaaaaaagatttgagggagataatttgtttttaagatagggtctcactctgccacccaggctggggtgcagtggtatggtcatagctcactgtggcctccacctcgtgggctcaagcgatcctcctgcctcagccctccgtaccctgagtacctaggactacaagcag

SEQ ID NO: 94207 - DNA, 601 bp, Human
tatgttgaaacggacctcccttcctctagacgataggctttcattgccactttcctaattcttcagtttggggcattacctgtgacttctcaggatggaagaggaggccatggctctttgctcccaccacccctctgccgccccgcaggtaccaccatcaccacagctctagctgccccgcgtctggctgagccccgcgtctagctgagcacagctgggtgctcaaccactcacactgaggccacaaaggaaaccatggtgacttccaactccttcctactttgtgcttcccctcaagctracaggagaaggggtttttcacttgcttagctgtctgtttatcgctcattccaccctggctctttaaactgttcaaatctcctctggagatgtccatgctcacccggcatcgggctgcctggcaatctcgtctttggggagactttctcggcaccacttcctgctctgaggactgagcaccatctgcccgggcacaggcatcatcttcagctgcttctcccccagtgacggatatcctgctccctgcgttccaatccttcctcagtcatcagtctctctcttccttagtacaatgcaccct

SEQ ID NO: 94208 - DNA, 601 bp, Human
gcattcccagtcgaatctccttttcttccatgtatacgtattcctcgtgaagttacataaacaaagtgtacatagtcaaactacaaggcttgttatggcaagcagccatccccaactccactctgcatctcctggcccagttcccagcctcagaagcaaacactctaagttatttgagtcaattatgttgaaacggacctcccttcctctagacgataggctttcattgccactttcctaattcttcagtttggggcattacctgtgacttctcaggatggaagaggaggccatggctctktgctcccaccacccctctgccgccccgcaggtaccaccatcaccacagctctagctgccccgcgtctggctgagccccgcgtctagctgagcacagctgggtgctcaaccactcacactgaggccacaaaggaaaccatggtgacttccaactccttcctactttgtgcttcccctcaagctaacaggagaaggggtttttcacttgcttagctgtctgtttatcgctcattccaccctggctctttaaactgttcaaatctcctctggagatgtccatgctcacccggcatcgggctgc

SEQ ID NO: 94209 - DNA, 601 bp, Human
cccgtggggcgaagtcagaagtcagaggtgctcgaggctgccccatcagatggctcctgggagcgtgcacaccgcggtctgtgcgcacagaagaccccagacggtgccaggcaccctgcacacatgcctctggctgagactacagcacctgctagcatgcccctggcattcccagtcgaatctccttttcttccatgtatacgtattcctcgtgaagttacataaacaaagtgtacatagtcaaactacaaggcttgttatggcaagcagccatccccaactccactctgcatctcctggmccagttcccagcctcagaagcaaacactctaagttatttgagtcaattatgttgaaacggacctcccttcctctagacgataggctttcattgccactttcctaattcttcagtttggggcattacctgtgacttctcaggatggaagaggaggccatggctctttgctcccaccacccctctgccgccccgcaggtaccaccatcaccacagctctagctgccccgcgtctggctgagccccgcgtctagctgagcacagctgggtgctcaaccactcacactgaggccacaaaggaaa

SEQ ID NO: 94210 - DNA, 601 bp, Human
aaggacattcgggacctatgacgcaaacgcaggcggctacacattcgcctgcaggactgcaccttttaaagtccgcatgtagacagtgaaaatctacaaaggtaaaccggaatctcctaagagcgggtagggatgcgactggtgggattacgggggattggcagtcttctttttatgtatctgtatttccctactttgtaaagaacattacttgtgcaataaaattaagaaaaaaagttctatagccaccttgctcaacttcgtcatgtcaaggaaaaaaagtatttaggaacataaattrttctttacttggaaaaaaaaaatctcttgctccaatccaaaaaggcataggaaaaaaggcataaagagctgtgcacattagcaaaggggccctcttgcactgagcggtggccagtgtgtctacactgcaggtgccaggctccgcgctgcgtgcaattaacaggtcaggtgcatggagtttaaaggagagcagaacaagcagcgggtcaaggtgccaggactgagatcacaaagacccacagggggcacatggagcagaggctggaccacagtctgggtggaggggtcggccaggactgag

SEQ ID NO: 94211 - DNA, 601 bp, Human
tgggctttcctgaacttcagttatctgtccttaaaagggaggaagggaccaggagacctcatcctgatctgtgattctccttcagcaaacaaaaatcgcctaagaatctcttccttctgatgatgtggctggtgtgggtgaaccagccgcgagaaggcacaggacgatactcccgcgtggagggcgccacgaggtcaaggtcctgaggccggaacaccaaggagctctgggagggtggaggaagaacacaagcctggagcagggggcagacacacggggcgtggggcccagaggccaccgrgaggactcaggttttattccgagtgtgctaaggagccagggattgtggctgaagcgggaggaacacgctaaggagccagggatggcggctgaagcgggaggaacacgcgctcggacttgctgatgggctcttacgtgggcttttccccagctgaagaatgagttactaaatgtgttttaaaatgcaaaaatgtgtacccggtgcttgtcctggcgctgttcagaacaggaagaaccggaaacaacctgaatattcacaggaggcaaacgatccgtgacaggacaagcgtgggatggcctc

SEQ ID NO: 94212 - DNA, 601 bp, Human
ggagcttgcagtgagccgagatcacgccactgcactccagcctgggcaacagagcgagactccgtctcaaaaaataataataataataataataattaaaattagccgtgcatggtggtgggcacctgtaatccagctactcaggaggctgaggtgggaggaccacttgagcccgggagttcgaggcagtagtgagctatgatcacatcactgcactccaacctgggcaacctcatctcttaaaaaaattaaaaaaaaaaacacaatattttagaccaggcatgatggtgtatgcctgtartcccagcactttgggaggccaaggcaggaggatcgtgtaagccaggagtttgataccagccagggcaacatggcaagactctgcctcttaaaacaaaaattttttaagaagcaaaataaccattctgtaataaatttcacactccccaccgcacctatcttacctgcaaagatttattttggcaaagaggcagcagattgcagagtaaagaacagtaaattggacgggcatggtggctcacgcctgtaatcccagcactttgggaggccgaggcgggtggatcacttgaggtcaggagtt

SEQ ID NO: 94213 - DNA, 601 bp, Human
gtgaacccgggaggcggagcttgcagtgagccgagatcacgccactgcactccagcctgggcaacagagcgagactccgtctcaaaaaataataataataataataataattaaaattagccgtgcatggtggtgggcacctgtaatccagctactcaggaggctgaggtgggaggaccacttgagcccgggagttcgaggcagtagtgagctatgatcacatcactgcactccaacctgggcaacctcatctcttaaaaaaattaaaaaaaaaaacacaatattttagaccaggcatgayggtgtatgcctgtaatcccagcactttgggaggccaaggcaggaggatcgtgtaagccaggagtttgataccagccagggcaacatggcaagactctgcctcttaaaacaaaaattttttaagaagcaaaataaccattctgtaataaatttcacactccccaccgcacctatcttacctgcaaagatttattttggcaaagaggcagcagattgcagagtaaagaacagtaaattggacgggcatggtggctcacgcctgtaatcccagcactttgggaggccgaggcgggtggatcac

SEQ ID NO: 94214 - DNA, 601 bp, Human
gggagaatgacctgggcggaaccacgcctggcagggagctgcagggcctccatcatcatgccaggcgaacccagtgacaagggcctcaaacagaagaggcccagggaagggcagcccatgggcctgagaagcaccactacacacctgggcggcgcactccgctcacaaagcactcttccaggaagggccccgggctgctggagactgaaccggaatctgcctaactggtggaatccccttttacaaagaagtgcctgtagctcacggggctagaacccaggaaggccccaggtgagctcgraaccctaaagcaaccccgctgtggacagtggcatcgcagataggagagtgccggtgaaacagtaagaccagggcagcatgcttcactgggcaacggaggtgctgctgcaagtgggcgcagtagcaggcaggtcagggaaaaccaagggactatgacttcagagataacaggtgacattcctgactgttctacctttagtcatgattagcaggccgggcgcggcagctcatgcctgtaatcccagcactttgggaggctgaggcgggcggatcacgagctcaggagatagagaccatcctg

SEQ ID NO: 94215 - DNA, 601 bp, Human
tggagagcttgggatgcaaccacacacaagcaggcccgcttccgggaggcgtggcccggccggcctgaggctgtgacagcgtgtgtccactgtccacagcagctgggccgggagaatgacctgggcggaaccacgcctggcagggagctgcagggcctccatcatcatgccaggcgaacccagtgacaagggcctcaaacagaagaggcccagggaagggcagcccatgggcctgagaagcaccactacacacctgggcggcgcactccgctcacaaagcactcttccaggaagggccccrggctgctggagactgaaccggaatctgcctaactggtggaatccccttttacaaagaagtgcctgtagctcacggggctagaacccaggaaggccccaggtgagctcgaaaccctaaagcaaccccgctgtggacagtggcatcgcagataggagagtgccggtgaaacagtaagaccagggcagcatgcttcactgggcaacggaggtgctgctgcaagtgggcgcagtagcaggcaggtcagggaaaaccaagggactatgacttcagagataacaggtgacattcctgactgttcta

SEQ ID NO: 94216 - DNA, 601 bp, Human
tcaaagcagcctgggttccaattaagcccgtgtgaccaccccagggatgccagaacattcctgattaacaagaggcgctgtttgaactgttcaagctaaaaaaaagccctcagaacctttcaaacaaatgccataattttctctccctgtttcctcactctttggaaaagctgatcttttgaatgctttaaacgttcaaaaagaaagctagataatggccccaaacacaacttcggcaagaagctcagaacaggggcagcaagtggagagcttgggatgcaaccacacacaagcaggcccrcttccgggaggcgtggcccggccggcctgaggctgtgacagcgtgtgtccactgtccacagcagctgggccgggagaatgacctgggcggaaccacgcctggcagggagctgcagggcctccatcatcatgccaggcgaacccagtgacaagggcctcaaacagaagaggcccagggaagggcagcccatgggcctgagaagcaccactacacacctgggcggcgcactccgctcacaaagcactcttccaggaagggccccgggctgctggagactgaaccggaatctgcctaactggt

SEQ ID NO: 94217 - DNA, 601 bp, Human
tgtaggtcacatcaaatggagacagcagatatgttaagtgacagaatcagagtctaaaaccacactaagaagcaggaaaaatgggggggggggggttgcgggtggtagaggaaaaataaattttttgacagttgcaccaaaaaaaaatcaattgtagaaacatatggtggtagggcacacctgctccatcagcataatctgtgaagatgcctgcagaatctgcatccagtgaacaaatttaactgagcacctactgtgtgcccagcaaggacactacatggacaaacagacagagtccttkgcagctagagctgagtggctcgctgaggaggccgaccatgacaagagtgggcaggtgacatccccaaggcccagaggaggtgacagtggcttgatccagtggccggatctggagaagagtggaaagcctgaggctgagggaagggggcatgttgacccgggagggccaggaaagggctctagctagggaaaggtgacacctgagcacagattcaacgaaacaaaaggtgggcaatacaaatacggctgggcgcagtggctcacgcctgtcatcccagctattctggaggttgaggcagga

SEQ ID NO: 94218 - DNA, 601 bp, Human
gcacagcagaaagcccgcactctggaggcagccaggtgaagggcccagctgagcctcagttttctggtctatgaaacagacaattcgaccctcctgcaggagctctgcgctgagggcacccggcagtcagtggaaaaccctggacccctgtgacggttgctggtgcccacgcccatcgcccgagcaggggcagacggcatgcctatcaggttgtaggtcacatcaaatggagacagcagatatgttaagtgacagaatcagagtctaaaaccacactaagaagcaggaaaaatgggggggkgggggttgcgggtggtagaggaaaaataaattttttgacagttgcaccaaaaaaaaatcaattgtagaaacatatggtggtagggcacacctgctccatcagcataatctgtgaagatgcctgcagaatctgcatccagtgaacaaatttaactgagcacctactgtgtgcccagcaaggacactacatggacaaacagacagagtccttggcagctagagctgagtggctcgctgaggaggccgaccatgacaagagtgggcaggtgacatccccaaggcccagaggaggtgacagtgg

SEQ ID NO: 94219 - DNA, 601 bp, Human
aaacgtgcatgtaaatagtcttgttttcaaaaagcaggttctgcaaaccatcccaagcataaagaggcagcagagttaacaccttagtgtctgcagtcagtcaagcactcaattctaagtccattcattgcgaatctgtgactctgagctctccaaacctcaaccccccacctcaggaaaatgggaacagttacagtccagcatggactcactgagaagcggatgcatgcagacacctatgtcctcttctcaataggttacttgtataacgaaccgctgtataaacagagactacaagatyagaaataaatatttctctatccactggcctctttccagaggagacataaggtgattctaacatcctcaggcactgttccagagtgccgactgatgcaaaggaatgggagaggcaagagaacagcctggcacagcagaaagcccgcactctggaggcagccaggtgaagggcccagctgagcctcagttttctggtctatgaaacagacaattcgaccctcctgcaggagctctgcgctgagggcacccggcagtcagtggaaaaccctggacccctgtgacggttgctggtgcccacgcc

SEQ ID NO: 94220 - DNA, 601 bp, Human
cactggacgccctggaggcagcctgggcctggctcctctcagagctgccccctcctcaccatgcgaatctgacacaaagcatctccctcatccatgccaagaattactgggaacagaaacgtgcatgtaaatagtcttgttttcaaaaagcaggttctgcaaaccatcccaagcataaagaggcagcagagttaacaccttagtgtctgcagtcagtcaagcactcaattctaagtccattcattgcgaatctgtgactctgagctctccaaacctcaaccccccacctcaggaaaatggsaacagttacagtccagcatggactcactgagaagcggatgcatgcagacacctatgtcctcttctcaataggttacttgtataacgaaccgctgtataaacagagactacaagatcagaaataaatatttctctatccactggcctctttccagaggagacataaggtgattctaacatcctcaggcactgttccagagtgccgactgatgcaaaggaatgggagaggcaagagaacagcctggcacagcagaaagcccgcactctggaggcagccaggtgaagggcccagctgagcctc

SEQ ID NO: 94221 - DNA, 601 bp, Human
cacaatctcggctcactgcaacctctgcccccccggttcaagcgattcttctgcctcagcctccagagtagctgggattacaggcgcatgacaccacacctggctaattttttgtatctttagtagagacagggtttcactatgttggccaggctggtctccaactcctgacctcatgatccgcccgccttggcctcccaaagtgctgagattacaggcgtgagccacagaagcacacttttctacgtataatgcattttaaacttggtcatgagagttgctgtgcagcaggaatcgacaytctcctaggcaagcctggggagcactggacgccctggaggcagcctgggcctggctcctctcagagctgccccctcctcaccatgcgaatctgacacaaagcatctccctcatccatgccaagaattactgggaacagaaacgtgcatgtaaatagtcttgttttcaaaaagcaggttctgcaaaccatcccaagcataaagaggcagcagagttaacaccttagtgtctgcagtcagtcaagcactcaattctaagtccattcattgcgaatctgtgactctgagctctccaaacctca

SEQ ID NO: 94222 - DNA, 601 bp, Human
aaaactcaggagtgatcacagagcccaggggcttgctctgggagtgtgggttgggggcgtaatgggatggaactagggaaggtccacatgttttcaaagaaactttcctttttcttgagaatgggcacacaggcgacagtatgtattctttgttttttgttttttgagacagagtctcactctgtcgcccaggctggagtgcagtggcacaatctcggctcactgcaacctctgcccccccggttcaagcgattcttctgcctcagcctccagagtagctgggattacaggcgcatgacamcacacctggctaattttttgtatctttagtagagacagggtttcactatgttggccaggctggtctccaactcctgacctcatgatccgcccgccttggcctcccaaagtgctgagattacaggcgtgagccacagaagcacacttttctacgtataatgcattttaaacttggtcatgagagttgctgtgcagcaggaatcgacactctcctaggcaagcctggggagcactggacgccctggaggcagcctgggcctggctcctctcagagctgccccctcctcaccatgcgaatctg

SEQ ID NO: 94223 - DNA, 601 bp, Human
tatttaattaaatgatgtaattacaatgacgtgcaacaggcacaaaccggcacattaaggatgggcggccaaggcctccagggagcaggactgagtgagcaccacagtgtttacaaaactcaggagtgatcacagagcccaggggcttgctctgggagtgtgggttgggggcgtaatgggatggaactagggaaggtccacatgttttcaaagaaactttcctttttcttgagaatgggcacacaggcgacagtatgtattctttgttttttgttttttgagacagagtctcactctgtcrcccaggctggagtgcagtggcacaatctcggctcactgcaacctctgcccccccggttcaagcgattcttctgcctcagcctccagagtagctgggattacaggcgcatgacaccacacctggctaattttttgtatctttagtagagacagggtttcactatgttggccaggctggtctccaactcctgacctcatgatccgcccgccttggcctcccaaagtgctgagattacaggcgtgagccacagaagcacacttttctacgtataatgcattttaaacttggtcatgagagttg

SEQ ID NO: 94224 - DNA, 601 bp, Human
agaatgatcaataaatactaaaaaaaaaaacaaacaaaaaaccaacttaaaggggtaaatgatatcttaaaaaaaatccattaaaagaggaaaacacaaagaataaaaataaagttatctataatccaccactcacaaaaaaaaaaaaaaaaaaacgtaatggatcccagaagttggctaagtgaggaatcaaatgatgcgtgtatctcaaacatttcaacttaaaacagaaaaacacacaattatctttcaagctgcaaactttttcttcgaacatgagtccattaattggagtttcatytttttttttttttttgcatgaaccatgtccacgacacaccgctcatgattgttagctttgtttctttaaagtggatccctgtcatcttcccagaccttacaacttttcctcataatctttcactatttgctttattcaatagcaattttttagcaattttcctttgggactttccaaagcattcagctttgtcttcacagaaacattgctctacacataattatttttcatcagcttccatatttaattaaatgatgtaattacaatgacgtgcaacaggcacaaaccggcacattaagg

SEQ ID NO: 94225 - DNA, 601 bp, Human
aaacactgcggaaggccgcagggacctctgcctaggaaaaccagagacctttgttcacgtgtttatctgctgaccttccctccactattgtcctatgaccctgccaaatccccctctccgagaaacacccaagaatgatcaataaatactaaaaaaaaaaacaaacaaaaaaccaacttaaaggggtaaatgatatcttaaaaaaaatccattaaaagaggaaaacacaaagaataaaaataaagttatctataatccaccactcacaaaaaaaaaaaaaaaaaaacgtaatggatcccasaagttggctaagtgaggaatcaaatgatgcgtgtatctcaaacatttcaacttaaaacagaaaaacacacaattatctttcaagctgcaaactttttcttcgaacatgagtccattaattggagtttcatctttttttttttttttgcatgaaccatgtccacgacacaccgctcatgattgttagctttgtttctttaaagtggatccctgtcatcttcccagaccttacaacttttcctcataatctttcactatttgctttattcaatagcaattttttagcaattttcctttggga

SEQ ID NO: 94226 - DNA, 601 bp, Human
agtacccagggacacaaacactgcggaaggccgcagggacctctgcctaggaaaaccagagacctttgttcacgtgtttatctgctgaccttccctccactattgtcctatgaccctgccaaatccccctctccgagaaacacccaagaatgatcaataaatactaaaaaaaaaaacaaacaaaaaaccaacttaaaggggtaaatgatatcttaaaaaaaatccattaaaagaggaaaacacaaagaataaaaataaagttatctataatccaccactcacaaaaaaaaaaaaaaaaaamcgtaatggatcccagaagttggctaagtgaggaatcaaatgatgcgtgtatctcaaacatttcaacttaaaacagaaaaacacacaattatctttcaagctgcaaactttttcttcgaacatgagtccattaattggagtttcatctttttttttttttttgcatgaaccatgtccacgacacaccgctcatgattgttagctttgtttctttaaagtggatccctgtcatcttcccagaccttacaacttttcctcataatctttcactatttgctttattcaatagcaattttttagc

SEQ ID NO: 94227 - DNA, 601 bp, Human
aggagccacctgcctgaggctgcacctgctgcacctgctgcacccagcctgaggccactaagctggagctcagactctctggtcccaagatcagaggaaccccaagtcaggggattcacatggggcaccagtccctctcaccaagagcctgggccgctccgtgacaccctggccacatggcagacgatgccactcacactcttcccagcagacagaggaaaggtcactcttaccccatggaaagggacccaggcaaggtgtggtttcaggcctggctgctccaccactactctccagcccmatccataagcccaaaggcccacgcagcagcaaaccctcgtcacgctgtgactcccacagggagcaaccactttcctacggggatgtgggtcccacacactgcctgtgcaggacaggggtgcaggaggcatctgcttctccacgtcactgcctcaaaacctcccacaacgggagccacattcccacctcaggtcctctgcacagccctcttccacaacaccgcacccctagatgcctgcgtggcctgccccctcttcacttgtttgagtcttcaatggaatgtcacctgagccctggctcc

SEQ ID NO: 94228 - DNA, 601 bp, Human
ctccagccagagccctgcggaaggcagggaacacaacccaagcgacacaggctgtctctgcagggcttgttttgcgaaaagtatgcagaaataggaataaaatacattagacagcaaaacctcagtgctacaaaccaaaggacaatcagcattcacaactgcaaagtcacaagggcaacagggcgtcatgtcagccggacttttctggctgatgcaacacaattgtgtggaaaggtggggtcgccaggttgggagagatgcatggccccagaacacgggaggagcagctggtgttttcctraagacaggggactaatgccatgctgtgcagtacccggccctgggtcaggttctgcaggagccacctgcctgaggctgcacctgctgcacctgctgcacccagcctgaggccactaagctggagctcagactctctggtcccaagatcagaggaaccccaagtcaggggattcacatggggcaccagtccctctcaccaagagcctgggccgctccgtgacaccctggccacatggcagacgatgccactcacactcttcccagcagacagaggaaaggtcactcttaccccatggaaagg

SEQ ID NO: 94229 - DNA, 601 bp, Human
cttgtgcctgtgggaagagagggctggagctccaccaccactggctgtcacgagctccacacaagaacagaggaaagttcttgaagagctgttgaatcatgaagggttattaaacaattgcagccttcgccacacatcaaatccaagaccagagccccaacacctccaactggcaggaagagtgtttattttccagaagcctcctgacctgtgtgtggttaaagctactcagagatgtttaccaagggtgctctggggattagctaagtgctcgtaaccaggaggagccgtgccaagtatyattacggcctaagaataactcccgacagtccattctgaaacccgcacttcaccaactacaaagtggaaggcattcagaggcctcaggagcctcagctcggagatgacacggcagtgacagttccaactgcagtccaagctgtgacatctgctgctgaacacgcgggcttcagctgcgaagccttttaaattctaactggtgggttttcaaggggaagaaagtctttttgttctatctgcagctgaattttgactcaagcccagctgcacgcagagcagcagagggctgtggggagtccgg

SEQ ID NO: 94230 - DNA, 601 bp, Human
tcaagaccagcctggccaacatggtgaaaccccgtctctactaaaaatacaaaaaattagccgggtgcagtggcaggtgcctgtaatcccacctactcaggaggctgaggcaggagaattgcttgaacccgggaggtggaggttacagtgagctgagaccacggtattgccctccagcctgcgcaacaagagcaagactccatctcaaaaaaaaaaaaaaagaaagaaagaaaaggaaaagaaaagaaaagaaagaaataggggaaagtctaagcagaaaataaccctacagccttctggrcaagttaccaaaggcaattctttatgtcaccaggatgccacccaccacacgtgtgacagagaaaacactgcctgcggttctctgtcaatctgaaggacaaatattaggttacagaatttggtccaagtctaaaagaagaatcctacaaatgtcatcacaagaattctggaaactcgaacacctgaaactgcatgacacctttggcttctacgtaggacaaggttatggacttttgatcatttgatatatactggaacgtcttcaaaagagtgctaagtaatacaatattttaagaataga

SEQ ID NO: 94231 - DNA, 601 bp, Human
tggctcacgcctataatgccagcactttgggaggccgaggcaggcggatcacctgaggtcaggagctcaagaccagcctggccaacatggtgaaaccccgtctctactaaaaatacaaaaaattagccgggtgcagtggcaggtgcctgtaatcccacctactcaggaggctgaggcaggagaattgcttgaacccgggaggtggaggttacagtgagctgagaccacggtattgccctccagcctgcgcaacaagagcaagactccatctcaaaaaaaaaaaaaaagaaagaaagaaaaggaaaagaaaagaaaagaaagaaataggggaaagtctaagcagaaaataaccctacagccttctgggcaagttaccaaaggcaattctttatgtcaccaggatgccacccaccacacgtgtgacagagaaaacactgcctgcggttctctgtcaatctgaaggacaaatattaggttacagaatttggtccaagtctaaaagaagaatcctacaaatgtcatcacaagaattctggaaactcgaacacctgaaactgcatgacacctttggcttctacgtaggacaaggttatggactttt

SEQ ID NO: 94232 - DNA, 601 bp, Human
cgcagtggctcacgcctataatgccagcactttgggaggccgaggcaggcggatcacctgaggtcaggagctcaagaccagcctggccaacatggtgaaaccccgtctctactaaaaatacaaaaaattagccgggtgcagtggcaggtgcctgtaatcccacctactcaggaggctgaggcaggagaattgcttgaacccgggaggtggaggttacagtgagctgagaccacggtattgccctccagcctgcgcaacaagagcaagactccatctcaaaaaaaaaaaaaaagaaagaaagaaaaggaaaagaaaagaaaagaaagaaataggggaaagtctaagcagaaaataaccctacagccttctgggcaagttaccaaaggcaattctttatgtcaccaggatgccacccaccacacgtgtgacagagaaaacactgcctgcggttctctgtcaatctgaaggacaaatattaggttacagaatttggtccaagtctaaaagaagaatcctacaaatgtcatcacaagaattctggaaactcgaacacctgaaactgcatgacacctttggcttctacgtaggacaaggttatgga

SEQ ID NO: 94233 - DNA, 601 bp, Human
gcgcgcagtggctcacgcctataatgccagcactttgggaggccgaggcaggcggatcacctgaggtcaggagctcaagaccagcctggccaacatggtgaaaccccgtctctactaaaaatacaaaaaattagccgggtgcagtggcaggtgcctgtaatcccacctactcaggaggctgaggcaggagaattgcttgaacccgggaggtggaggttacagtgagctgagaccacggtattgccctccagcctgcgcaacaagagcaagactccatctcaaaaaaaaaaaaaaagaaagaaagaaaaggaaaagaaaagaaaagaaagaaataggggaaagtctaagcagaaaataaccctacagccttctgggcaagttaccaaaggcaattctttatgtcaccaggatgccacccaccacacgtgtgacagagaaaacactgcctgcggttctctgtcaatctgaaggacaaatattaggttacagaatttggtccaagtctaaaagaagaatcctacaaatgtcatcacaagaattctggaaactcgaacacctgaaactgcatgacacctttggcttctacgtaggacaaggttat

SEQ ID NO: 94234 - DNA, 601 bp, Human
ccaccccactgaatcaagacccccctgaaggcggggcttaggggctgcacacaaactccctggtgattcttacacacaactacttccggaactaccgatcatctgcataaatagagaggggaggctgggcgcgcagtggctcacgcctataatgccagcactttgggaggccgaggcaggcggatcacctgaggtcaggagctcaagaccagcctggccaacatggtgaaaccccgtctctactaaaaatacaaaaaattagccgggtgcagtggcaggtgcctgtaatcccacctactcrggaggctgaggcaggagaattgcttgaacccgggaggtggaggttacagtgagctgagaccacggtattgccctccagcctgcgcaacaagagcaagactccatctcaaaaaaaaaaaaaaagaaagaaagaaaaggaaaagaaaagaaaagaaagaaataggggaaagtctaagcagaaaataaccctacagccttctgggcaagttaccaaaggcaattctttatgtcaccaggatgccacccaccacacgtgtgacagagaaaacactgcctgcggttctctgtcaatctgaaggac

SEQ ID NO: 94235 - DNA, 601 bp, Human
ttttaatttaaaaaaaagctcaacaataaaaaaaataagcaagtcctcatagccataacattgagcactgaacacccattaaagctgatgctgggcaaaaaggtggtcaggcagttgctgcaaaaagcgcaggacacgaggatgtgctcggctctaaccaggacagtgggcgcatggtttcacggcgcgtgtggcgagggcagcgggcgcacggtttcacggcgggtgtggcgaggggagcgggcgcacggtttcacggcgcgtgtggcgaggggagcgggcgcacggtttcacggcgcgygtggcgaggggagcgggcgcatggtttcacggcgcgtgtggcgaggggagcgggcgcatggtttcacggcgcgtgtggcgagggcagtggatgcatggtttcacggtgcgtggcgtcatgacgtcgggctaatggcatggaccacctgcaccagagtcatctgaggcaactccagcctgccccgccccaccccaccccactgaatcaagacccccctgaaggcggggcttaggggctgcacacaaactccctggtgattcttacacacaactacttccggaactaccgatcatctgcata

SEQ ID NO: 94236 - DNA, 601 bp, Human
cctgctgacctgccacgctcttccaagaggacatcctgaggaaacccaagacaagcaccacacctggccacggtggcatcctgccaccgtgttgggatgtttttaattgtggtaaaatacacttaacataaaatataccatcttaaccatttttaagtccccagttctgtcgtgttgagcatattcatgttattgggcaaccagcaccacacctatccccagaactcttaattttgcaaaactgaaaccctgtcgcattaaagaggaactcccacagcccctctgctcccagccccagccrcctccatactaccttccgtctctaagaatgcgaccactccagccacatgagtggagccatagagcatttctctgtgacgggctcactctacttggcatcacgtcctcaaggctcatccatgttacagcatgtggcagactctccttccttttgaaggctgagtaatactccattgtgtggctacacaacgtttatccactcacccgtcggtggacacctgggctgctttcaccttttggctgttgtgaataatgctgctaggaacatgggtgtgccaatgcctgttccaaacgctgcttt

SEQ ID NO: 94237 - DNA, 601 bp, Human
cctgaggaagactggaccctccaaaaggacgaggctaagagagcgagcaaaggggggtcctcaggcctgacctgctgacctgccacgctcttccaagaggacatcctgaggaaacccaagacaagcaccacacctggccacggtggcatcctgccaccgtgttgggatgtttttaattgtggtaaaatacacttaacataaaatataccatcttaaccatttttaagtccccagttctgtcgtgttgagcatattcatgttattgggcaaccagcaccacacctatccccagaactcttamttttgcaaaactgaaaccctgtcgcattaaagaggaactcccacagcccctctgctcccagccccagccacctccatactaccttccgtctctaagaatgcgaccactccagccacatgagtggagccatagagcatttctctgtgacgggctcactctacttggcatcacgtcctcaaggctcatccatgttacagcatgtggcagactctccttccttttgaaggctgagtaatactccattgtgtggctacacaacgtttatccactcacccgtcggtggacacctgggctgctttc

SEQ ID NO: 94238 - DNA, 601 bp, Human
aattcaaagtagctagaagagaaccagaatttttcccaatacgtggaaatgataaatactcaaagtgatggttaccccaaataccctaaacttgcccattccacattctgtgcacgtaagaaaatatcacaggtactccataaatatgtaaaatattatgtataaaaataaataaatggtaaataaataaataaaagaaaatgggctctctggggatgaagtgtatgagctttagctagtggaaacagaatgggtttaaggcaatggtttcagagcactccatatcagaaaaagaaaagaygaaatggttttgccaacatgtggacatttctgaggccacaaaggaggtcccatcaagaacaaggtggaatccgatcaaacgggtcaggaggtcacctcctgaactctacaggaagcattccggcgccctcttctcgtattaacagcagcctgtggagaaggacggaggccaccatctggagtaaaggacatacccttgaaccaagcggggtggggaggaggagcccaggaggctctgggcacgcggaggagtccacaggggtggactgtgagctctcagagaggcttgcacggagaagca

SEQ ID NO: 94239 - DNA, 601 bp, Human
gtataaattcagttgttccacagaagaggagggtgactagagttaacagtgtattgtataattcaaagtagctagaagagaaccagaatttttcccaatacgtggaaatgataaatactcaaagtgatggttaccccaaataccctaaacttgcccattccacattctgtgcacgtaagaaaatatcacaggtactccataaatatgtaaaatattatgtataaaaataaataaatggtaaataaataaataaaagaaaatgggctctctggggatgaagtgtatgagctttagctagtgraaacagaatgggtttaaggcaatggtttcagagcactccatatcagaaaaagaaaagatgaaatggttttgccaacatgtggacatttctgaggccacaaaggaggtcccatcaagaacaaggtggaatccgatcaaacgggtcaggaggtcacctcctgaactctacaggaagcattccggcgccctcttctcgtattaacagcagcctgtggagaaggacggaggccaccatctggagtaaaggacatacccttgaaccaagcggggtggggaggaggagcccaggaggctctgggca

SEQ ID NO: 94240 - DNA, 601 bp, Human
gaccagcccggccaacatggtgaaactccatctctactaaaaatacaaaaattagccaggcgtggtggcacacgcctgtaatcccagctactcaggaggctgaggcaggagaatcacttgaaccagggagtcagaggttgtagtgagccaagatgacgccactgcactccagcctggcaacagagcaagactccatctcaaaaaaaaagaaagaatgagagcctgtcatttgtaacaacgtggctggaatgggaggtgaccgtgtcaggtgaaaccaccaggaacagaaagaaactgcacrtcttcactcatgggagctgtggaaattcacctcctaaaggcagagagtagaatgacaggaactagtggattgaaaggtctgggtgagcggaaccacagatgaagagagttgagttaatgggtacgaacatacagttagatgaaaggtataaattcagttgttccacagaagaggagggtgactagagttaacagtgtattgtataattcaaagtagctagaagagaaccagaatttttcccaatacgtggaaatgataaatactcaaagtgatggttaccccaaataccctaaacttgcc

SEQ ID NO: 94241 - DNA, 601 bp, Human
aaaaccctacggcacaggtacagtgcactgctattacctgacaatccctatgccgttaactttatggatgtggaagggacagggaggctggaggctgttttcagggtgtgcaatccaagcccattttcacactggcattgggaggccgggagaggacatgcaccgtggaggcggtgtctggatgtcgccggggacatgaggagaaaacacttcaagtacaatcatcaaccagcatgttaaaagttgtgaaattttgtataccctttgttcggcagtgtcaatcaaaagaaaatgtgttccycatatacaaaaatcaactggagatggattacaggctgaaacctaagacccaaaaatataaaaaatactaaagaaaacaaggaaaacacttcaggacattggtctaggcaaagattttatagctaagacctcaaaagcacaggcaacaaaaacaaaaatagacaaatgggactacatcaaagtaaaaagcttctgcccatccaagaaaacaatcaacagagtgaagagacagcctcttgaatgcaggaaaatatctgtcaactcttcggccaataagggactaacatccaaaatacaactc

SEQ ID NO: 94242 - DNA, 601 bp, Human
cttaaaggaaaaggagatggacccatgggagaaaacctgggtctcagccccagccctgacccctccaggctcaactccctacctgctcggctgggcttcctaaggctcacttccaaaaccctacggcacaggtacagtgcactgctattacctgacaatccctatgccgttaactttatggatgtggaagggacagggaggctggaggctgttttcagggtgtgcaatccaagcccattttcacactggcattgggaggccgggagaggacatgcaccgtggaggcggtgtctggatgtcrccggggacatgaggagaaaacacttcaagtacaatcatcaaccagcatgttaaaagttgtgaaattttgtataccctttgttcggcagtgtcaatcaaaagaaaatgtgttccccatatacaaaaatcaactggagatggattacaggctgaaacctaagacccaaaaatataaaaaatactaaagaaaacaaggaaaacacttcaggacattggtctaggcaaagattttatagctaagacctcaaaagcacaggcaacaaaaacaaaaatagacaaatgggactacatcaaagtaaaa

SEQ ID NO: 94243 - DNA, 601 bp, Human
ccaggacatccttaaaggaaaaggagatggacccatgggagaaaacctgggtctcagccccagccctgacccctccaggctcaactccctacctgctcggctgggcttcctaaggctcacttccaaaaccctacggcacaggtacagtgcactgctattacctgacaatccctatgccgttaactttatggatgtggaagggacagggaggctggaggctgttttcagggtgtgcaatccaagcccattttcacactggcattgggaggccgggagaggacatgcaccgtggaggcggtgyctggatgtcgccggggacatgaggagaaaacacttcaagtacaatcatcaaccagcatgttaaaagttgtgaaattttgtataccctttgttcggcagtgtcaatcaaaagaaaatgtgttccccatatacaaaaatcaactggagatggattacaggctgaaacctaagacccaaaaatataaaaaatactaaagaaaacaaggaaaacacttcaggacattggtctaggcaaagattttatagctaagacctcaaaagcacaggcaacaaaaacaaaaatagacaaatgggactacat

SEQ ID NO: 94244 - DNA, 601 bp, Human
cagccctcgggagcactgtcacgtgatgggctctcagcctggatacttgctggccacatccctaggcccccagatccctgccggctctcagtccccatgcgaccaggcccccatcatagggaggactgaagctgcagggcttgctattccagagccctccaaccacaggggcagccgtgcccaacacctcccacgggcagaagccgctggagggcacaggggcaccagaaggaatccctcccttcgcagcctcttgcgctgaaaaacccgcagtcaccactttggctaaaccaagcctcaygagccctgtctggccattcttgctcatgaccagggttcagcttccactcaaaagcacaagcacagtgagctcgatgacagccttcaagaacgtcacacgggaccagtctactctacttgcagagacagagggaaggccaggacatccttaaaggaaaaggagatggacccatgggagaaaacctgggtctcagccccagccctgacccctccaggctcaactccctacctgctcggctgggcttcctaaggctcacttccaaaaccctacggcacaggtacagtgcactgctattacctg

SEQ ID NO: 94245 - DNA, 601 bp, Human
ccagccctcgggagcactgtcacgtgatgggctctcagcctggatacttgctggccacatccctaggcccccagatccctgccggctctcagtccccatgcgaccaggcccccatcatagggaggactgaagctgcagggcttgctattccagagccctccaaccacaggggcagccgtgcccaacacctcccacgggcagaagccgctggagggcacaggggcaccagaaggaatccctcccttcgcagcctcttgcgctgaaaaacccgcagtcaccactttggctaaaccaagcctcrcgagccctgtctggccattcttgctcatgaccagggttcagcttccactcaaaagcacaagcacagtgagctcgatgacagccttcaagaacgtcacacgggaccagtctactctacttgcagagacagagggaaggccaggacatccttaaaggaaaaggagatggacccatgggagaaaacctgggtctcagccccagccctgacccctccaggctcaactccctacctgctcggctgggcttcctaaggctcacttccaaaaccctacggcacaggtacagtgcactgctattacct

SEQ ID NO: 94246 - DNA, 601 bp, Human
gttctctctcaccagagggcacactgcctgccacctccctctgtggggaagcctccctgcagcctgcagagcagaaggcagggtcaggagcatttgacaccgatttagaaacaagcttcttgccccaaggtacgaacccacccagcaaagctgggagctggggtaagatctcagagggccaggctctgctaaccatgttctgcgattcccagtgatgccaagaccatgataaatgcaaccatttagcaatgaggggggaaatgggagtggttcaaatcaactgaaaagtgacagtgacagmgctctcttctgaagtgctgggcgcccacagatggcacacgcaccaggcagtctcctacgtcacccaggaaggcctctgtctcatgtcatggggtcaacgcctcattctggcactgatgggccacaggagaaacctgagtactctggagccccggggcatccatctccatcacccaaggagcaggctggctctccacattcccaccgactctgcaggaggctgcttccgggtggctcccctgcacgctcctccttgcctgaggtgggtgtgacctggagttgtcctgccccaggcaggaac

SEQ ID NO: 94247 - DNA, 601 bp, Human
ctcctccaaacagaggaagggccacttccttacagtgtctctggccacccccacgcccctcgccatcccatgcctgttttgcacggcacagaggacagctggaggccgccttgcccagcattagtttggtgtttctggagtgtcttccatcactggaacaaagctaccaagagcctgtgagcagatgtcctgcggcctggcccaggccctgagccctcacacacacccagggccggtcataagccctccctctgaccacagccaattcacacagagcacgccacggccttctcccttccaygtcccccagagaggcctcctctgcccacccaaagaacaggccccttgctgaacatctagtggggacagcgatgggtgcagaaggagtagctggcaccggggagaccccatctgtcctcacacacacaggcaaaccggggttagaaagcagctccgtggaaaaaccatttatgactgaaagaccttggaagagaaactgaactctaggacagagatgaaaggtgcagctgcccttgaacgccgtgaccattctctccagtttcccaaagcttccaacctcagggagttaaaaatatcagta

SEQ ID NO: 94248 - DNA, 601 bp, Human
aacaccggggagatgaccttagaaagccccgattttacttcacctgtagaaacagagacacgacctgacagtgtcactcttcagaggaaacgaaatcatgtttaaaaagcacccgccaggcccctggcacaggggaggtgctcagcgagttttaagttcctttcctcacctctccttcagaagacccacatataacaacaagagtaaaatcagcgatctccaggtgtagcgctttctactttccaggacgattccagattgtctcagtgaatgccccagcaaccctgttgttcaccgtttycattttttaaacgaggaaactcagactccaatgtgaaacagccgcttcaaagttcaaagtgcaccccgatgatcagcaacagctgagctcggcccgagccacatcttctaactcaacgctgggactccggaggacacagcaaggatctgagccatgcatgcaaagttacgccagtggtgtgtgagcattcccagcctcacaacctggggcacaaagccaaggctccctggctagactgacccagtggcatgtgagctcaggcccgaggacccatccttgttcttctcttcacctgtcatg

SEQ ID NO: 94249 - DNA, 601 bp, Human
aaagcctctgttctgacatgtatacactttgatcctagataagcccctacactctttttttttaagtacaatgtccattttatttttctccagagaatagtctgtcttcagtctttaagaactcagctccttacatgggctttggtgggggacgtgcggcagcacccgcaggtctaaatcggggtgggggtgttcggtccttgcgggcttcacgagatcgattcctgactactttgctgtgaattacacaactcacacagtaatgtagcttcacacacagcttgggaagcacataggcatygaagacgctcgcttcagaaatgtccctgactgctgcagcctccactatgtttcgaatgacgaatttcttaatggcgttgtccttgggcacgcatcgggcacagttagtgcagcgaataggctgcacgtggccgcggccctttttggcacgaacgttgttccttcttttctttgtcatcttggaggcatggaccggagagagcgataagcccctacactcttattctggacctatttactcctgtgttacatacaaccatctaaggcttggtttggtttctccaggattcaacaaaattgg

SEQ ID NO: 94250 - DNA, 601 bp, Human
acagccagaggctgtcagagatccaagggagtcattgccagtgtccttgtctaaggaggatgggccatggagaagccctccctgcccgctctccacccagatctgttgacagccacccctcacatgcccagggcctggagggtcccagcaaggctgagactatgagcagctgtcctactcacatacccatcccagcatccaggtcagcccctttgtcctggggtcctcaaggtcactggcgcccttccagcctgctggccttgggccagcctctagcccctccttctggatcttggtcttstcagatctgaccctgtcacctctttccccgaccaggccccttcccctctggtgcctgggcagcctgggggaagtatgctggaagcagcgtaatgatctggcaaggcagaggagacagcacgtcttgaaacatttttggggtcaaggactaccccatttgttccctcactcccacctaggtcactgatgtgcattagcttggactgttgtaacaaaatatcacagacagtgtggcttaaacaacagtcatcactttccacagttctggaggccagaagtccacaatccaggttccctcaga

SEQ ID NO: 94251 - DNA, 601 bp, Human
tccctgcccgctctccacccagatctgttgacagccacccctcacatgcccagggcctggagggtcccagcaaggctgagactatgagcagctgtcctactcacatacccatcccagcatccaggtcagcccctttgtcctggggtcctcaaggtcactggcgcccttccagcctgctggccttgggccagcctctagcccctccttctggatcttggtcttctcagatctgaccctgtcacctctttccccgaccaggccccttcccctctggtgcctgggcagcctgggggaagtatgytggaagcagcgtaatgatctggcaaggcagaggagacagcacgtcttgaaacatttttggggtcaaggactaccccatttgttccctcactcccacctaggtcactgatgtgcattagcttggactgttgtaacaaaatatcacagacagtgtggcttaaacaacagtcatcactttccacagttctggaggccagaagtccacaatccaggttccctcagattctgttcctggcgagaacccacttcctggcttgtagacggctgccctctcactgtgcactcacatggcattccccag

SEQ ID NO: 94252 - DNA, 601 bp, Human
tgccagactctcattgttcaggagcagcagaggtaggatctggacctgatggagtctggagtcagcacccataacatgtcctcctggaccttggggatacactgtgagcaggctggctggggtctgccagcacagataggtgccattctgttttgcatactatttcagggggtcctgaacaccttgaagcaggtggaggcccctgctccagactgggagctcctggagaggccaccctgtgtctgtgtggttctaagctggagccacatcgaatcaggatggggctccagcacccgacagyccccatcaaatttcacaggttttggcgccgtcgggcaaggctgacacattgtcttggaggaggcccaggaagtctggccttagggtcgcagcctgagtttcaggcagatagggcatgagattccagcatttctgcttcgagccccgtggtagatccctgtctccctccttccccatggcctatttctgtctcatttattcattaacttcttgaacattcgtgaacacctgttttgtgcacagtgctgggttctgagggtgcagcaatgaagaaggccaacccagcagcctccattcctgc

SEQ ID NO: 94253 - DNA, 601 bp, Human
agaagagctatgttgcctgcctctgggaccctggggctacagcccacgagtgtcccttgcagagcccaccagggtgccttggaggcccatcccagtgccaggctgttcttcccagatgggacagctggggccacaggctgccgtggcagtgctgggctttctctggacagctctcccacctctgcccagggggcccggggggccagccccctgcctgggtcagcctctccctgcctgctgctctcctctggcccatccagcttgtatgtagattttccctcacgtgtgtgtgtgtgtgtgagtgtgtgtgctggtgagagtgacagcgggagcagggatgtgagacctgcagggtggcagggctcatggatgactggcggggtgcattaagtgctcatgctcgtgaaaggcacctcttcttgggtgtgggtgaggacaggtgtgactgcgcatgcaggtatgtgtgaggagaggggttgtggggagcatgtgcgcctgtgaggggaggctttccaactgaagtgctgcctcccccgctggccagctctggagtcctccatcctgtctggtcaggccccccccaacccctgacctggcactc

SEQ ID NO: 94254 - DNA, 601 bp, Human
ggggcaagccagggaagcggccagggacggccgcagaaggtaagagcccagggcagggcgggggtgtggggggctggcatctcaggtgggaacagggggattcggtagggtctggccactccccagtctgctaggggaggaatggctggcttactaatgcgcacgcgagcccagatgcctggagggaccctgtgctaggccgaggtcagcgctggcgtggaggcacatccagcacccgggcggcagggccgcttttgggggccggtggctctagggttggtgctgtggttgtacgggtcgyttatccccattcctccagtacgcgacaggtactaggcttgagccacaggggactgtgctgtgtcaccccctgccatactaatgggaccactctccctgttggtggcacagcttcacgtcgtccctccctcctgcctttgccctcctactccaggaggtctcacgtaggtgagagagtttcaggtggtggtgagcacagggcttcaggtggtggtgagcaatgggtggtcctacattagtacgggaaattagatgaggtgatgcatcactgaagcatttaacccacggcctcttgcataat

SEQ ID NO: 94255 - DNA, 601 bp, Human
gggaacagggggattcggtagggtctggccactccccagtctgctaggggaggaatggctggcttactaatgcgcacgcgagcccagatgcctggagggaccctgtgctaggccgaggtcagcgctggcgtggaggcacatccagcacccgggcggcagggccgcttttgggggccggtggctctagggttggtgctgtggttgtacgggtcgtttatccccattcctccagtacgcgacaggtactaggcttgagccacaggggactgtgctgtgtcaccccctgccatactaatgggamcactctccctgttggtggcacagcttcacgtcgtccctccctcctgcctttgccctcctactccaggaggtctcacgtaggtgagagagtttcaggtggtggtgagcacagggcttcaggtggtggtgagcaatgggtggtcctacattagtacgggaaattagatgaggtgatgcatcactgaagcatttaacccacggcctcttgcataatcagttgtcagtaaatcttagctgttttcatcgtggccctctggaaggtggcagagggtcttgtgatccctgtctcccaggagattcc

SEQ ID NO: 94256 - DNA, 601 bp, Human
gggccgcttttgggggccggtggctctagggttggtgctgtggttgtacgggtcgtttatccccattcctccagtacgcgacaggtactaggcttgagccacaggggactgtgctgtgtcaccccctgccatactaatgggaccactctccctgttggtggcacagcttcacgtcgtccctccctcctgcctttgccctcctactccaggaggtctcacgtaggtgagagagtttcaggtggtggtgagcacagggcttcaggtggtggtgagcaatgggtggtcctacattagtacgggraattagatgaggtgatgcatcactgaagcatttaacccacggcctcttgcataatcagttgtcagtaaatcttagctgttttcatcgtggccctctggaaggtggcagagggtcttgtgatccctgtctcccaggagattccaaggcaccatccaacattcctgatgtcagcagcccctcccctgccaccccagctctagatctttcctggctgcttcccacaccctgggctgcctgtgcccctcctgcctctggctctccttccaggcttgctctcctggctctggggcaccgctctag

SEQ ID NO: 94257 - DNA, 601 bp, Human
acgcgacaggtactaggcttgagccacaggggactgtgctgtgtcaccccctgccatactaatgggaccactctccctgttggtggcacagcttcacgtcgtccctccctcctgcctttgccctcctactccaggaggtctcacgtaggtgagagagtttcaggtggtggtgagcacagggcttcaggtggtggtgagcaatgggtggtcctacattagtacgggaaattagatgaggtgatgcatcactgaagcatttaacccacggcctcttgcataatcagttgtcagtaaatcttarctgttttcatcgtggccctctggaaggtggcagagggtcttgtgatccctgtctcccaggagattccaaggcaccatccaacattcctgatgtcagcagcccctcccctgccaccccagctctagatctttcctggctgcttcccacaccctgggctgcctgtgcccctcctgcctctggctctccttccaggcttgctctcctggctctggggcaccgctctagcagccctgcgtcccctggctgtctgcatttggtagctttcctgtgtttctgccaaacttccctcatgctccccac

SEQ ID NO: 94258 - DNA, 601 bp, Human
cttcccacaccctgggctgcctgtgcccctcctgcctctggctctccttccaggcttgctctcctggctctggggcaccgctctagcagccctgcgtcccctggctgtctgcatttggtagctttcctgtgtttctgccaaacttccctcatgctccccacctctcatcaggttctcaacagcacttgcagctcctgcttagggtcctgggaggattcccatggggaatcctcacaaccagtccctgctccctctcccagactctgaaatgagtgtgcagccacaagctccctacctgtcytttctgtcctctgtgtgatccctgaaccccccaggactccctatccttccaatcaattccaaaccccttacttctcgaaaggagaccacttcctcttctttgggcttcaatactcaaccaagtgtcccttttctttgaagcttttcttgccccgtaggagaccaggggaaggtcttgggcccatgtcccttcctttgtatggcagttggcagggatgaccagatgctcctccaggcctggatggctcagtcacctctctgccccttctgtgcccagaacagaatagtggaggagtggata

SEQ ID NO: 94259 - DNA, 601 bp, Human
tgccagcaggatgctgaaggccagaggagctcaggcctccttggagtgagctcggcctcaggagggtgtccacaggctctgtgtgggctctatgggtggctggtggcctgaggctcccaaggtggtcagagcaggcctcccgcccacctgcttctggaactcctgtgttgcaggggcgcccctctcaaataactggcagaatccaggagaggagacccatgtggaggcacgggagcaccagcctggtgagtggccgtcatccgcctggccttggggccagctgccctggctggttggactragggcttccccagagtaggcctgggtggggttgtcaggcagctaccagcgctttcccctcagagccggaggaggagaccgagcaacccacactggactacaatgaccagatcgagagggaggactatgaggactgtgagtagggtcctgccagccccacctgggtcggacccctggcctgggggatgtgccaatgggcccatcccagccttgggccccactctgagccagcctccccctcagttgagtacattcggcgccagaagcaacccaggccacccccaagcagaaggaggaggcc

SEQ ID NO: 94260 - DNA, 601 bp, Human
gctcaggcctccttggagtgagctcggcctcaggagggtgtccacaggctctgtgtgggctctatgggtggctggtggcctgaggctcccaaggtggtcagagcaggcctcccgcccacctgcttctggaactcctgtgttgcaggggcgcccctctcaaataactggcagaatccaggagaggagacccatgtggaggcacgggagcaccagcctggtgagtggccgtcatccgcctggccttggggccagctgccctggctggttggactgagggcttccccagagtaggcctgggtgrggttgtcaggcagctaccagcgctttcccctcagagccggaggaggagaccgagcaacccacactggactacaatgaccagatcgagagggaggactatgaggactgtgagtagggtcctgccagccccacctgggtcggacccctggcctgggggatgtgccaatgggcccatcccagccttgggccccactctgagccagcctccccctcagttgagtacattcggcgccagaagcaacccaggccacccccaagcagaaggaggaggcccgagcgggtctggccagagccccctgag

SEQ ID NO: 94261 - DNA, 601 bp, Human
ccctcaggttccctttcctcctgggtggcagcccgtgcatcgccatttccctgcccccaggtccccatcagtgcctccaatgtctccccatctcaccccccagcccgcaaccccaggcacaggtgccagttgtccctccaggcctttcccatgccctgggcctcgagtcctttccccaggccagatgctcctggaaggccgggctggtgacttcagcagggtcttgctcagctgcccctgagctcgggctgctcctgactcctgcaagaccctctcccaactcagctgtcccccatctccygtcctcctcccctctggcgcggtcctgtcctgctgagctcctgtggacccaggagctgaggccccgcagcagggtcagggcagcctcagctggctctccctccccatagtggactattactttgggcctcctccgccccagaagcccgatgctgagcgccagacggacgaagagaaggaggagctgagtgagtgggaccaaggacttcccacaccaggcctgccctgaaggccacctggggcctgcctgatccaccccacatggtcctcaaagcccagagccaggctgactggcccctcc

SEQ ID NO: 94262 - DNA, 601 bp, Human
ggtggcagcccgtgcatcgccatttccctgcccccaggtccccatcagtgcctccaatgtctccccatctcaccccccagcccgcaaccccaggcacaggtgccagttgtccctccaggcctttcccatgccctgggcctcgagtcctttccccaggccagatgctcctggaaggccgggctggtgacttcagcagggtcttgctcagctgcccctgagctcgggctgctcctgactcctgcaagaccctctcccaactcagctgtcccccatctcctgtcctcctcccctctggcgcggkcctgtcctgctgagctcctgtggacccaggagctgaggccccgcagcagggtcagggcagcctcagctggctctccctccccatagtggactattactttgggcctcctccgccccagaagcccgatgctgagcgccagacggacgaagagaaggaggagctgagtgagtgggaccaaggacttcccacaccaggcctgccctgaaggccacctggggcctgcctgatccaccccacatggtcctcaaagcccagagccaggctgactggcccctcctaccttgcaccttccagagaaac

SEQ ID NO: 94263 - DNA, 601 bp, Human
agtcctttccccaggccagatgctcctggaaggccgggctggtgacttcagcagggtcttgctcagctgcccctgagctcgggctgctcctgactcctgcaagaccctctcccaactcagctgtcccccatctcctgtcctcctcccctctggcgcggtcctgtcctgctgagctcctgtggacccaggagctgaggccccgcagcagggtcagggcagcctcagctggctctccctccccatagtggactattactttgggcctcctccgccccagaagcccgatgctgagcgccagacrgacgaagagaaggaggagctgagtgagtgggaccaaggacttcccacaccaggcctgccctgaaggccacctggggcctgcctgatccaccccacatggtcctcaaagcccagagccaggctgactggcccctcctaccttgcaccttccagagaaacccaaaaaggaggacagcagccccaaggaggagaccgacaagtgggcagtggagaagggcaaggaccacaaaggtgtgtggctggggcttggggcctgggtccctgtggggcagcatctggactcctgattgcctcccgggcc

SEQ ID NO: 94264 - DNA, 601 bp, Human
cctgggtccctgtggggcagcatctggactcctgattgcctcccgggcccttggtgccatgtcctcccttcattgtccctagagccccgaaagggcgaggagttggaggaggagtggacgcctacggagaaagtcagtaagtggggggcacaagggggtgagggtgggggccacaggatgggggtgctgggacaagtgactggcccaatgtcacaaacaggacccaggtccccggaaccctttcctactcagattcttgggacccagaagggaggggccccgggagcccaggatagcctcrcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagacggtccccatctggatgacatctgtggctgcgccctgggggagctctacctgtgatttcacgtgtgtcccctgagagctgggcatggtcagcccgttctccagatggggcagctgaggcccagggaggggaagcac

SEQ ID NO: 94265 - DNA, 601 bp, Human
gggggccacaggatgggggtgctgggacaagtgactggcccaatgtcacaaacaggacccaggtccccggaaccctttcctactcagattcttgggacccagaagggaggggccccgggagcccaggatagcctcgcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagayggtccccatctggatgacatctgtggctgcgccctgggggagctctacctgtgatttcacgtgtgtcccctgagagctgggcatggtcagcccgttctccagatggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaa

SEQ ID NO: 94266 - DNA, 601 bp, Human
gggaggggccccgggagcccaggatagcctcgcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagacggtccccatctggatgacatctgtggctgcgccctgggggagctctacctgtgatttcacgtgtgtcccctgagagctgggcatggtcagcccgttctccagawggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaaggatggagctagtgagccaccattctggggtacgcgtcctcagagtgtccccccattgggatggagtcacaccgtattgaggacaaccagatccgagcctcctc

SEQ ID NO: 94267 - DNA, 601 bp, Human
ggcggggcacggtggctcacgcctgtaatcccagcactttgggaagtggaggcaagcggatcacctaaggtcaggagttctagaccagcctgaccaacatggtgaaatcctgtctttactaaaaatacaaaaaattagctgtgtctggtggcacgcacctgtaatcccagctactcggggagctgagacaggagaatagcttgaaccttggaggtggaggtttcagtgagccgagattgtgccactgctctccagcctgggtgatagagtgagactctgtctcaaaaataaaataaaattwaaaaaaaaaaaaaaaaaagctgggcgcggtggctcacacctgtaatcccagcactttgggaggccgaggcgggcggatcacgaggtcaggagatcgagaccatcctggataacgcggtgaaaccccatctctactaaaaatacaaaaaaatagccgggcgtggtggcaggcgcctgtagtctcagctactccggaggctgaggcaaaagaatggtgtgaacctgggaggcggagtttgcagtgagccgagattgcgccactgcactccagcctggaggacagagagagactccgtctcaa

SEQ ID NO: 94268 - DNA, 601 bp, Human
cagcaggtgaaggccaagaggagccaacaatttgatgacgagtgtggggaggatgtccgccaggagcacagcctgggacaggagaatagagtgagaccgcagagcttccaggggacaaccctcccaaccacgtggccaaggagaggcaggagctggccaaacaggcctgctacaaacacaggctctggagtcaggcacgcctgggttcaagtctcagctctcccactccttagttgtgtgtcaagagtttatactctctgagcttcagtttcctcatctggaaaatgggaatatcatagcrcctagctcacaggactgctgtgtggcttaaatgagctaatatatggtgcagacagaaaggactcagaaactatatatatatatattttgagagtgagtctcattctgccacccaggctggagtgtagtggctcgatcttggctcactacaacctccacctcctgggttcaagtgattctcctgcctcagcctcctgagtagctgggattacaggcgtgcaccaccatgcctggctaatttttgtatttttagtacagatggggtttcaccatgttggccaggctggtcttgaactcctgg

SEQ ID NO: 94269 - DNA, 601 bp, Human
gggaaggtcggtctctactctcagcatctcagccatcccagcctcccctttctcagctcctgcccaccctgcctcccactaccctcacccagacctgtagggcagcaggtgaaggccaagaggagccaacaatttgatgacgagtgtggggaggatgtccgccaggagcacagcctgggacaggagaatagagtgagaccgcagagcttccaggggacaaccctcccaaccacgtggccaaggagaggcaggagctggccaaacaggcctgctacaaacacaggctctggagtcaggcacrcctgggttcaagtctcagctctcccactccttagttgtgtgtcaagagtttatactctctgagcttcagtttcctcatctggaaaatgggaatatcatagcacctagctcacaggactgctgtgtggcttaaatgagctaatatatggtgcagacagaaaggactcagaaactatatatatatatattttgagagtgagtctcattctgccacccaggctggagtgtagtggctcgatcttggctcactacaacctccacctcctgggttcaagtgattctcctgcctcagcctcctgag

SEQ ID NO: 94270 - DNA, 601 bp, Human
tctttttctgggagacagggtctcgctctattgcctaggctggagtgcagtggcatgaccttggttactgcagccttgacctcatgggttcaagtgatcctcccacctcagcttcccagtagctaagactacaggtgtgcgccactgcacctggctaatttttgtagagatgtgattgtgccatgttgcccaggctggacttgaactaccaagctcaaatgatccacctgcctcagcctcccatagtgctgggattacaggcatgagccacctggcccggcccaatcccaatgcttaaaaaacacacacacacacacacacacacacacacacacgcacacacacacacacacacactacaaaatcttgttcttcgattctttctctcatctctatttcttacaactaccctgaaaaataggtattggccacacccaatttatacatgaggaaattgaggctcagagaggttctgagacctgccctaagtcacacagtggctgagtactgaagctcagttttgcttggctcctgaggctatacattttacatggagctctgctggactttggttccctgtgctaagaaatgatagtgtaca

SEQ ID NO: 94271 - DNA, 601 bp, Human; identical to SEQ ID NO: 38714

SEQ ID NO: 94272 - DNA, 601 bp, Human
ttctccacctgtaaaatggggatgacttgagcacagggtctgcttcacaaggtggtttggagatttacggtatgagttatttatgatatgagttccttaaacctttacaccagggtttatacctagaaatgaactacttttttttttttttttttttttgagacggagttttgctcttattgcccaggctggagtgcaatggtgcgatctcggctcactgcaacctctgcctcccaggttcaacttccacctcctgggttcaagtcattctctggcctcagcctcctgagtagctgggatwacagacgcccgccaccacacccggctaatttttgtatttttagtagagacggggtttcaccatgttggccaggctggtctcaaaactcctgacctcaggtgatccacccgcctcagcctcccaaagtgctgggattacaggcgtgagccaccgtgcccggcctgaaatgaactacttattttaagagctgctactcttactataattcagttggagggcacaactacggaggggaggctgggtcagcccaaggggggcaccccaggtgaatcctagagatctggaaggagtggccccagc

SEQ ID NO: 94273 - DNA, 601 bp, Human
cagcagcaccgccacgttgacagctgaccagaagttgacccgctccaagttgccctcttgcaggttgcggtcacgtgcctcgaaggcccgcagtagcgtgagcatctggatgctgcgctccagccgggtccgcatggtctcaatggactcctacagggcagcgggaggggaagggtcaggcctccctccacccatcagggagcagagaccaaaaaaaccgggggatacggagggaggctgtattaaccctgggaggtacagctgcaaacacagacttgttcaggctaagttcaaatcctcrccctgccactcactggctgtgaccatgagcaacttaattaacctatctgagcctgtttcctcttctataagcttccaaattgctgtgaacatttaatgcctaaataaatgtacaaggatgagcatggtggctcatgcctataatcctagcactttggaaggctgaggtgggaggatcgcttgagcccaggagtttgagaccagcctgggctacatggcaaaaccccatctctacaaaaaattagccaggggtggtgatgtgcaactgcaatcccagctactcaggaggctgaagcaagat

SEQ ID NO: 94274 - DNA, 601 bp, Human
ccacttacctgcacccagggcagcaggtgggaggggagagaaagcgagagttagcaggggcctggggaacagggagtgaccgggagtgagcaggggcttggggaggctgcaccaagtgccctctgggtggaccaaatgacggacagatgggcagtcccatggtgcgtccagcagggtgcagccggtgtgcagggtgagagggcggccagcacgcacgcaggggctcaccatgagcacacggctggcagcgcaggatccccgccctggaccctgctccagcacatcgggggccccgggctgyggaggggagacgagatgaggtggggatgcagttccggtggctgaccccctttaaggctaagttccccctcccagacccccatgtggaaactgacactcaaaggaactcgggaagagtcccgacctagccgtcagctgtctcttctctgctcaccacctccaaatggcctgtccaccgggcctccccacagccccagctgctcccggcctgtgaactcggtccccccactgcagccaaggccgccccccactctgcctgctcccgaggcagagtctgcagtccccgcaatctggcatccct

SEQ ID NO: 94275 - DNA, 601 bp, Human
ctggagggagggaggctgtgcaccccacagaagactgggccccctgggcacaaggggacactggtgctgggttcagcagcccccaggacctgggccaagacgggggtggctgctgcattcacgcaggacgttgagctgcagggactagagtggcagatgggccaggtccactaggccaccccatctccacccccagggccacaagccgctgtgggctccacaggggtgggaaggagtgcagggctggggctcgagtgccgtggcctccacgtaaacgggaacacgctgtgggcgagaaggsggctgagaacaggctggccagctggtgtcctgcccacctcactgcagggccccagcagcccccaggccacagccgccggccacagggcactgcctgggctcaccgtctcttcatctccagcgggatcccagcctctgccaggagggccttgtacatgtcagacttcaggaaccttgggtaggagtcctacaagagacagcgtccagcccctgacccttctgcctcctcacctctcagccagctccacccgaaggagcagccaaacattgctggagcctcctccagccacagagtctccgg

SEQ ID NO: 94276 - DNA, 601 bp, Human
atctaaactcctttgtatctttaaaactttctgccatatcaacaagtttaaaaataattttaaaccaaaatccaaaataaaaactgaacagtccgggtgcggtggctcacacctgtaatcccagtactttgggaggccgaggcaggtagatcatttgaggccaggagttcgagatcagcctggccaacatggcaaaaccccatctctactaaaaaaaaaaaaaaaaaaaaaaaaaattgcagggtgtggtggcacatgccctgtagccccagctacttgggaggctgaggcaggagaatcycttgagcccgggaggtggaggctgcagtgagccgagatcacgccactcaactccagcctgggcgacagagtgagactccgtctcaaaaaataaataaaataaaaacaaaaactgaacattcatgatgatgaaaaatcaaaagtaacctacatgccgtccacaggggaaggcagcagcctgcagccaagggtgaggttgatccctgcttgcaaaggcagacggagctccaaggccgactatgggaaaagggcgccacagaacaattcgtgcgatgaaaaacctcacgcgacgttctctttt

SEQ ID NO: 94277 - DNA, 601 bp, Human
ggctcacgcctgtaatcccagcactttgggaggccaaggcgggcggatcacaaggtcaggagttggagaccagcctggccaacatggtgaaaccccatctctactaaaaataaaaaaaaaaattagctgggcatggtggcgcatgcctgtagtcccagctactcgggaggctgaggcaggagaattgcttgacagggggtcggaggttgcggtgagccgagatcacgccactgcactccagcctggcaagactgcaagactcgtctcaaaaaaaaaaaaaaagaaaaaagaaatacatacrcctgtattgacacagaaggtcctggaaagacacagaaaaatgggaacagtagttacccctatgatggaaactgagggctgggggccaatagtaggaaagaactttcttttcataatctaaactcctttgtatctttaaaactttctgccatatcaacaagtttaaaaataattttaaaccaaaatccaaaataaaaactgaacagtccgggtgcggtggctcacacctgtaatcccagtactttgggaggccgaggcaggtagatcatttgaggccaggagttcgagatcagcctggcca

SEQ ID NO: 94278 - DNA, 601 bp, Human
aatatgttcatctcatggaattcaccgtggccggtaagaaggacaagggtgctcgacaggttctgatctacatcaaagatgcagacatgaagtgaaaacgaaaacaggggcagaacagtgtgtatggtgtgactttgcttgtgcttagaaaaaaaacacaagtgcaggctgggcgcggtggctcacgcctgtaatcccagcactttgggaggccaaggcgggcggatcacaaggtcaggagttggagaccagcctggccaacatggtgaaaccccatctctactaaaaataaaaaaaaaaattagctgggcatggtggcgcatgcctgtagtcccagctactcgggaggctgaggcaggagaattgcttgacagggggtcggaggttgcggtgagccgagatcacgccactgcactccagcctggcaagactgcaagactcgtctcaaaaaaaaaaaaaaagaaaaaagaaatacatacgcctgtattgacacagaaggtcctggaaagacacagaaaaatgggaacagtagttacccctatgatggaaactgagggctgggggccaatagtaggaaagaactttcttttcataatctaaa

SEQ ID NO: 94279 - DNA, 601 bp, Human
ccagcttaatttcaatattgttgtgtctaagggaacagggtggtccaaggagatggaaacagatgggcgaacagccagaatacacacaattattgatgaaacttgctatcttatgtggacatggttcttggtaccccaaaacaatcacaatagtaacataaagatcatgtatcaccgtaacagatacaataataatgaaaaagtttgaaatactgcaagaattaccaaaacaccacccagagacacaaagtgagtatatactgttggaaaaatggtgctgacagacttgctggacacaggkttgccatgaactttcaatttgtagaaaacacaataaagtgaggtaggcccctatgcacatgtacacacacacacacaccccctcacagtgtgggatgacaattaggttggaaaaagcataggcaaaataaaaaaaatttaaatgtacatacaccaagagccttcatatacacaaacaataatactttcccggagtaaaaaaatttaaaaacctagtgatgaatctaagaagagtgcaaaaggcccatgaaaacaatggaaaagctaataagggagaaaaaaatgaattgaagacatatca

SEQ ID NO: 94280 - DNA, 601 bp, Human
ctcggcttcccaaagtgctaggattacaggcatgagccactgtgcctagcgttgtttgtttgtttgttttaagagtcagggtctccctatgttgcccaggctagatttaaactcctgggctcaagcaattttcctgcctacagttcccaggtagctgggagtacaggtgcaggcctggcttggagtaacacttcccatttccttcaagagcttttcctttgcatttaccatttggctgttttgtgcaagcagactagcttttggcctagttcagctttcaacatgccttcctcaagaagcytaatcatttctagcttttgatttaatgtgagaaacatgtgattctttatttcacttgaacccttagaggccactgtagataaccagcttaatttcaatattgttgtgtctaagggaacagggtggtccaaggagatggaaacagatgggcgaacagccagaatacacacaattattgatgaaacttgctatcttatgtggacatggttcttggtaccccaaaacaatcacaatagtaacataaagatcatgtatcaccgtaacagatacaataataatgaaaaagtttgaaatactgcaa

SEQ ID NO: 94281 - DNA, 601 bp, Human
caaagtgcttggattacaggcataagccacgacatctggcctatttcagttaacttcaatttaaatggccacactggccagtgtttgtaatagtgagcagcacggctgtgtcctcacttttctaaggcaggccacgaccactcacaagtcactgtgtagcctgttaatactgtttcagtctggtaaactgaagctctggtttcagaaagaaaagcacttttgggaacaacagtcaaagacacgggccgggcgcggtggctcacgcctgtaatcccagcactttgggaggccgaggctggtrgatcacaaggtcaggagatcgagaccgtcctggctaacacggtgaaaccccatctctactaaaaatagaaaaaattagccgggcgtggtggcagtcgcctgtagtcccagctactccggaggctgaggcaggagaatggtgtgaacccgggaggcggagcctgcagtgagctgagatcgcgccactgcactccagcctgggtgacagagcgagactccgtctcaaaaaaaaaaaaatcaaagacacagagagtggatttgatgcactttcactgccttgctccaggaacatgctctgagc

SEQ ID NO: 94282 - DNA, 601 bp, Human
taattttttgtatttttggtagagacaggacttcgtcatattacccatgctggtctcgaactccggagctcaagcgatctgcctacctcagtctcccaaagtgctgggattacaggcatgggccaatgcgcccagccctgaaccatatcttgatgatgcacctcaaaaaactagccccctctctaagacagcactgtccaatttttttttttttttttttttttttgagacagggtctcactctgtcactcaaggctcaggctggagtacagcggcatgatctcggctcactgcaagctccatgtcctgggctccctcagcctccgcagtggctgggactaagggcgcaggtcaccaacccagctaatttttgtattttttgtagagatggggtttcgtcatgctgtccagactgttctcaaacatctggcctcaagtgatccccccgccttggacacccaaagtggtgggattacaggcatgagctaccgctcccggccccaaaagaactttctactgtgatgggaatattccaaatctgaaccatttaatatggtagacactatttccatatagacattgagcacctgaaatgtgacca

SEQ ID NO: 94283 - DNA, 601 bp, Human
ttaaacatgagcaccatggcccctaatacccagggaacactacatcttttctgaccttggtttcaagtcttagagacactggacaatatccattttcttttctcataattgaattatagaaaaggattataaaaaataaataagagttaatctctataacctgaatcatatcttaaattgtttctgagaggggggtctcactctgtcacccaagttggagtgcagcaatgtgatcttggcttgtggcaatctctgcctcccaggctcaagcaatcctctcacctcagcctcctgagtagcwgagaccacaggcgtgtgccaccatgccaggctaattttttgtatttttggtagagacaggacttcgtcatattacccatgctggtctcgaactccggagctcaagcgatctgcctacctcagtctcccaaagtgctgggattacaggcatgggccaatgcgcccagccctgaaccatatcttgatgatgcacctcaaaaaactagccccctctctaagacagcactgtccaatttttttttttttttttttttttttgagacagggtctcactctgtcactcaaggctcaggctggagta

SEQ ID NO: 94284 - DNA, 601 bp, Human
tggcctaagcactgctcgcagtttcaaagaagggagcaggaagacggtgtccacacagagagggacatgcccacaccagcctttctgagggacaccaggctatctctcagacctggcttgatggcttctgcccctaccagtggtggggacacacggtacatttaaacatgagcaccatggcccctaatacccagggaacactacatcttttctgaccttggtttcaagtcttagagacactggacaatatccattttcttttctcataattgaattatagaaaaggattataaaaaataartaagagttaatctctataacctgaatcatatcttaaattgtttctgagaggggggtctcactctgtcacccaagttggagtgcagcaatgtgatcttggcttgtggcaatctctgcctcccaggctcaagcaatcctctcacctcagcctcctgagtagctgagaccacaggcgtgtgccaccatgccaggctaattttttgtatttttggtagagacaggacttcgtcatattacccatgctggtctcgaactccggagctcaagcgatctgcctacctcagtctcccaaagtgctggg

SEQ ID NO: 94285 - DNA, 601 bp, Human
gggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgtgccattgcaccccagcctgggcaacaagaatgaaactacgtctcaaaataataataataataataattaataataataataataataatatgatttcagagcattttgaaaatgaaagaaatcagttcttctctaaacctctagctccccattctctgaggtagtggcctaagcactgctcgcagtttcaaagaagggagcaggaagacggtgtccacacagagagggacatgcccacaccagcctttctgagggacaccaggctatctctcagacctggcttgatggcttctgcccctaccagtggtggggacacacggtacatttaaacatgagcaccatggcccctaatacccagggaacactacatc

SEQ ID NO: 94286 - DNA, 601 bp, Human
ggtgggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgtgccattgcaccccagcctgggcaacaagaatgaaactacgtctcaaaataataataataataataattaataataataataataataatatgatttcagagcattttgaaaatgaaagaaatcagttcttctctaaacctctagctccccattctctgaggtagtggcctaagcactgctcgcagtttcaaagaagggagcaggaagacggtgtccacacagagagggacatgcccacaccagcctttctgagggacaccaggctatctctcagacctggcttgatggcttctgcccctaccagtggtggggacacacggtacatttaaacatgagcaccatggcccctaatacccagggaacactac

SEQ ID NO: 94287 - DNA, 601 bp, Human
attaaaggcagagctggtagctgggtgagggggctcatgcgtgtaatcccagaacattgggaggccaaggtgggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgygccattgcaccccagcctgggcaacaagaatgaaactacgtctcaaaataataataataataataattaataataataataataataatatgatttcagagcattttgaaaatgaaagaaatcagttcttctctaaacctctagctccccattctctgaggtagtggcctaagcactgctcgcagtttcaaagaagggagcaggaagacggtgtccacacagagagggacatgcccacaccagcctttctgagggacaccaggctatctctcagacctggcttgatggcttctgccccta

SEQ ID NO: 94288 - DNA, 601 bp, Human
tctggcctaggcccaagtgcagccacaagttgggtacactgctacaaaagtggccaagcctgaggacagtagcagtgccacctgattccccaagatgtcacctgagaattaaaggcagagctggtagctgggtgagggggctcatgcgtgtaatcccagaacattgggaggccaaggtgggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgtgccattgcaccccagcctgggcaacaagaatgaaactacgtctcaaaataataataataataataattaataataataataataataatatgatttcagagcattttgaaaatgaaagaaatcagttcttctctaaacctctagctccccattctctgaggtagtggcctaagcactgctcgcagtttcaaag

SEQ ID NO: 94289 - DNA, 601 bp, Human
aagctaatagaggcaaacctaacaagagaggccctggcagagcctcatgtgtgcctggtgggaggacctgtatgttgtgagctagagagtgcctgcctggccaaggaccccatctggcctaggcccaagtgcagccacaagttgggtacactgctacaaaagtggccaagcctgaggacagtagcagtgccacctgattccccaagatgtcacctgagaattaaaggcagagctggtagctgggtgagggggctcatgcgtgtaatcccagaacattgggaggccaaggtgggaggatcayttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgtgccattgcaccccagcctgggcaacaagaatgaaactacgtctcaaaataataataataataataattaataataataata

SEQ ID NO: 94290 - DNA, 601 bp, Human
ctgagtccggcaatgctccatttcctgacaggagcattttacagacttgcgtctgcccctctgagggaggcagggccatcagctaacactcagagacaaggatggtcctacaacatcctgatctgggaggaagaggtgaaggcaactcaccaccctcaggcatcttaacagaaaacagtggaactaaggctcattctaaagaatgtgcccaagatcacacaccgaaggctgcaaagcgagagtcaaacttggaaccctgaacctgcacttgtccctttacactgccctgcagcatggatgygatggctgggcagagggaagtgcccaagcctggggacaaaaatgcctacctgctttcttgtgtgtcaacctcagctacagaaaggagagggcatctttctaacacatcagtgtagggctctaaaaacacaagctaatagaggcaaacctaacaagagaggccctggcagagcctcatgtgtgcctggtgggaggacctgtatgttgtgagctagagagtgcctgcctggccaaggaccccatctggcctaggcccaagtgcagccacaagttgggtacactgctacaaaagtggccaagc

SEQ ID NO: 94291 - DNA, 601 bp, Human
tctgagtccggcaatgctccatttcctgacaggagcattttacagacttgcgtctgcccctctgagggaggcagggccatcagctaacactcagagacaaggatggtcctacaacatcctgatctgggaggaagaggtgaaggcaactcaccaccctcaggcatcttaacagaaaacagtggaactaaggctcattctaaagaatgtgcccaagatcacacaccgaaggctgcaaagcgagagtcaaacttggaaccctgaacctgcacttgtccctttacactgccctgcagcatggatrcgatggctgggcagagggaagtgcccaagcctggggacaaaaatgcctacctgctttcttgtgtgtcaacctcagctacagaaaggagagggcatctttctaacacatcagtgtagggctctaaaaacacaagctaatagaggcaaacctaacaagagaggccctggcagagcctcatgtgtgcctggtgggaggacctgtatgttgtgagctagagagtgcctgcctggccaaggaccccatctggcctaggcccaagtgcagccacaagttgggtacactgctacaaaagtggccaag

SEQ ID NO: 94292 - DNA, 601 bp, Human
gctccaattcttgagatactgtgactgccagcacacctgacttccctaagcctctgcctggagcaataaagtggtcatggtggatccatatatatttgtcagaaaacatctgggcttttgcactacctgagttgagatttttagaaacagtttaggagtttactttctggctaggcacgatggctcacgcctgtaatcctagcactttgggaggccgaggtgggtggatcgcttgaggtcaggagttcgagaccagcctggccaacatggcgaaaccctgtctctacttaaaaagaaaaamttagctcaccttggtggtggatgcctgtaatcccagctactcgggaggctgaggcaggagaatcgcttgaaccctagaggtgaggttgcagcaagccgagatcacaccactgcactccagccttgggcgacagagtgaaactttgtctcaaaaaaaaaaaaaaaaaaaaacctttattttcctctgcagatatttgagttctgggacacactgctttccatgtattctggaaagagaaaggagacctgaatccaggagtggaaacattgtgggagctctgccaaagatccacagaaggga

SEQ ID NO: 94293 - DNA, 601 bp, Human
tcctgcctcggcctcccaaagtactgggattacaggcgtgagccactgcacccagcctaaaactaatctttgtggtaaaagttttctcatctgcatgacaagaaatcgcctaccgaggatcacataagactcccagaggcaaaagccttctgaaaactatagcgtgtcatatgaatttcaccagctccaattcttgagatactgtgactgccagcacacctgacttccctaagcctctgcctggagcaataaagtggtcatggtggatccatatatatttgtcagaaaacatctgggcttytgcactacctgagttgagatttttagaaacagtttaggagtttactttctggctaggcacgatggctcacgcctgtaatcctagcactttgggaggccgaggtgggtggatcgcttgaggtcaggagttcgagaccagcctggccaacatggcgaaaccctgtctctacttaaaaagaaaaaattagctcaccttggtggtggatgcctgtaatcccagctactcgggaggctgaggcaggagaatcgcttgaaccctagaggtgaggttgcagcaagccgagatcacaccactgcactc

SEQ ID NO: 94294 - DNA, 601 bp, Human
cagtgagaaacagggtcacacactccccacgctgagaaacagggtcacacgctccccacactcaacgcttaccatggggttttctcactaaaagtcaaattctcacacagaagtacaggctgggcaggaacaaaagtcatttttcagaagtaagcacaaggctggcagagctgggtcagacccagcaccatatgtattagccggatgcctgtgcagaagtatctcatcttttcttttctttttttttttccttttttcttttttttcttcaaaagagacagggtctcacaatgctactcargctggtctcatactcctggggtcaagcaatcctcctgcctcggcctcccaaagtactgggattacaggcgtgagccactgcacccagcctaaaactaatctttgtggtaaaagttttctcatctgcatgacaagaaatcgcctaccgaggatcacataagactcccagaggcaaaagccttctgaaaactatagcgtgtcatatgaatttcaccagctccaattcttgagatactgtgactgccagcacacctgacttccctaagcctctgcctggagcaataaagtggtcatggtggat

SEQ ID NO: 94295 - DNA, 601 bp, Human
gcggctttttcttttcccccttgagatggagtcttgctctgtcgcccaggctggagtgtaatggcgcaatctcggctcactgaaacctccgcctcttgggttcaagcgattctactgcctcagcctcccaaatatctgggattacaggcgcgtgccaccaagcccggctaatttttcatattttttagtagagacaaggtttcaccacgttggccaggctggtctcgacctcctgacctcatgatctgcccacctcggcctcccaaagtgctgggatgacaggcatgagccactgcacccmtctggctttatactttatatagtctgtctggtaatgtaatacacataaagacagagttatattcatgagattgggggtggggcaaaacttataaacagcaaactgaaccataaacaagtgttgttttgttttattggcttccaacatttatgaaaatccttttccctcattttgatggtgaaaggcctaataaatgtactgcagcacaataaaacatctgttacaaaaactgaagattcctggaataacttggaaattcaagaaaaacacatttaggaagatgaaccagcccagccagaa

SEQ ID NO: 94296 - DNA, 601 bp, Human
ctgcctggggagatctggataagggagtgtcacctgcaggggtgctgtgggtggtgctgactcttatctcagagtccagggctctgagggcctccgctctagaaacacaaatgtactacctctgatctggacccagaagagagagaagtcccatacatatctctccacccaggaaaaatatatctaatatctaggtcaggagggtgcactctcttggggaagctctagcctccgcagggccatactctgcccctgggcagggagacccctaaggtcctagaagagaccactgaggacagayattctagggtgcaaacctggtcatgcttcttccccagaggccctcttggtgaagggatgggagagactgacataactcctccatgttgtgatgaaaaaggaaggcctgctttgaactgcactgtagctcagctctgtaatagcaaatggcaagtagctacatgattctttccaagtctatcatgggctgtggggctcagactgttttccagccttcctcctgaactggcacgaccctctaaccatccgaagtcaccctaggctcacaaacaaaccacatacgagggtttggtcaaaccta

SEQ ID NO: 94297 - DNA, 601 bp, Human
tgcgtgcagagcgctgacttccttcctcatagcatggctgcccatccgttcccttatcccaaacacttaaactttccggtttttatcagggaagaagctttgtgcaagatgtgcaagcccactgtgatcacagctatttccaaatggcagaaataccaggttgcacacaactgggtgccacggagaagtgggtgcagctgtggtgtgggagggagggcatcccttttccccttttcaaggtcatctgtgcccttctgtctccttactggcaatgctgatgcctcctgcctggggagatctrgataagggagtgtcacctgcaggggtgctgtgggtggtgctgactcttatctcagagtccagggctctgagggcctccgctctagaaacacaaatgtactacctctgatctggacccagaagagagagaagtcccatacatatctctccacccaggaaaaatatatctaatatctaggtcaggagggtgcactctcttggggaagctctagcctccgcagggccatactctgcccctgggcagggagacccctaaggtcctagaagagaccactgaggacagatattctagggtgcaaac

SEQ ID NO: 94298 - DNA, 601 bp, Human
gaaggggagggccacagtcagtagagacctagaatgcagactgtaaaagctagggacagggactgaagcacctgtcttcaggggcaagaacacctgtctctttttctactggactctctgggtttatgaagatgcacagttcataccaagtgtctaatcaggtctcctgcccagtaccttcaccagagctggtgtcagcctcagttctgagccccccagagccagaatggaccaggcctgccggcccagggagagccacatctgcccagagggtctgtgcatgcccagggagaaccccacmtgcccaaggacagacgcatctgcccaggggaagccacacctgcccagggggagccacaccttcccagagggtctgtacctgcccaggggaagccacatctgcccaggggaagccaaatctacccagggggagccccacctgcccaaggagagccacacctgcccaggggaagccacacctgcccaaggagagccacacctgcccaaggagagccacacctgcccaaggagagccacatctgcccagggagagccccacctgcccagggagagccatacctgccccagagcatgctgtagc

SEQ ID NO: 94299 - DNA, 601 bp, Human
aaaaataagtgctaaataatactaatattagctactagagtgtcttgtaataaataagaggaaatgcttgcaccacactgtagaaaattcaagggtttcacgatgctagttaactcactatcttggcctcccctggaaacagacatcctacatatgaaggggagggccacagtcagtagagacctagaatgcagactgtaaaagctagggacagggactgaagcacctgtcttcaggggcaagaacacctgtctctttttctactggactctctgggtttatgaagatgcacagttcatascaagtgtctaatcaggtctcctgcccagtaccttcaccagagctggtgtcagcctcagttctgagccccccagagccagaatggaccaggcctgccggcccagggagagccacatctgcccagagggtctgtgcatgcccagggagaaccccacctgcccaaggacagacgcatctgcccaggggaagccacacctgcccagggggagccacaccttcccagagggtctgtacctgcccaggggaagccacatctgcccaggggaagccaaatctacccagggggagccccacctgccca

SEQ ID NO: 94300 - DNA, 601 bp, Human
ccagggggagttggggccccaggctgccctggcacccatcccctacccctgactgccactcctgtctacagggtgtgaccgcgggcaggctgccaactctccccttcattgcctacaggtaggggactgtgccccagctgtggaggctgtgatgagaagggagggtgcggtacaggggaccaggctcatcaaccgcctcagaaactccttccatggaggttcacgaataacaccacagaacctcccagaattgctggatctgtataaatgtagctaaatcctacgttactgtgttcgacccttcagaatcttagtaatgccatcactgatcctgcctgtatgcagagagctgactggcaggctctggtgtacaagttcccttcatcctgctaacaagatgagttcctcagtgctatgacacctattcatcaagagaacatatagagagggtttagcagaaaaataagtgctaaataatactaatattagctactagagtgtcttgtaataaataagaggaaatgcttgcaccacactgtagaaaattcaagggtttcacgatgctagttaactcactatcttggcctcccctggaaacaga

SEQ ID NO: 94301 - DNA, 601 bp, Human
tcacgagttcaagaccagcatggccaacatggcgagacccccccccccccaccgatctctactaaaaatacaaaaattagctgggcgtggtggcgcacacctgtaatcccagctactcgggaggctgaggcaggagactcacttgagcttgggaggcaggggttgcattgagccaagattgcgctactacactccagcctgggtgacacagcgagattctgtctcaaaaaaaaaaagagaataactgctaatgggtatggggtttccttctggggtggtgaaagtgttctggatctagatrgtggtgatggttatacaacatgaatgtaccagatgccactgaagcatagacttcaaaatgacaaatagtgttatgtgtattttaccaaaacaaaaaggggtaaacaatgaagtgcagtctgcctgcaccccaggaggggccagcccgctgcagtccaagctccgagtcaatgacacgctcgttggaaaaaaagagctgcttctccactggccccactccctgatcttaaccatttatataaacactcaccctcagtgcaaacaccacattaaaaagaatcatagtaggtgcttccctctt

SEQ ID NO: 94302 - DNA, 601 bp, Human
ggcacagtggctcacgcctgtaatcccagcagtctgggaggccaaggtgggtggatcacctaaggtcacgagttcaagaccagcatggccaacatggcgagacccccccccccccaccgatctctactaaaaatacaaaaattagctgggcgtggtggcgcacacctgtaatcccagctactcgggaggctgaggcaggagactcacttgagcttgggaggcaggggttgcattgagccaagattgcgctactacactccagcctgggtgacacagcgagattctgtctcaaaaaaaaaaagagaataactgctaatgggtatggggtttccttctggggtggtgaaagtgttctggatctagatagtggtgatggttatacaacatgaatgtaccagatgccactgaagcatagacttcaaaatgacaaatagtgttatgtgtattttaccaaaacaaaaaggggtaaacaatgaagtgcagtctgcctgcaccccaggaggggccagcccgctgcagtccaagctccgagtcaatgacacgctcgttggaaaaaaagagctgcttctccactggccccactccctgatcttaaccattt

SEQ ID NO: 94303 - DNA, 601 bp, Human
aaatacaaaaattagcaggggcagggcacagtggctcacgcctgtaatcccagcagtctgggaggccaaggtgggtggatcacctaaggtcacgagttcaagaccagcatggccaacatggcgagacccccccccccccaccgatctctactaaaaatacaaaaattagctgggcgtggtggcgcacacctgtaatcccagctactcgggaggctgaggcaggagactcacttgagcttgggaggcaggggttgcattgagccaagattgcgctactacactccagcctgggtgacacagygagattctgtctcaaaaaaaaaaagagaataactgctaatgggtatggggtttccttctggggtggtgaaagtgttctggatctagatagtggtgatggttatacaacatgaatgtaccagatgccactgaagcatagacttcaaaatgacaaatagtgttatgtgtattttaccaaaacaaaaaggggtaaacaatgaagtgcagtctgcctgcaccccaggaggggccagcccgctgcagtccaagctccgagtcaatgacacgctcgttggaaaaaaagagctgcttctccactggc

SEQ ID NO: 94304 - DNA, 601 bp, Human
atttatcaacaaggcaggcctgtcttaaaaattaagctccagctgggcatagtggctcacacctggaatcccagcactttgggtggccaaggagggaagaccatttgagaccaggagttcaagatcagccagggcaataaggtgaaaactcatctctacaaaaaatacaaaaattagcaggggcagggcacagtggctcacgcctgtaatcccagcagtctgggaggccaaggtgggtggatcacctaaggtcacgagttcaagaccagcatggccaacatggcgagacccccccccccccaccgatctctactaaaaatacaaaaattagctgggcgtggtggcgcacacctgtaatcccagctactcgggaggctgaggcaggagactcacttgagcttgggaggcaggggttgcattgagccaagattgcgctactacactccagcctgggtgacacagcgagattctgtctcaaaaaaaaaaagagaataactgctaatgggtatggggtttccttctggggtggtgaaagtgttctggatctagatagtggtgatggttatacaacatgaatgtaccagatgccactgaagcatag

SEQ ID NO: 94305 - DNA, 601 bp, Human
cctgttgctttttttttttttgagctggagtttcgctcttgttgcccagattggagtgcaatggtgcgatctctgctcactgcaacctccgcctcccggattcaaccgattctactgcctcagcctcctgagtagctggaattacaggtgtccaccaccacacctggctaattttgtattttttagtagagacggggtatctccatgctggtcagcctgctctcaaactcctgatctcaggtgatccgcccgcttcagcctcccaaagtgctgggattacaggcgtaagccattgtgctcrgctccggttgcttttacctgtccgtaatcaatctatacttctccaggttctggtctgatctccatttctcacccttgatggcaagaggatgggccagtgtataataatcaccacattgtttaatcactccccaactactacacactatgattatctccagtttaattattgttataaaaatctttattcttgctgagaacaagcctgggggaaatctttacgcagttgtaaaagttgcttgtttttcttgataatactcctaacagtgggactgctagatctaagggcatcatatgctat

SEQ ID NO: 94306 - DNA, 601 bp, Human
tgaccttccaggctcaggtgatcctcccacctcagcctcccaggtagctgggactacaggcgcacatcatcatgcctggctaatttttgtattttttgtagagatggggtttcgctatgttgcccaggctggtgtcaaactcctgggctcaagtgatccacccaccttggcctcccgaagtgctaggaatacaggagtgagccactgtgcctggacaaaagtgtatattttaaaaagaaagaatatatatttaaaatgacaaaagtgtatattttaaaaagaaagaatatatatttaaaaygacaaaagtatatattttaaaaagaaagacttgtccacccaaaaaatacaaactctttacattatcaaaatttctcctactcgtcaatatcacggccagctgaagtcctagactatcttgtttcctgttgctttttttttttttgagctggagtttcgctcttgttgcccagattggagtgcaatggtgcgatctctgctcactgcaacctccgcctcccggattcaaccgattctactgcctcagcctcctgagtagctggaattacaggtgtccaccaccacacctggctaattttgt

SEQ ID NO: 94307 - DNA, 601 bp, Human
agtcacactggttaacaagaaaaccagcaggctccaggcccatatctctgcccaagagctccttctgcaaccatgatgactgggtcaaaggacagtgcaggaggctctcaggaacaagaggggccctcgaccctctggaacctatcagggaccacagtcagccaggcaagcacatctgcccaagccaagggtggaggcatgcagctgtgggggtctgtgaaaacacttgagagagcagataactgggccaaccatgactcagtgcttctggaggccaacaggactgctgagtcatcctgtrggggtggaggtgggacaagggaaaggggtgaatggtactgctgattacaacctctggtgctgcctccccctcctgtttatctgagagggaaggccatgcccaaagtgttcacagccaggcttcaggggcaaagcctgacccagacagtaaatacgttcttcatctggagctgaagaaattctctatattctcatcagatcccatgttcacaaacagaactcacacctggatggacttacaacaaggcagcatcccttgccagagaaaggactgttgctcccatgctgtgcccaccactgg

SEQ ID NO: 94308 - DNA, 601 bp, Human
gagaggcaccaggccaattgttcactgaatacttttggtcctgaaggatgagaagctcttcccagcagaagtcacactggttaacaagaaaaccagcaggctccaggcccatatctctgcccaagagctccttctgcaaccatgatgactgggtcaaaggacagtgcaggaggctctcaggaacaagaggggccctcgaccctctggaacctatcagggaccacagtcagccaggcaagcacatctgcccaagccaagggtggaggcatgcagctgtgggggtctgtgaaaacacttgagrgagcagataactgggccaaccatgactcagtgcttctggaggccaacaggactgctgagtcatcctgtaggggtggaggtgggacaagggaaaggggtgaatggtactgctgattacaacctctggtgctgcctccccctcctgtttatctgagagggaaggccatgcccaaagtgttcacagccaggcttcaggggcaaagcctgacccagacagtaaatacgttcttcatctggagctgaagaaattctctatattctcatcagatcccatgttcacaaacagaactcacacctggat

SEQ ID NO: 94309 - DNA, 601 bp, Human
cccagcctcacccactgagcctcaatttcctcttgagtgactggagtcagtgacacccacctagtgaaggtggcccagcacttggtgttgcgtcatgctcagtaaaatggcattttgcatctgtttgatttaaaaacactttcggactctcatgtataacttcgggctcgttttctgttttaagaggagtctggaggtggtggttccagcagagtgcatgctactcagcaaaggggtttaaaaaagcaaaggtactcaggggtttgtacctctgtcccaccagcaacacacgagatgcctmttcccccgagctttgccaacatcgagtctcgtgaaattgtggatcttaaccagtataacaggtggggaatgggatctctgtgtagctttattgtgatgcactgatgcatctcttcacatgtttgaaccacctgtcttttctgtgagctcactgctcagatcccttgttcattcttctattgggaaatataagtccttaaacataggagagtgatttgtcttttgtgatgtaagttccagcagagtgcaccctactcagcaaaccatttaaaaaacagccactggccgggcacggtggctc

SEQ ID NO: 94310 - DNA, 601 bp, Human
acccgcctcagcctggcaaagtgttgggatcacaggtgtgagccaccgcgcccggccttttttttttcatttttgatacgcggtctggctctgttgctggggccagagtacaatggtacaaccatggctcaccataatcttgatttcctaggcttaagtgaccctcccacctcagcctcctgagtagctgagactacacttgtgccaccacactcagatattttttaaaaattttttgtagaaatgcgatctcacattgttgttcaggctgatcttgcacttctgacctcaagaaatccgsccctcagcctcccaaagtgctgggattacaggcgtgagtcaccacgcccggcctgcttgtccacatttaataaaggtgatgctcagccaatacaatcagaacaactgtgaggttttcatggtatcctcaaggcttgctgccctcacacagtcagtgtcgcaaaccccaactctctcagagtgagaggagacagctggccccagcctcacccactgagcctcaatttcctcttgagtgactggagtcagtgacacccacctagtgaaggtggcccagcacttggtgttgcgtcatgctcag

SEQ ID NO: 94311 - DNA, 601 bp, Human
cacccgcctcagcctggcaaagtgttgggatcacaggtgtgagccaccgcgcccggccttttttttttcatttttgatacgcggtctggctctgttgctggggccagagtacaatggtacaaccatggctcaccataatcttgatttcctaggcttaagtgaccctcccacctcagcctcctgagtagctgagactacacttgtgccaccacactcagatattttttaaaaattttttgtagaaatgcgatctcacattgttgttcaggctgatcttgcacttctgacctcaagaaatccrcccctcagcctcccaaagtgctgggattacaggcgtgagtcaccacgcccggcctgcttgtccacatttaataaaggtgatgctcagccaatacaatcagaacaactgtgaggttttcatggtatcctcaaggcttgctgccctcacacagtcagtgtcgcaaaccccaactctctcagagtgagaggagacagctggccccagcctcacccactgagcctcaatttcctcttgagtgactggagtcagtgacacccacctagtgaaggtggcccagcacttggtgttgcgtcatgctca

SEQ ID NO: 94312 - DNA, 601 bp, Human
gagtgcagtggcgccatctcagctcactgcaacctctgcctcctagatttaagtgattcttctgcctcagcctcctgagtagctgggactacaggcatgcaccaccacgcccggctaattttttgtatttttagtagacagcgggtttcaccatgttagccaggctggtctcgaactcctgacctcgtgctccacccgcctcagcctggcaaagtgttgggatcacaggtgtgagccaccgcgcccggccttttttttttcatttttgatacgcggtctggctctgttgctggggccagartacaatggtacaaccatggctcaccataatcttgatttcctaggcttaagtgaccctcccacctcagcctcctgagtagctgagactacacttgtgccaccacactcagatattttttaaaaattttttgtagaaatgcgatctcacattgttgttcaggctgatcttgcacttctgacctcaagaaatccgcccctcagcctcccaaagtgctgggattacaggcgtgagtcaccacgcccggcctgcttgtccacatttaataaaggtgatgctcagccaatacaatcagaacaactg

SEQ ID NO: 94313 - DNA, 601 bp, Human
actcgatgttggcaaagctcgggggaagaggcatctcgtgtgttgctggtgggacagaggtacaaacccccgagaaggaaacacaacattacaaatgccattttccctattagtaatgcctttaggaatttatcttatagatacagaggcgcacatacaaaataacacaggtaaatggttagcactggaaggctggaacaaactcaatggtgggggcagttgcggctcactaggcagccaaaaaaagaattaaaaagtattttttaaattttatttattttttattttacttttgttttttaatttttattattattattatttttgagatgacatctagttctgtcacccaggctggagtgcagtggcgccatctcagctcactgcaacctctgcctcctagatttaagtgattcttctgcctcagcctcctgagtagctgggactacaggcatgcaccaccacgcccggctaattttttgtatttttagtagacagcgggtttcaccatgttagccaggctggtctcgaactcctgacctcgtgctccacccgcctcagcctggcaaagtgttgggatcacaggtgtgagccaccgcgc

SEQ ID NO: 94314 - DNA, 601 bp, Human
cacgagactcgatgttggcaaagctcgggggaagaggcatctcgtgtgttgctggtgggacagaggtacaaacccccgagaaggaaacacaacattacaaatgccattttccctattagtaatgcctttaggaatttatcttatagatacagaggcgcacatacaaaataacacaggtaaatggttagcactggaaggctggaacaaactcaatggtgggggcagttgcggctcactaggcagccaaaaaaagaattaaaaagtattttttaaattttatttattttttattttacttttkttttttaatttttattattattattatttttgagatgacatctagttctgtcacccaggctggagtgcagtggcgccatctcagctcactgcaacctctgcctcctagatttaagtgattcttctgcctcagcctcctgagtagctgggactacaggcatgcaccaccacgcccggctaattttttgtatttttagtagacagcgggtttcaccatgttagccaggctggtctcgaactcctgacctcgtgctccacccgcctcagcctggcaaagtgttgggatcacaggtgtgagcca

SEQ ID NO: 94315 - DNA, 601 bp, Human
tcacactccatggaatctacactgctgttattcccacccacacattccgtcgacccctagcggatgagctgtgctcctccacaggctgagtgtaggggctgtgttgcagaaagtgaagagacatccctgccctcctgggagacacaattcaatggtcatatgaatgagtgacatgctgtcactgagggccactgggatccacagggagacacaagtgctaggtctggcacaagtgttggggtggcctcctgagcgattcacattcccagcctatattcacagatgttaggtcctgcaggasagggccaccaggctattcagccacaccataaccctagctttaattaaaatagcaactggggaccggacgtggtggctcacgcctgtagtcctagcactttgggaggtcgaggttggcagatcacgaggtcaggagttcaagaccaggctggccaacatggtgaaactccatctctactaaaaatacaaaaattagccaggcctggtggcaggcgccgtaatcccagctgctcaggaggctgaggcaggagaatcacttaagcccgggagacggaggttgcagtgaactgagattgtgcca

SEQ ID NO: 94316 - DNA, 601 bp, Human
gtcatgtggtctggtttgtacactggcatggggccctctcctctggcagagacacgccatgttggttcctctaacttccacgtggactttactccattttcccaagcatcagctcacccacctgctgctttctccctcagagcactctgcactgaggctggtgcttctttatgaactaacccagctccctagagcggtgacaagtgctgccaccaggagtgccccaaaggccatggcagacctgggcaaattccctgaacatgtcagagggatgactgctctggaaaggtgccggcccaayctccagcctgtaaatcccccacagtaagagggtaagccaggagctgcactgaggtctgttaacaaggggaaagagaaaggtttgtcactgtttttaagtctgcagctttaagacaagagcccttagcacaagcagggtttgggccctgaaaggtttcctgccgagcttgcacttctatttgcaaggtgtttaatggtttggtctgaaaacactctggaggaaaacactgtcctcctcaagacttatccagcccctcacacagctctgggccagccaagagggcccagcccagtctgtgac

SEQ ID NO: 94317 - DNA, 601 bp, Human
tggagagagttatagggaaaggaacaggggcttggaacacacctcatggaaagccaggaacaagttccagctatgggtatggagaaatgagggcaggagggtcacatgaaggttcttctagtgacttcccagcttggtcatctctgctgccctcaccgtgtcagctgtccttggagccgcagtcatgtggtctggtttgtacactggcatggggccctctcctctggcagagacacgccatgttggttcctctaacttccacgtggactttactccattttcccaagcatcagctcacccmcctgctgctttctccctcagagcactctgcactgaggctggtgcttctttatgaactaacccagctccctagagcggtgacaagtgctgccaccaggagtgccccaaaggccatggcagacctgggcaaattccctgaacatgtcagagggatgactgctctggaaaggtgccggcccaacctccagcctgtaaatcccccacagtaagagggtaagccaggagctgcactgaggtctgttaacaaggggaaagagaaaggtttgtcactgtttttaagtctgcagctttaagacaagag

SEQ ID NO: 94318 - DNA, 601 bp, Human
gcgtgagccaccgcaccccacccaaggcctttctgtttctgtcctatttaggatgcagctcaaagtggctgttgggacaccacagaatcagaatacggaggctcctattgtttcaaatgtagctgtctttgctccatctaggagcacagtgaggccttatgacatgtgctgtggctcccagcaccagtttaggtacttggagtgcagcagggaagaaaataacttggctgctctgcacgctgggggcttcactcagcggcatctagacagacacataattggccgggcgtggcggctcacrcctgtaatcccaaaacctgggaggccgaggcaggccgatcacttgaggtcaggagttcgagaccagcctggccaacatggtgaaaccctgtctctactaaaaatacaaatattaggccgggtgccgtggctcacacctgtaatcccagcactttgggaggctgagatgggcagatcacctgaggtcagaagtttgagaccagactgaccaacagggagaaaccccgtctctattaaaagtacaaaattagctgggcgtggtggtgcatgcctgtaatcccagctacttggaaggctgagg

SEQ ID NO: 94319 - DNA, 601 bp, Human
ttgttttcaccaggagcttctaaaactccctgatggagaagccagggcgccacccaactccaccgctcaccacaaagcgcccttgccttaagtaagagccaacagcacttgttctatgacacagaggagatgcaactgctcaagcaaagctgtctgcagctggccttcaccgcatccccggaggctccaggcaacaggggggatctccacctactcttgtcaaggcctggctactcaaagtggccggcaccttccttgtgtcctgcacagggaacgcagcctgtgaagcctcacaatgacwccagttctaaaataggagcaaaacacacacaagttcttctccaaactgcccatttctacagcacctccccgcatcatgtttcctctgttcactgccccactgcccaggagagcagccaactagtgcttttcccatcaccccctgaccctattctgctattctcagctcccagttggcgggacaggccaacacacccacatccggctaagtccgggagacttggccagacttctggctgccccaggccagaaggtacaaacggcccctcggacgtctcttaggacacgtcaatacggggtg

SEQ ID NO: 94320 - DNA, 601 bp, Human
taatgctgtctccccaaccagaactcactcctgaggaggggggcttgtgggtttcattctctgctctctacacattgtaaaacgtgtcaggcacataggcacggagctgcatttcctgaatgaagccaaggaacacaccgccctccctgcatgcactgtctttcctaggaagccctgccccaagaacaggctccacagtggggatgcagcccacgtcatcccctcggggaaccacacaaaacaaggaaggagttgttttcaccaggagcttctaaaactccctgatggagaagccagggcrccacccaactccaccgctcaccacaaagcgcccttgccttaagtaagagccaacagcacttgttctatgacacagaggagatgcaactgctcaagcaaagctgtctgcagctggccttcaccgcatccccggaggctccaggcaacaggggggatctccacctactcttgtcaaggcctggctactcaaagtggccggcaccttccttgtgtcctgcacagggaacgcagcctgtgaagcctcacaatgacaccagttctaaaataggagcaaaacacacacaagttcttctccaaactg

SEQ ID NO: 94321 - DNA, 601 bp, Human
caccctgctcaatggtgctgattcccctgctgcttaggggaaactgcaggtggagacccgggcaggagagcatctcttaagatcacattatgtttaagaaaagaaaatatgggggccgggcatggtggctcatgcctgtaatcccagcactttgggaggccaaggtgggtggatcacgaggtcagcagttcaagaccagcctggccaacatggtgaaaccccgtctctactaaaaatacaaaaattagccaggtgtggtggcgtgcgcctgtagtcccagctactcgggaggctgaggcasgagaatcacttgaacccaggaggtggaggttgcagtgagctaacatcacgccactgcactccagcctgggcaacaaggcaagactctgtctcaaaaaaaaaaaaaaaaaaaaaaaaaaaaaggaagaagaagaagaaagaaaaagagaaacatatttctggctagccctggaatctgtagtccaaccagactgccagggcttgagagaagccgtaccctgtcctggggactcagtgcactagaggcactctaactcaggcccctgcccgtccagacccctggcagacacccaacacccag

SEQ ID NO: 94322 - DNA, 601 bp, Human
tggcctctggggggatcagactggaggccgcatagtggatcttgtggggcaggcagaagctcacctccagccagctgttgatgtgaagccgaactacgcccgacgtgcacaggctgcagagagtgggcgctgttacccgttcacataaactttctaaccatgcacacagatcagaaaacaccctgctcaatggtgctgattcccctgctgcttaggggaaactgcaggtggagacccgggcaggagagcatctcttaagatcacattatgtttaagaaaagaaaatatgggggccgggcayggtggctcatgcctgtaatcccagcactttgggaggccaaggtgggtggatcacgaggtcagcagttcaagaccagcctggccaacatggtgaaaccccgtctctactaaaaatacaaaaattagccaggtgtggtggcgtgcgcctgtagtcccagctactcgggaggctgaggcaggagaatcacttgaacccaggaggtggaggttgcagtgagctaacatcacgccactgcactccagcctgggcaacaaggcaagactctgtctcaaaaaaaaaaaaaaaaaaaaaaaaaaaaag

SEQ ID NO: 94323 - DNA, 601 bp, Human
ttttgggaggctgagatgagcgatgagtggatcacctgaggtcaggagttcgagaccagtctggccaacatggtgaaaccctgtctctactaaaagtaccaaaaaaattagccaggcatggcagtgggcgcctgtaatcccaactactcgggagcctgaggcaggagaatcacttgaacttgggaggtggacgtagtggtgagccgggatcgcactactgaaatccagcctgggcgataagatcaaaactctgtctctctctcacacacacacacacccccgcaaaaaaaaaaaaaaaaaagaaaaagaaaaaaaaaagaaaaagaaaataactgagatcccatgagtgctgactgaaatgcaaaagactggggtagggcaacaccattaagatgaagtccctccagccctccggcctccccaaggacactcagccccacatccaggctgccctgcccaagcctaaggtggtgccagaagggcccaggagaaacctgggattggtcatttctggacacaactggatacaaaattatgtgttttaacttctataaacggcagagccccacctgcaagcttccgcagtgggaagaagaaaaag

SEQ ID NO: 94324 - DNA, 601 bp, Human
ccaaccagatccgcagacgaggctgaggggccctccatctaatcagaaagggcagccctctgcatggacaggcccataagcatgtggctcagcaaggacgtggcatcttgtacagagtgcacaggccaacacatgtgcacacacaggggcgtaaggccaccaggttaggtctctgttctgcacatgggagggccccgcatccaagcttcctgcccttagttcccgtatgttgttcatgcaccactgtgagacccccatggccctgcccgctgctgccctgcccaccccctagctctggtgyctcaacctccaggactgcaagcaccccagtcctttctctcacagactcgccttacctctctgagacagaagaacaagtcagtcccgtggctcactcacaaagccagccctgaacccaggtctgactcagatgccaaaacctccagccatcccagggactggccccaccccatggtgggctgtgccgcggctctcagctggacacagcccctgtggatgtactgtggcaggcggcctgcctttcctgatgccccagcaccgccacatgccacccatctgggcctccagagctatacctgca

SEQ ID NO: 94325 - DNA, 601 bp, Human
aaaaggtgtgtgaaatcctaagctctcgcacttctgcctctgcatcagcccaggacaccactccaccctcttggcgggtaggcctctgtggaggtgagtcacccctgcctggacaccgtgctgccctgctgctgaggacacttatacctcagctcagaaaacagggcctccagactgagtgagtggctcatgcctgtagtcccagcattttgggagggcaaggcaggaggatcgcctgaacctcggagttcgagaccaacctgggcaatatagtgagaccctcatctctgccaaaaatttktatttaattagccaggcactgcggcacatgcctgtagtcccagctacttggaggctgagacaggaggattgcttgcacctgggaggtgggggttgcagtgagccaagattgtgcgagtagtgcccccaatggctccgccaaccccgacatggcaggtttcagctccatcaccgccctgttccctcaccccacgtgccactcgcatgtctctctcaaaaagacacccccactttcccccagctctgctcagcatagtggtctccacctcctgcctctccctgcagcagcctctccaagatg

SEQ ID NO: 94326 - DNA, 601 bp, Human
ccagcagcactcacagacatacgctggcattgggagacagcatgtagacgttgttctcacacagcgggtagatgatgatggccttgccccagtacaccagatgagctgcaagctggaaaacctgcaggcaaaagggaagctgcaaggaccatgcctgaggctggcccaccgggagctgtcagcagctctcagcctgggtggccatggcctaccagcctggagaagctggccccagcctcatgcagaacacacctggtggctatggcccgagacttcctccctaacgtggaatagcaccttygcaacctctcactaggatgtggggcacagccagcacacagcactttctgtgagcaatggtttttttttttttttttttggagacagtcttgctctgtcgcccaggctggagtgcagtggcacaatctcagctcactgcaacctcttgcctcccaggttcaagcgattctcctgcctcagcctcctgagtagctgggattacaggcacatgccaccacgcccagctaatttttgtatttttagtagagacagggtttcaccatgttggccaggatggtctcgatctgacctcgtgatccac

SEQ ID NO: 94327 - DNA, 601 bp, Human
cagccaggcaggtagtgcctatccactacacacctgccactctgggctccttgagcttctgtgactcacctcctgcacagcgggggccaggggattcctaaattctgacaaggagaccggcaaggagaacttggcaagaacggacggcaggtcatgagatgggaactggtgggagaactgctcggccagcggggagtacctgcaggcaggtgagcatgccagtgagtgcagcagacccccccaccgtgttctcaacactggcctcagtgggcagcagagaagcaaagtgtggcaggtgggycaggacagtgcgatgagggcagaacggtatgaggccaggcaggcctccaggtggacagagcctgggcacttccccttgagcagcagcaggagccatgggcacagttcatcctgcatctcacctctgatccctcaaggtggattagaagagccagcctggaggagggggccaggcatatgggggacacaggagagccacagagcacagagccagaccagaattgggacctgggtatgctagtggccaggagttaggctgaagtgagagcctggccttggggcttccacagcctttggtgcc

SEQ ID NO: 94328 - DNA, 601 bp, Human
tcccagcactggagcccaggcagaacctggctgacctaggccccttgacaaggcctggagcaaccactcagtcatggcctggaaaagccactccgttatctagaccacaggaggcctctgagaagggagcaccagcagctcctccctaagcactgccccaagagcaggggtgcagagagtgccttttattcagctggtacaacctggctcagctcccagaaaccaagggctctgtgaaagaccgcactgagagctctgtcaggtttagcgtctaacggagctgaaaagccagaatcgttckcattcgtaatttgagaacggaaagggtttaactttaaggactggttttgcctaatagatctggcacttactcagatacttctggagacaaagacttgagaacacccagctcgtctgtctccaacaccgtatcctatctggccctgctctgagtctctgcccagaactcagtggaggggaggatggcaaagccacctcagcacaaggctatgacacctgcagcccacaggggaagccactggccctgccacagatgcaggtgcaccagttcatcccacagacctgcaggaggcctcctatc

SEQ ID NO: 94329 - DNA, 601 bp, Human
ttcccagcactggagcccaggcagaacctggctgacctaggccccttgacaaggcctggagcaaccactcagtcatggcctggaaaagccactccgttatctagaccacaggaggcctctgagaagggagcaccagcagctcctccctaagcactgccccaagagcaggggtgcagagagtgccttttattcagctggtacaacctggctcagctcccagaaaccaagggctctgtgaaagaccgcactgagagctctgtcaggtttagcgtctaacggagctgaaaagccagaatcgttmtcattcgtaatttgagaacggaaagggtttaactttaaggactggttttgcctaatagatctggcacttactcagatacttctggagacaaagacttgagaacacccagctcgtctgtctccaacaccgtatcctatctggccctgctctgagtctctgcccagaactcagtggaggggaggatggcaaagccacctcagcacaaggctatgacacctgcagcccacaggggaagccactggccctgccacagatgcaggtgcaccagttcatcccacagacctgcaggaggcctcctat

SEQ ID NO: 94330 - DNA, 601 bp, Human
atcaaaattaaataaaatcaataaaccaaaaataaaacagaggggcttcccagcactggagcccaggcagaacctggctgacctaggccccttgacaaggcctggagcaaccactcagtcatggcctggaaaagccactccgttatctagaccacaggaggcctctgagaagggagcaccagcagctcctccctaagcactgccccaagagcaggggtgcagagagtgccttttattcagctggtacaacctggctcagctcccagaaaccaagggctctgtgaaagaccgcactgagagytctgtcaggtttagcgtctaacggagctgaaaagccagaatcgttctcattcgtaatttgagaacggaaagggtttaactttaaggactggttttgcctaatagatctggcacttactcagatacttctggagacaaagacttgagaacacccagctcgtctgtctccaacaccgtatcctatctggccctgctctgagtctctgcccagaactcagtggaggggaggatggcaaagccacctcagcacaaggctatgacacctgcagcccacaggggaagccactggccctgccacaga

SEQ ID NO: 94331 - DNA, 601 bp, Human
ggagtgtgagacacatcagtgtcctcagatacacatctgtctactcatctctgggagggtcaacaaggagctgctggccagggtcacctcctgggagggggctggggaactggggatgggaatgggggatatatcccaggcaagtaagaagacttggtcaaaaggactgcaagatatccagacttcacatgaatttaagaaataaaacagacgcgggtggatcacttgagctcaggagttcgagaccagccttgccaacacagtgaaacctcatctctactaaagatacaaaaattagcckggtgtggtggcacacacctgtaatcccagctacttgggaggctgaggcaggagaatcacttgaacctgggaggcggaggttgcagtgagccaagatcacgccactgtacttcagcctggacaacaaagcaagtttctatatcaaaacaataaaaaaaaagctgggcgtagtggctcatgcctgtaatcccagcactttgagaggatgaggtgggtggatcacctgaggtcaggagttagagaccaccctggtcaacacggtgaaaccccgtctctactaaaaatacaaaaaattagccag

SEQ ID NO: 94332 - DNA, 601 bp, Human
aggctgctgccctcaagccacactggccatgacagctcttctggggcgcagaggtgtcagctgtcctggtagtggtatgagatcctgctctgctcccaggctggggcagagattccagcactgatttgctgggctgggagctgcccctaattctagcaagcctgctgaagagcccggagacagagctgccacctcagagtcacggtggtgctaggagacaggagaggtgtctccacgggggacacgaggcacgtgcatgtgcgtgtgcagctgtgtggaggcccctcatcactcacagcaycgcccacgttgagcctcctggatgccacccccaagcgtctcccctgactaccacagcggtgccctgggggtcctacttggggagccaaagctgagggcgttgggcgtgctgaggctgcgaccgccgacccgggcagtgaaggggacgtcgtcctctcgcggacggggctcctcctcgctgggtgaggccatcaggcagacataggtgtgcagctggatgagaagccggcgctgcagcatccacaccaccatctggatgagctgggtctgcgggtggcagcaggtgaggctggtccccctc

SEQ ID NO: 94333 - DNA, 601 bp, Human
agcctggggaccggggacctgggacctggcaacaggctgctgccctcaagccacactggccatgacagctcttctggggcgcagaggtgtcagctgtcctggtagtggtatgagatcctgctctgctcccaggctggggcagagattccagcactgatttgctgggctgggagctgcccctaattctagcaagcctgctgaagagcccggagacagagctgccacctcagagtcacggtggtgctaggagacaggagaggtgtctccacgggggacacgaggcacgtgcatgtgcgtgtgsagctgtgtggaggcccctcatcactcacagcaccgcccacgttgagcctcctggatgccacccccaagcgtctcccctgactaccacagcggtgccctgggggtcctacttggggagccaaagctgagggcgttgggcgtgctgaggctgcgaccgccgacccgggcagtgaaggggacgtcgtcctctcgcggacggggctcctcctcgctgggtgaggccatcaggcagacataggtgtgcagctggatgagaagccggcgctgcagcatccacaccaccatctggatgagctgggtc

SEQ ID NO: 94334 - DNA, 601 bp, Human
gtgccccacaaacaccccaaggtgggcctgggcatcctgtccctcacccaggatggaggacaaagcaccctgggcaggtggggtcctcacatgaagcatgaagcctacagccagacctcagccaaggggggactttcaaagtcttccacccccttccttccccaagcctggggaccggggacctgggacctggcaacaggctgctgccctcaagccacactggccatgacagctcttctggggcgcagaggtgtcagctgtcctggtagtggtatgagatcctgctctgctcccaggctgsggcagagattccagcactgatttgctgggctgggagctgcccctaattctagcaagcctgctgaagagcccggagacagagctgccacctcagagtcacggtggtgctaggagacaggagaggtgtctccacgggggacacgaggcacgtgcatgtgcgtgtgcagctgtgtggaggcccctcatcactcacagcaccgcccacgttgagcctcctggatgccacccccaagcgtctcccctgactaccacagcggtgccctgggggtcctacttggggagccaaagctgagggcgttgg

SEQ ID NO: 94335 - DNA, 601 bp, Human
ttctccgtcatcctctggttcagtggcgagtccccgctgggaagtagctctgcgctggagttgtccatgctggggctggtgagggtcatgtcatcgctgctggctgtgggggacatgggtcagggtgaccaagtggaattccaggacacccaggggaacagcgagggcagagccagcagccagcctccaatgacacccctaactcctacaagggttagggtacatctgcctgcaagcattcgctgctgccccacctcctgggtgtgacacgcccctcatacggctgacttgggaaacgggyagcctcccctctgggggcaacctcaagggacctgaacagaggtgcgatgtgtgccccacaaacaccccaaggtgggcctgggcatcctgtccctcacccaggatggaggacaaagcaccctgggcaggtggggtcctcacatgaagcatgaagcctacagccagacctcagccaaggggggactttcaaagtcttccacccccttccttccccaagcctggggaccggggacctgggacctggcaacaggctgctgccctcaagccacactggccatgacagctcttctggggcgcagag

SEQ ID NO: 94336 - DNA, 601 bp, Human
tgggcaaacccctgccaagtcccatgagggtgagaacttggcacttaaattagccgggcgtggtggcgggcgcctgtagtcccagctactcaggaggctgaggcaggagaatggcgtgaacccgggaagcggagcttgcagtgagccgagattgcgccactgcagtccgcagtccggcctgggtgacagagcgagactccgtctcaaaaaaaaaaaaaagaacttggcactgcctctcaagggaaaaggaacatctaagaagtactggagagagaagagtccgaaaaataggcatgccaggcccatggcccggcgtcttggtgacaagccgaaccctcaggcctgggcagtggcacctgcccctacacacctgaatgcagagactccatctcgaacagggccccatctgttctcagtggatttggtggttctgttgcgtacgtccctatccactttctgccctgaccctgcaactggccccagtcccaacgggtcaacctacacccacctggcaaacatgcggaggtcctcagggttctgggctgcgggtacactgaggatggctgcgcgttcatgctccgacaggctggccagcaggttc

SEQ ID NO: 94337 - DNA, 601 bp, Human
ctcccgggaaactatgcccctgcactgtcccccaagtcagggtggggctgacagagaccactgagccacatcacctttaacatgggggaccctggatgcccgcagggcttacagtcctgggcaaacccctgccaagtcccatgagggtgagaacttggcacttaaattagccgggcgtggtggcgggcgcctgtagtcccagctactcaggaggctgaggcaggagaatggcgtgaacccgggaagcggagcttgcagtgagccgagattgcgccactgcagtccgcagtccggcctgggygacagagcgagactccgtctcaaaaaaaaaaaaaagaacttggcactgcctctcaagggaaaaggaacatctaagaagtactggagagagaagagtccgaaaaataggcatgccaggcccatggcccggcgtcttggtgacaagccgaaccctcaggcctgggcagtggcacctgcccctacacacctgaatgcagagactccatctcgaacagggccccatctgttctcagtggatttggtggttctgttgcgtacgtccctatccactttctgccctgaccctgcaactggccccagt

SEQ ID NO: 94338 - DNA, 601 bp, Human
ccgccaccacacccagctaattttttgtattttttagtagagacggggtttcaccatgttagccaggatgatctcgatctcctgacctcgtgatccacccacctcagcctcccaaagtgctgggattacaggcatgagccaccgcgcctgacttttttttttttttttaatgtcaccatcatttggaaggtcactgctttagggtgctttctgcaactcaggctggcacagaggaggctaggatgcaggtgagacctggaccagctgctcagaagagttgcaagtggttctctcgagggcygagtgtggttcttaaccggaaactcagtccctgacaacccgaccactcccgggaaactatgcccctgcactgtcccccaagtcagggtggggctgacagagaccactgagccacatcacctttaacatgggggaccctggatgcccgcagggcttacagtcctgggcaaacccctgccaagtcccatgagggtgagaacttggcacttaaattagccgggcgtggtggcgggcgcctgtagtcccagctactcaggaggctgaggcaggagaatggcgtgaacccgggaagcggagcttg

SEQ ID NO: 94339 - DNA, 601 bp, Human
ccaatgccaggcctcagggccaagagggctcagcctcagcacggggggagccctggggtggggagacgcgagcgcccacctgcgcaccccagcagccttccgccctccgcctgggctcaggggagcagagcctggaagacggcaatgacagggtcctcgtgggtggtcaccaccagcacgctgcggaacttgtcaaacagcatgagcagctgggagcgccgcgtgttctcgttgtacataatctcctccaggtggtggcggccgcggaagtagtgaaggagcctggaagggatgggtgggygtgagcccaacctgacaccagcccccagaggcctctgctgaagagccactgctgggaatcagctctgagctgcccacaggcctgaacagagctggtggtgaaggccagggaggcagccaccacagccccccaacaagggtgggcaggcctcctggaccccatgcccaccacggtcccgctgaccaccaggtgggcggagtgggttcaggacggcagacggctgttcaaacccagaggtgcccaagcctgcgtcctgatgttgggaccagggttctgctggtggcttctttttcgtgctac

SEQ ID NO: 94340 - DNA, 601 bp, Human
catccctcgcttcaggtccatcccaaacttggagcacaggtcctccttcggggtctggcagaaggctcacatggggccaggtgctggtggcagggccccacctacccttccagccaacccacctggctcctctctagccgctggtggtcccaggacaggacagagaaggcccgggtggggccgcctcagcaccccagcctggggggtgggatcagcacagaagcaagtccaagtgcagggaaaggggcggctgtgctcgctcaggccccacgggcaagtcagccacccacagagcgacagyctctcctgaaggcaggaaaccccactggtgctggccagaaaggggcatggccccactcacgctttcccagtgaccctcctgtgcagatgtcagcgtgccccggtgtgatgctgacctggggctcccgtgagtctgactggcccatcccagaccctgtgtgcactgactcgccccaccccgcttgccttgaggatgtaaaagtcgagcccgtaagcctcatcgatgaggtccagggtccgcatggtcacagtcactgtgaacttcttgtccaggatctcactgtagaactctcgctcaaac

SEQ ID NO: 94341 - DNA, 601 bp, Human
gggagcgggccatgctcctctgggtgggcaatgcagagcagcagctcttccccaagcccacccagtgcaccagccccttgtgcaggctctctccaaggcagcacactcccagaccctgaacaccaggctctgggcaggcagcatcggctggtgctcacacactcaccttctcctccaaaagtctctgcttctcaatggcctcctccagcgtgaggcccacccactctgcctcctcctctgggatggcaaattcctaggcaggcagagatggaaagggcagtgaggcccagggccgggccasgagtccccaggtgtagggagcgggacggaaaccctcaccttgtacttgtcgtagatggctgcccgccgctcggggtcctcggggtgcagctgggggtcctgccgggcaagccgcagcagcatccctcgcttcaggtccatcccaaacttggagcacaggtcctccttcggggtctggcagaaggctcacatggggccaggtgctggtggcagggccccacctacccttccagccaacccacctggctcctctctagccgctggtggtcccaggacaggacagagaaggcccgggtggggc

SEQ ID NO: 94342 - DNA, 601 bp, Human
ctgggacagaacagggtggggacttggaggggagggagcgggccatgctcctctgggtgggcaatgcagagcagcagctcttccccaagcccacccagtgcaccagccccttgtgcaggctctctccaaggcagcacactcccagaccctgaacaccaggctctgggcaggcagcatcggctggtgctcacacactcaccttctcctccaaaagtctctgcttctcaatggcctcctccagcgtgaggcccacccactctgcctcctcctctgggatggcaaattcctaggcaggcagagrtggaaagggcagtgaggcccagggccgggccaggagtccccaggtgtagggagcgggacggaaaccctcaccttgtacttgtcgtagatggctgcccgccgctcggggtcctcggggtgcagctgggggtcctgccgggcaagccgcagcagcatccctcgcttcaggtccatcccaaacttggagcacaggtcctccttcggggtctggcagaaggctcacatggggccaggtgctggtggcagggccccacctacccttccagccaacccacctggctcctctctagccgctggtggt

SEQ ID NO: 94343 - DNA, 601 bp, Human; identical to SEQ ID NO: 38400

SEQ ID NO: 94344 - DNA, 601 bp, Human; identical to SEQ ID NO: 38399

SEQ ID NO: 94345 - DNA, 601 bp, Human; identical to SEQ ID NO: 38398

SEQ ID NO: 94346 - DNA, 601 bp, Human; identical to SEQ ID NO: 38397

SEQ ID NO: 94347 - DNA, 601 bp, Human; identical to SEQ ID NO: 38396

SEQ ID NO: 94348 - DNA, 601 bp, Human; identical to SEQ ID NO: 38395

SEQ ID NO: 94349 - DNA, 601 bp, Human; identical to SEQ ID NO: 38394

SEQ ID NO: 94350 - DNA, 601 bp, Human; identical to SEQ ID NO: 38393

SEQ ID NO: 94351 - DNA, 601 bp, Human; identical to SEQ ID NO: 26417

SEQ ID NO: 94352 - DNA, 601 bp, Human; identical to SEQ ID NO: 26418

SEQ ID NO: 94353 - DNA, 601 bp, Human; identical to SEQ ID NO: 26419

SEQ ID NO: 94354 - DNA, 601 bp, Human; identical to SEQ ID NO: 26420

SEQ ID NO: 94355 - DNA, 601 bp, Human; identical to SEQ ID NO: 26421

SEQ ID NO: 94356 - DNA, 601 bp, Human; identical to SEQ ID NO: 26422

SEQ ID NO: 94357 - DNA, 601 bp, Human; identical to SEQ ID NO: 26423

SEQ ID NO: 94358 - DNA, 601 bp, Human
tcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaatgtattttaggaaaaaatatattctgttattgcacagagaaraatgcatatatgaagctgaagtagttaagtggaaagtgagtaggtagagtgaaaaagatgcatcagttagcttttgctatgtaacaaccatccccagacttggcggccttaaacaacaacaatttatttagctcttgattgttctgcttgttggcagtttgggctgagcttggctgggcagttcttctggtcttggtctcctccacgtgtctgcaggcaactgtaggtcctccgggtagctcttctggggtttggccggctattggctggggtgtgaggggcaactggtccctgtggttt

SEQ ID NO: 94359 - DNA, 601 bp, Human
taagataaaaagaatgaatcattactaccctgtgaggcaggtatgcatacttatgttgtctaaaaatgatacagttttcttaatgtattttaggaaaaaatatattctgttattgcacagagaaaaatgcatatatgaagctgaagtagttaagtggaaagtgagtaggtagagtgaaaaagatgcatcagttagcttttgctatgtaacaaccatccccagacttggcggccttaaacaacaacaatttatttagctcttgattgttctgcttgttggcagtttgggctgagcttggctrggcagttcttctggtcttggtctcctccacgtgtctgcaggcaactgtaggtcctccgggtagctcttctggggtttggccggctattggctggggtgtgaggggcaactggtccctgtggtttcatcacccagcaggctagcctgggcttgtcaccggccactaagcaagcactctaggaacaagaaacggtcaatccccgaaacccaagtgcttttcaagcctctgtctgtatcatttttgttcatgtccctttggccaaagaaagccacaagacaaacccagattcaagaggtggag

SEQ ID NO: 94360 - DNA, 601 bp, Human
gtctaaaaatgatacagttttcttaatgtattttaggaaaaaatatattctgttattgcacagagaaaaatgcatatatgaagctgaagtagttaagtggaaagtgagtaggtagagtgaaaaagatgcatcagttagcttttgctatgtaacaaccatccccagacttggcggccttaaacaacaacaatttatttagctcttgattgttctgcttgttggcagtttgggctgagcttggctgggcagttcttctggtcttggtctcctccacgtgtctgcaggcaactgtaggtcctcygggtagctcttctggggtttggccggctattggctggggtgtgaggggcaactggtccctgtggtttcatcacccagcaggctagcctgggcttgtcaccggccactaagcaagcactctaggaacaagaaacggtcaatccccgaaacccaagtgcttttcaagcctctgtctgtatcatttttgttcatgtccctttggccaaagaaagccacaagacaaacccagattcaagaggtggaggaaataaattctgtctcttcatgagaggagtgaagaactgtagtcagtaactacagg

SEQ ID NO: 94361 - DNA, 601 bp, Human
catttttgttcatgtccctttggccaaagaaagccacaagacaaacccagattcaagaggtggaggaaataaattctgtctcttcatgagaggagtgaagaactgtagtcagtaactacagggaggatacagaggacaaacatcagaaaggtgggatgtggagtcctgatcttggggaactcttgagtgagctgatgtgtggagacattcttctaacatagtgcttagaggctgatcaaaaataggctactgcatcatttccctcttcttcataagccagccttggggctcagcactcaartgcagccccttgaccctggaaataactgagatgaggccttgagtgaaggttgtgagccaggggcaggggtgctgttaaggaagagggtggttctggttctgaatcatcacgagatgacagtccctgtcttttgtgtgtggttttgccattttcaaggtgtttacccacctcttaggagctggcccaggaatgggccagagaagagggagcggcctaccgactggccccagccatgctttggggtcagggctgggacatcgttggcaaagaaggggtcggttgccctcactggtgtggagc

SEQ ID NO: 94362 - DNA, 601 bp, Human
ctctccacgccctcttctctcctctgtaaacagaagtagcgtggtcccaatgactcacagcctggcttgagtgttttggagctaagaccagggatgtgctttgcagggggccacgggacactgacgatgcaagacgtgcagtgccctgcccgaggtcacgtgcacagctagaaggagcaaagcttccagccctggcattcagcactgcatcctgcctccagctaaccttttgtctgtgtccccaccagccaccagcccagagcccgggccaggcttgggagcccaagtccatggtcacagrtcacattgtgccacatgtgtgtctccccgctcccaggttactcttggggtcttctctcggcctggaccccctacacccaccctgtgtgcagtgctaagtcaccattctcagcagaagccagtgagctgcactttcccagatcctcatgagaagccgctggggccccagagacagtcatttcatgctggctttataattgagcgccgagttgctctgggatggggaagcagagcttttgtcccctgcttctccttgctgtctggggtcacctctgtcccaaggtcgccctggaggacaggc

SEQ ID NO: 94363 - DNA, 601 bp, Human
cccagagacagtcatttcatgctggctttataattgagcgccgagttgctctgggatggggaagcagagcttttgtcccctgcttctccttgctgtctggggtcacctctgtcccaaggtcgccctggaggacaggcggggccagacctggccagaggccctccatcaggctggagccgtgccttcctcctaggctcctccagaccccctgggagctcggcacgtatcattagactttattagaatcaaagaaatgagtcatatttgcaaacaaggcctgctcagccaatcttcccctgcrgctgtcggaaagaggaggcggtggagaaaggctgcacggccccgtgctctgggcggacgggcccttttataattgttgcctctgctagtctccaggggagagccatggccaataaatggctggcgtgcagtcaaaaggaaacgatttggcccgctaggaggacgtatttacatctctgagtgccggctggacggcagcagggcggccgactcaaaacagacgtccaggcagttcttttttggatcccaccctggagtgaatcattactattcttggacaagaatgcagcttacctcggag

SEQ ID NO: 94364 - DNA, 601 bp, Human
aggaggcggtggagaaaggctgcacggccccgtgctctgggcggacgggcccttttataattgttgcctctgctagtctccaggggagagccatggccaataaatggctggcgtgcagtcaaaaggaaacgatttggcccgctaggaggacgtatttacatctctgagtgccggctggacggcagcagggcggccgactcaaaacagacgtccaggcagttcttttttggatcccaccctggagtgaatcattactattcttggacaagaatgcagcttacctcggagtctcctccctctrtatgagacagacgaggaagctggggatgatggggcccttgccaaggccagcaccatgcccggcacatgaggtggctggccccagggtggcatcagtaaaaaggaaccaggtccatggctgatttctatctgagtgatttcaggtgcattcctgaacttgtctcagcctcagtttccccatcaaccaaatgggtataattaatttactcaattaatgtcagctgagcacctattaggtaccaggcactgttcagtgatcaagacagacatagaccctgccttcttgggactgacattttag

SEQ ID NO: 94365 - DNA, 601 bp, Human
gtgggacaggcagacattaaatagatagcacatgtacaattataatataaaagcaataagtgatgagaaataggctcagggcaggggaaggacagtgaccagggatgttttttacagagggtggccaggaacagctgccctggggatgtggcctttgagcagagacctgaaggaaaggagcgagggagttttggaacaagtggctgagggaagcagttaggtccaaggccttaaggcaggatcgcgttcgacctgttcagggaatggcccagatagcagctagggtggctgaaggaggagraagtgatgctgcagtctgggggatgagggtagggcttgggcgcccgcacccccagcctgcccagaacacttcccctttacacccgttcacctgtgtgtttactaattggcaccccctcgctcttaaaagtgagtctgaatggcagggtcagaagggccgtgttggccggggagcgggagccctgggaggacgtggagcagaggagggatgtggcctgacataggtattgatagattccctctgacttgttggggcaggagtagagggaggaagaccaacgaagaggctgctggaaatcat

SEQ ID NO: 94366 - DNA, 601 bp, Human
ggacaggggcagagacagtgtgctgggagagctgtgttaacactgtggggagcctgtgcagcttcctcctggggtacttaggaggcacaggtgagtggcagggcgccatggcgttccctcggcacgacactctacagtttactgagcacgccctcactgctgggtagggattggctgggatcctgatcggctgctttctggctgggaagaccctggaagtcagacacggaagggactgtggaggggcctgcctgagattcagcctgcatggctgcccgagatgtctttggaaagaatgtcrgttgctctggccctgagcctgtgtcaggctgtgttgtgacaaatcctgattgatgagatacattggtttcagccctagtatgttcacgtggcccgttataaagcttttcaagaatttaaaataacttttataaaggtgatatgtgcacattaaaaacattgaaatagtgcaaaaatactttgcaaagtgcatccccctcccccacacaggcagcaactgccaccagcttcttgtgtgtcctgccaaaaatagtgtgtgtgtattcaagtacaaatgtgtctctgtctccctccctcttta

SEQ ID NO: 94367 - DNA, 601 bp, Human
gtacttaggaggcacaggtgagtggcagggcgccatggcgttccctcggcacgacactctacagtttactgagcacgccctcactgctgggtagggattggctgggatcctgatcggctgctttctggctgggaagaccctggaagtcagacacggaagggactgtggaggggcctgcctgagattcagcctgcatggctgcccgagatgtctttggaaagaatgtcggttgctctggccctgagcctgtgtcaggctgtgttgtgacaaatcctgattgatgagatacattggtttcagycctagtatgttcacgtggcccgttataaagcttttcaagaatttaaaataacttttataaaggtgatatgtgcacattaaaaacattgaaatagtgcaaaaatactttgcaaagtgcatccccctcccccacacaggcagcaactgccaccagcttcttgtgtgtcctgccaaaaatagtgtgtgtgtattcaagtacaaatgtgtctctgtctccctccctctttacacggtagggagcatgtctcatgcactgttcttcaccttgcttctttcctgcattttgtctccaggaccgagc

SEQ ID NO: 94368 - DNA, 601 bp, Human
aggtgagtggcagggcgccatggcgttccctcggcacgacactctacagtttactgagcacgccctcactgctgggtagggattggctgggatcctgatcggctgctttctggctgggaagaccctggaagtcagacacggaagggactgtggaggggcctgcctgagattcagcctgcatggctgcccgagatgtctttggaaagaatgtcggttgctctggccctgagcctgtgtcaggctgtgttgtgacaaatcctgattgatgagatacattggtttcagccctagtatgttcacrtggcccgttataaagcttttcaagaatttaaaataacttttataaaggtgatatgtgcacattaaaaacattgaaatagtgcaaaaatactttgcaaagtgcatccccctcccccacacaggcagcaactgccaccagcttcttgtgtgtcctgccaaaaatagtgtgtgtgtattcaagtacaaatgtgtctctgtctccctccctctttacacggtagggagcatgtctcatgcactgttcttcaccttgcttctttcctgcattttgtctccaggaccgagctccttagtaggacac

SEQ ID NO: 94369 - DNA, 601 bp, Human
cagctgggatgtggttggccgccagcctgccctatagggatgccccctgccccaaggtgccaggtgatcccagcatatagcagaggactgaagagattgttaaatcagcatatagcagaggactgaagagattgttaaaatttaggctctgttttctcttaaaaccagaccaacagtgtagtggagtagagagagcactggttttggagtcagacaggtgtgggcttggggtggcagctctgtgtcacctgctggctctgtgaccatgggcaagtggacccaccaagccttcattttcccyatctgtaaaatggggtgaatggcctctactcctgggatcagatgagataaactgaaaaggccttggaaagcaggtggttgctggtagcttttatttcgtccatcagcattatcatgttgacatccctggtgccagggggagcccactgatgtcgctgtgaccagcaagaagagggcaaagaaaagctgtcctgtcttatggctgttagtgggagtatttcacggatcggtcctacagtgacatgtgaacttgctgtcctcccagttgagtccattcattcactcattcactcaacaggtc

SEQ ID NO: 94370 - DNA, 601 bp, Human
tgttgacatccctggtgccagggggagcccactgatgtcgctgtgaccagcaagaagagggcaaagaaaagctgtcctgtcttatggctgttagtgggagtatttcacggatcggtcctacagtgacatgtgaacttgctgtcctcccagttgagtccattcattcactcattcactcaacaggtctttattgaggtcctccaatgggccagatgctgttctaggtgctgggaacacagcagtaaactaaagaaaggccttgcttgaataccagttgagaagggaatcttggatttattcraagtccttatgttgaagcttctctaaaaaaaataaaataaaaatgataaagggtctagcctggtgtgtgttccgagaaccagagccctgactgtgggggtaatcccacggactggctgaaagcttgggatgttccagaatgcttccccaagagcatcctgggcaggagctgttattctcattttacaaaaggggaaactgaggcacagagtcacacttcactccctgcccctcctgcatgggagtgtgaccttcagacagggagctgactcccattagaaggaaactcagcttcttccag

SEQ ID NO: 94371 - DNA, 601 bp, Human
aatcccacggactggctgaaagcttgggatgttccagaatgcttccccaagagcatcctgggcaggagctgttattctcattttacaaaaggggaaactgaggcacagagtcacacttcactccctgcccctcctgcatgggagtgtgaccttcagacagggagctgactcccattagaaggaaactcagcttcttccaggggttcgcaaacaccctggagcatgcagaccctgtctcttgtggccagcagcctgtggtggacaggtaacctgggaggcccagtgggcagggccgatgtcyctgttctcagcgtggctgtcctcgatcactgttgcagcagtcagagctctgggaccatgggtgccacttctgggcatcaagtttcatggcctgggctgtcagtaccctgcatcgccctggcctgctttcagatgctgtcatccataagaatgtctgggagtaggtacttgtgtgcttgtttagcagggcagcaggaatcagctcggattggtgggaggcttaagtctggactccaaagacccacgctctgccgtgtcatcctgggcagggttggtgactgtcccgtgccaattatcctta

SEQ ID NO: 94372 - DNA, 601 bp, Human
tgtcagtaccctgcatcgccctggcctgctttcagatgctgtcatccataagaatgtctgggagtaggtacttgtgtgcttgtttagcagggcagcaggaatcagctcggattggtgggaggcttaagtctggactccaaagacccacgctctgccgtgtcatcctgggcagggttggtgactgtcccgtgccaattatccttaaaaccgtttacctgcctctctctgagaccctcaaaaccctggcagggcaggggaggaaaccagcattgcttaggtgccggctgtgtgcctgaaactyccctgggcatctgaacaccacagttaacatctgcaaaggtttatcaagtgctagctgcatcccagaccctgaatttaggaccttgtgtgacttacattttagtgagagatccaggttacacagggatgaataaaataataagggacaatattgggggagggcaacactttatagacgaggagccagaggtctgggaaagttggctaacttcgttctgtcagtgacggaacaaacagtagagctgagaattgaacctagtgtttggcccacggttggcactgaagaaggttctgctgaagt

SEQ ID NO: 94373 - DNA, 601 bp, Human; identical to SEQ ID NO: 26424

SEQ ID NO: 94374 - DNA, 601 bp, Human; identical to SEQ ID NO: 26425

SEQ ID NO: 94375 - DNA, 601 bp, Human; identical to SEQ ID NO: 26426

SEQ ID NO: 94376 - DNA, 601 bp, Human; identical to SEQ ID NO: 26427

SEQ ID NO: 94377 - DNA, 601 bp, Human; identical to SEQ ID NO: 26428

SEQ ID NO: 94378 - DNA, 601 bp, Human; identical to SEQ ID NO: 26429

SEQ ID NO: 94379 - DNA, 601 bp, Human; identical to SEQ ID NO: 26430

SEQ ID NO: 94380 - DNA, 601 bp, Human; identical to SEQ ID NO: 26431

SEQ ID NO: 94381 - DNA, 601 bp, Human; identical to SEQ ID NO: 26432

SEQ ID NO: 94382 - DNA, 601 bp, Human; identical to SEQ ID NO: 26433

SEQ ID NO: 94383 - DNA, 601 bp, Human; identical to SEQ ID NO: 26434

SEQ ID NO: 94384 - DNA, 601 bp, Human; identical to SEQ ID NO: 26435

SEQ ID NO: 94385 - DNA, 601 bp, Human; identical to SEQ ID NO: 26436

SEQ ID NO: 94386 - DNA, 601 bp, Human; identical to SEQ ID NO: 26437

SEQ ID NO: 94387 - DNA, 601 bp, Human; identical to SEQ ID NO: 26438

SEQ ID NO: 94388 - DNA, 601 bp, Human; identical to SEQ ID NO: 26439

SEQ ID NO: 94389 - DNA, 601 bp, Human; identical to SEQ ID NO: 26440

SEQ ID NO: 94390 - DNA, 601 bp, Human; identical to SEQ ID NO: 26441

SEQ ID NO: 94391 - DNA, 601 bp, Human; identical to SEQ ID NO: 26442

SEQ ID NO: 94392 - DNA, 601 bp, Human; identical to SEQ ID NO: 26443

SEQ ID NO: 94393 - DNA, 601 bp, Human; identical to SEQ ID NO: 26444

SEQ ID NO: 94394 - DNA, 601 bp, Human; identical to SEQ ID NO: 26445

SEQ ID NO: 94395 - DNA, 601 bp, Human; identical to SEQ ID NO: 26446

SEQ ID NO: 94396 - DNA, 601 bp, Human; identical to SEQ ID NO: 26447

SEQ ID NO: 94397 - DNA, 601 bp, Human; identical to SEQ ID NO: 26448

SEQ ID NO: 94398 - DNA, 601 bp, Human; identical to SEQ ID NO: 26449

SEQ ID NO: 94399 - DNA, 601 bp, Human; identical to SEQ ID NO: 26450

SEQ ID NO: 94400 - DNA, 601 bp, Human; identical to SEQ ID NO: 26451

SEQ ID NO: 94401 - DNA, 601 bp, Human; identical to SEQ ID NO: 26452

SEQ ID NO: 94402 - DNA, 601 bp, Human; identical to SEQ ID NO: 26453

SEQ ID NO: 94403 - DNA, 601 bp, Human; identical to SEQ ID NO: 26454

SEQ ID NO: 94404 - DNA, 601 bp, Human; identical to SEQ ID NO: 26455

SEQ ID NO: 94405 - DNA, 601 bp, Human; identical to SEQ ID NO: 26456

SEQ ID NO: 94406 - DNA, 601 bp, Human; identical to SEQ ID NO: 26457

SEQ ID NO: 94407 - DNA, 601 bp, Human; identical to SEQ ID NO: 26458

SEQ ID NO: 94408 - DNA, 601 bp, Human
gcacgtaattgccaccacgccagaggaaaatggcttcctttggacaaaaaggccaactttgggttaatttgttcttttaatatattgctagagctaagcgggctactttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggcccygagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttg

SEQ ID NO: 94409 - DNA, 601 bp, Human
ggctgcggccaagactgggcagtccttaacatctggggcggctgccgggtctttgtcagcctgagtcctggccaccagcttctgcctccccggccagccttccggctccgccgaggtggggaggtggcggcggaagccccctaccctaggccttcgctgagcaccacggccacacggccatcctgcacacggcagagcagcggctctatcttaggtagggtgaagggaaagggggcttcccgaagctgcgggcaggctctacttgctccccctttaaaaaaaaaaaaaaaaaaaaaaaaaagacccacaagacaaaaaaaaaatcgcttttgacagattgaataacaattgtgaataacatgcagttgggcagaaggaggcacgtaattgccaccacgccagaggaaaatggcttcctttggacaaaaaggccaactttgggttaatttgttcttttaatatattgctagagctaagcgggctactttatctgttaaacgcgctcctagcgccgtcgttaaacagcgacgcctttgaatcccggccgggactggagtcccggcgcaacacatggcttttataaaaatctccggattacctc

SEQ ID NO: 94410 - DNA, 601 bp, Human
aacccactcgagccccgaaggagatgctgcccagggcctgggccgtcctcccgggggcattttcgcagcccgccccccgcagcccccagccgcccagagaaagccagagaaagccagcgaacgcgcctgcgcagtgcgcgcgcccccttgccaactagggcagggggagcagaggggccaggcccggcacagcccattctggggcagatggacgctgcgaggcacctcctccccaggatgagggtcccagggcttacccgcgcccaggaggctggccaggaggaagagggcgtacatagcrccgtctgactccgcagtctgcaatgcggagcgtcagctgatcccccgcagatataaatctgccctgccccaaagccgtccagagcgcaggcgctaaccccgccccatccgggcctgcccgagctcaacagcgccctgactcagcgcctctgagggcgcctgcgcgaaggggaggccaataggagggggcaatgggaggggcgaaaggaagggctatggggaggagtgaggaagaacttggagaaagggaagggaaaggtcataaaagaaaagccctactaattgaataggtcagagatta

SEQ ID NO: 94411 - DNA, 601 bp, Human
ccccatatatcgtgacttactttccaatctgactctggcataacattttataagacaaggaaaaaaaaatcaaaatatctaaccccaaaatatatttccttgccataccttgaaattgccctgcaaagtctcttgtgggaaaaatccacattctatagagaatcccctttcccctatgttttccttccttcctctccagatccaggagataatcaactaagagccagtcaccctttcatttccatagaaatattttacaacgtgctcgctctcttagtcggctacctgagagcttcctctrcacaataaaacttggtctccacaatcctttatcttaacttgaatactttctttctattgattctaggttttcagataaactcaaccaattatcaactagaaaatgtttaaatttacctatggcctggaagccccccgccgctttgagttgtttcgcccttctgaaccaaaccaacgtatttcttaaatgtatttgattgatgtctcgtgcctcccgaaaatatgtaaaacccagctgtatcccaaccaccttaggcacatgttctcaggacctcctgagggctgtgtcacgggccatggt

SEQ ID NO: 94412 - DNA, 601 bp, Human
cacgcctgtaatcccagaactttgggaggctgaggcgggagaatggcttgaacccggaaggcggaggttgcagttagccgagactacgccattgcaccactccggcctgggcaacaacagcgaaactccgtctcaaaaaacaaacaaacaaacaaaacaaacaaacaaaaaaaaaacggccaatagcgtgcaagactttcttttctctttttctttttttcacaggtggggtcttgctatgttgcccaggctggtctccaactcctaggctcaagcgatcctcccacctcggtgtcccaaygtgctgggattacaggcataagccaccgcacccggatgcaagacatttcaaagcaagtgaaatgaggaccccatggcaaaataactggaccagaaaaccctatatcgccttcaatacctatgagaattaagctccgattttttttagcttgcccaaattcctatctaaggggtgtaggaatcataccctacaaaccataaactctcatcagatgggttttatttgaccccatatatcgtgacttactttccaatctgactctggcataacattttataagacaaggaaaaaaaaatcaaa

SEQ ID NO: 94413 - DNA, 601 bp, Human
cccgagacacgattgagtcccttttgggtgatgtgaatgaatcagaactcttaagggtcttgtgaggagtgactcaacgtcaacaagaacaatggataatgtaaaaagaaagaaaaaaaattgccctgaatcagtataaaaaatttagagaccagcattagtttattatacagaccatggaataactgcagtataagcttgagtataaaatcaaaatgatttttttataagcagatcatctttcattgtgtacaagtaaaacaaatttaagagcttcgtatagggtcaagatacattcttsagagctgctgaaagctaactcatttcttcggttttgcatcaaccctgtcatccactttgttactttttattaaaatttgggtagctaggttaaaaatggcagccagcccttaaactacatatagttactaaaaaacagacattgtggtgggggctgggtgcggtgtctcacgcctgtaatcccagaactttgggaggctgaggcgggagaatggcttgaacccggaaggcggaggttgcagttagccgagactacgccattgcaccactccggcctgggcaacaacagcgaaactccgtc

SEQ ID NO: 94414 - DNA, 601 bp, Human
atgcacacctgtctaagtggctttggtcttggccttgagaacttcctaagcatgcctcattaggtgctgttcccagccagcaacaccccgccctacccttccacttccccacagctgcctggacatcccatggtctcactcaccaagaaaatggaagaccaagttctcctttccctcatctacaaaatgccacaccaatcaatccaacacacttcaactctcatagtttgttctcaaaacaacctgtcagggccgggtgcggtggctcacacctgtaatcccagcactttgggaggccgargcaggcggattacttgaggtcaggagttcaagaccagcctggccaacatggtgaaaccccatctctactaaaatacaaaaaattacctcccatttacccgagtgttcagggaagagggtcctttggtcaactaaatattgtggttaaccataagcccatatataccagaggtggattttataggcatggtggtgggcacctataatcctagctactcgggaggcagaggtgggaaaatcgcttgaacccggaaggcggaagtggcagtgagccgagatcgcgccactgcacaccagcctg

SEQ ID NO: 94415 - DNA, 601 bp, Human
ttaaggagcaacaagcaaaacagtcagtagaatatactactatttgtgttaaaaagaaaaaaggcagaaggaactcacacatgggatgtacctctgcaagcttctaagggagctgctaccaggctgtttggggagggcctggggacagcagtggcagggacaaaccttgtactctatactccattctactgactgacctggcttcccacgtccatctattatctactctaaacagctcgcctccatttacgaatggggaaaccgaactagggggctggaacagacaacctcaggtccaggrttagtgacaacagatctagacccaagcattcgggttaccaggaaccagctctgatctgctgggctgctctgatgtcaagatcccctggcagctaaacctagtttggctacctagactatgaactgcctgccaactccctcctaactgctgtctacctaccctggcttgttttcctgactcactaattatacccagcatgtatgtttttaataagtcaatttaattttgttaaagtcacaacgtcctttgaaattaaagacgccaaaggaaatcacaaaatcaagggcagaaaataggccg

SEQ ID NO: 94416 - DNA, 601 bp, Human
acatggtgaaaccctgtgtgtactaaaaatacaaacgttagccaggcatggtggcgtgcacccataatcccagctactcgggaggctgagacaggagaatcacttgaactcaggaggtggaggttgcagtgagccaagatcacaccactgcactccagcctgggcaacagagcaagactctgtgtcaaaaaaagaaattatataaatggaatactatattgtagtgaaaatgaaatagacctacatatttttgtagggggctttccagtaaaaaccagaaagccttctagacaaattctaraagacataacagtaatctatacattttcaacatagaaaaacctccctagcaaaacaaaaaactaacctaacaatatacagtggtccctccttaaccatagcttccttttctaccgttgcagttacccacggtcaaatgtggtttgaaaatgtattcccacagtcaaatgtggtctgaaaatgtatcctgagaaagaccacattcacataatttttattatatattgttttaattgttctgtattactagttgttgttaatcccttactgtgcctaatttataaactaaactttatcacag

SEQ ID NO: 94417 - DNA, 601 bp, Human
acctgttatgtgccaaaactgccgcacatgctgcagacacagcaagcgatcaagacaacacacacatcacaacgccaggtagcggtgagtgctacaaataaagcaaggtggggtggggcagctatttcaggcagatcagtggggaactctgataaggcaacatcaagcagggacccgaatgcacagagaggaagccccatgggttacccagggaggaagatgttccagagaggtggaattcaaaatggaaaatctctgagcaccaagaaggaaggggccagaaggctggacagcaggccakacagaagagagggggaggagctgagaggtggccaatcaccaggtgacgggcgaccttgcggacacacttgagttttattcctagtgctataggaagccacatggccctctggtatcaatgcctgaaaaagagacttactcgtacagaacagcatcccatcacagctactgagagagtcataagtaacgtgacaaatactggccaaaagaactttctctgcgtcttcttcaatcttagtcatgacgtttccactcatgtaaataattttttaaaggcagtatctgtccaaatgtggccaga

SEQ ID NO: 94418 - DNA, 601 bp, Human
aattaatgttcaataaaaagcaaaacgggccaggcacagtggctcccatctgtaatccaagcaccgtgggaggcagaggcaggcagatcacctaagccctggagttcaagaccagcctgggcaacatagtgaaaccccatttctactaaaaatacaaaaaatggccaggtgcagtggctcacgcctgtaattccagcactttgggaggccgaggcgagtggattacttgaggtcaggagttcgagaccagcctggccaacacagtgaaacctggtctctactacatatatatatattagcyaggcatggtggcacacacctgtggtcccagctactcaagaggctgaggcaggagaatcacttgaacctgcaaggcagaggttgcagtgagccgagatcaagccactgcactccaacctgggtgacagagtgagactccgtcttaaaaaaaaaaaaaaaagcagaacatctccgcatgggttagctattataatttctgtagtttctgcaaatcatctaaaccagtggttctcaaagtgtggtccaaaacgccgagcatcccagggactctttcagggggtgagggcaaaatcctcatgat

SEQ ID NO: 94419 - DNA, 601 bp, Human
ccgcagttggcacaggcacccacacaaactggtgctggctcccacactgagcattgctgaccagctgcgtggtctctgcacatttgcagaagataatcatatgctgaaaaaggtttcatgcaaacctcattaaagaaattcagtattctgaacttgtctcatctactgtttactaacttaaaagttccagatatatgtgagtctactataaatgtcacttttggcttccttcagttagtactttataggaatactgccttcacttgaaatctaaaatgttcagaccacagcatgggtcacrggaggatatcagactggcccagaattccgattcagttgctttcaccacagagggctgttatgagaattaaatgaattaatgttcaataaaaagcaaaacgggccaggcacagtggctcccatctgtaatccaagcaccgtgggaggcagaggcaggcagatcacctaagccctggagttcaagaccagcctgggcaacatagtgaaaccccatttctactaaaaatacaaaaaatggccaggtgcagtggctcacgcctgtaattccagcactttgggaggccgaggcgagtggattact

SEQ ID NO: 94420 - DNA, 601 bp, Human
cttaattaatttggggacaattcctaactagttcattcaagggtactgtagtccaataaaaactcctaacaaagcttttcttccaaagcatcaacatatcaggtgatgatcaaagaagaacttagatcaccttagataagattacatggtaatccatgactgaaaaactagcccttggcaggactatccagattccagccaagtgagcaagtggaggcaggggtcagaggcgggctctgcatggctccccatcctcgagaaagctccactgcagatccagcatgctgcaccgcagttggcrcaggcacccacacaaactggtgctggctcccacactgagcattgctgaccagctgcgtggtctctgcacatttgcagaagataatcatatgctgaaaaaggtttcatgcaaacctcattaaagaaattcagtattctgaacttgtctcatctactgtttactaacttaaaagttccagatatatgtgagtctactataaatgtcacttttggcttccttcagttagtactttataggaatactgccttcacttgaaatctaaaatgttcagaccacagcatgggtcacgggaggatatca

SEQ ID NO: 94421 - DNA, 601 bp, Human; identical to SEQ ID NO: 25854

SEQ ID NO: 94422 - DNA, 601 bp, Human; identical to SEQ ID NO: 25855

SEQ ID NO: 94423 - DNA, 601 bp, Human; identical to SEQ ID NO: 25856

SEQ ID NO: 94424 - DNA, 601 bp, Human; identical to SEQ ID NO: 25857

SEQ ID NO: 94425 - DNA, 601 bp, Human; identical to SEQ ID NO: 25858

SEQ ID NO: 94426 - DNA, 601 bp, Human; identical to SEQ ID NO: 25859

SEQ ID NO: 94427 - DNA, 601 bp, Human; identical to SEQ ID NO: 25860

SEQ ID NO: 94428 - DNA, 601 bp, Human; identical to SEQ ID NO: 25861

SEQ ID NO: 94429 - DNA, 601 bp, Human; identical to SEQ ID NO: 25862

SEQ ID NO: 94430 - DNA, 601 bp, Human; identical to SEQ ID NO: 25863

SEQ ID NO: 94431 - DNA, 601 bp, Human; identical to SEQ ID NO: 25864

SEQ ID NO: 94432 - DNA, 601 bp, Human; identical to SEQ ID NO: 25865

SEQ ID NO: 94433 - DNA, 601 bp, Human; identical to SEQ ID NO: 25866

SEQ ID NO: 94434 - DNA, 601 bp, Human; identical to SEQ ID NO: 25867

SEQ ID NO: 94435 - DNA, 601 bp, Human; identical to SEQ ID NO: 25868

SEQ ID NO: 94436 - DNA, 601 bp, Human; identical to SEQ ID NO: 25869

SEQ ID NO: 94437 - DNA, 601 bp, Human; identical to SEQ ID NO: 25870

SEQ ID NO: 94438 - DNA, 601 bp, Human; identical to SEQ ID NO: 25871

SEQ ID NO: 94439 - DNA, 601 bp, Human; identical to SEQ ID NO: 25872

SEQ ID NO: 94440 - DNA, 601 bp, Human; identical to SEQ ID NO: 25873

SEQ ID NO: 94441 - DNA, 601 bp, Human; identical to SEQ ID NO: 25874

SEQ ID NO: 94442 - DNA, 601 bp, Human; identical to SEQ ID NO: 25875

SEQ ID NO: 94443 - DNA, 601 bp, Human
ggagagacttgatcactaccatctacctcctggggaacattagttctagaaccgaaacactcagcaatttgcaacctaggatttccaaatcaacacccttataaatcgtcccatgaaataaaatgctatttgttgatttgaaaatgaaaaattagttgacatttcttcaatgagaacccctaggtcaatctgtccataaaaaatttttcacaatggataaagttctattatatgtagaatggtttgcttattctccatgttatgtaaaagcaagaacagctgtgtgttaaccatctaatgktacttatatggtaaccattagctgttgaccatctcaccagagaactgtgcaaaggctaataatttttttttttttttgagatggagtctcgctctgcggcccaggctggagtgtagtggtgcgatcttggctcactgcaagctccgcctcccgggttcacgtcattctcctgcctcagtctcctgagtagctgggactacgggcacccgccaccaggccgggctaatttttttgtatttttagtagagacggggtttcactgtgttagccaggattgtcttgatctcctgacctcgtgat

SEQ ID NO: 94444 - DNA, 601 bp, Human
atggagagggtaaaaaatatgatctatgtgctttactttgacttttggttcgaaatatttgacatgaagaagtgggatcagttttatagtgaagttctaggtaagtatttttttcaatcagtaacatgaagctctaacttatttgtgtctttgaagcagagcttatataaagccataaagtcagggtagtggggttttggtaagtgaatttataaaacaaaaatacaagatgatctattaatctcacaaatattatagaaaagcttaaattacagggtcagttaaaaccctgtggccatcmctcacacagaacaccccaggaaatcataaacctatacattagtgcatctaagactttaagcaattacacatctgttttactatacattgttttacatcttaaaaacagtaaaatccatcaaataacttcttactgaatgcatagatttagaatgagtagttacacatttttctacaactatctatataactgcagaaattgttttttcttgtaaacttgttttcttatttagaaatcaaaagatgttcccatattaccagaaggtttccttcacagtaaagagagataatgtctatacct

SEQ ID NO: 94445 - DNA, 601 bp, Human
ggtaaaaaatatgatctatgtgctttactttgacttttggttcgaaatatttgacatgaagaagtgggatcagttttatagtgaagttctaggtaagtatttttttcaatcagtaacatgaagctctaacttatttgtgtctttgaagcagagcttatataaagccataaagtcagggtagtggggttttggtaagtgaatttataaaacaaaaatacaagatgatctattaatctcacaaatattatagaaaagcttaaattacagggtcagttaaaaccctgtggccatcactcacacrgaacaccccaggaaatcataaacctatacattagtgcatctaagactttaagcaattacacatctgttttactatacattgttttacatcttaaaaacagtaaaatccatcaaataacttcttactgaatgcatagatttagaatgagtagttacacatttttctacaactatctatataactgcagaaattgttttttcttgtaaacttgttttcttatttagaaatcaaaagatgttcccatattaccagaaggtttccttcacagtaaagagagataatgtctatacctcagatgca

SEQ ID NO: 94446 - DNA, 601 bp, Human
agaaatgtgttcctttaatatttgcagacaaacttagtgttcacttgatcttactaaagcatttaaatcattcttcattgagaccccagagatttacatattacagcataaacataccctatgagagcagatgatttttgccgtatgacaagcaacttattaaagcttcctgtgggaactcgtctcaacatcatagctgcctgacacagaagcacagagataatgaacaatgcatgtataataaagcacaaataatttataccacttgtatctgaatggcgcccttagtttagattccagrgaattctgtcagcatataagattatattttttatgaaggaacacaataaactcatatattttaaattaatatcacacttttaagacatatgtacaaagcaagcattctttgttacgttattatttaatctcttaaaagatcatttttgtctacataaaactgaaattttattccattgttaaaactcaatatctatgttgaatgaaaattgtatgggctttatatgataactttctcaagagacaaaagctgaggtaagactaatgaaaaatctatgccaccctaccctactcttgaaaa

SEQ ID NO: 94447 - DNA, 601 bp, Human
cttagtgttcacttgatcttactaaagcatttaaatcattcttcattgagaccccagagatttacatattacagcataaacataccctatgagagcagatgatttttgccgtatgacaagcaacttattaaagcttcctgtgggaactcgtctcaacatcatagctgcctgacacagaagcacagagataatgaacaatgcatgtataataaagcacaaataatttataccacttgtatctgaatggcgcccttagtttagattccagggaattctgtcagcatataagattatattttttatgaaggaacacaataaactcatatattttaaattaatatcacacttttaagacatatgtacaaagcaagcattctttgttacgttattatttaatctcttaaaagatcatttttgtctacataaaactgaaattttattccattgttaaaactcaatatctatgttgaatgaaaattgtatgggctttatatgataactttctcaagagacaaaagctgaggtaagactaatgaaaaatctatgccaccctaccctactcttgaaaaatttccccacccatactaagggaaaaactgat

SEQ ID NO: 94448 - DNA, 601 bp, Human
caaagcaagcattctttgttacgttattatttaatctcttaaaagatcatttttgtctacataaaactgaaattttattccattgttaaaactcaatatctatgttgaatgaaaattgtatgggctttatatgataactttctcaagagacaaaagctgaggtaagactaatgaaaaatctatgccaccctaccctactcttgaaaaatttccccacccatactaagggaaaaactgatagtgtcagtaggagggggaagagaataggaggtgtagaaggacaagaaaagggatgactagyactaaaatagtgataattactactactagctgttgttattaacttgcagaaagatttgaatgcaagtcaatggttgtgaaacccgttcttcgtttattatgtaaaataattgctaacccaggttgctttcatttcaattaaatattaaattctaagataatttcttataagagaaaaagacacttgacaaaatgtatcaggtgttttaaaaatgaatattgctatcagttttataatatgttcacgtgaaatcatacagagaaaaaaattaatcaaggtgtacctattaaacattatgga

SEQ ID NO: 94449 - DNA, 601 bp, Human
ctttctcaagagacaaaagctgaggtaagactaatgaaaaatctatgccaccctaccctactcttgaaaaatttccccacccatactaagggaaaaactgatagtgtcagtaggagggggaagagaataggaggtgtagaaggacaagaaaagggatgactagcactaaaatagtgataattactactactagctgttgttattaacttgcagaaagatttgaatgcaagtcaatggttgtgaaacccgttcttcgtttattatgtaaaataattgctaacccaggttgctttcatttcarttaaatattaaattctaagataatttcttataagagaaaaagacacttgacaaaatgtatcaggtgttttaaaaatgaatattgctatcagttttataatatgttcacgtgaaatcatacagagaaaaaaattaatcaaggtgtacctattaaacattatggaaaatattcataaaattaacattggaagtaatccaacatcttaaatgaaggaatgattaaaaacttatactatgtgcatacaatagcattacaataattttatcaatgaaatattcaactacactgtcagccatatta

SEQ ID NO: 94450 - DNA, 601 bp, Human
aatctatgccaccctaccctactcttgaaaaatttccccacccatactaagggaaaaactgatagtgtcagtaggagggggaagagaataggaggtgtagaaggacaagaaaagggatgactagcactaaaatagtgataattactactactagctgttgttattaacttgcagaaagatttgaatgcaagtcaatggttgtgaaacccgttcttcgtttattatgtaaaataattgctaacccaggttgctttcatttcaattaaatattaaattctaagataatttcttataagagaawaagacacttgacaaaatgtatcaggtgttttaaaaatgaatattgctatcagttttataatatgttcacgtgaaatcatacagagaaaaaaattaatcaaggtgtacctattaaacattatggaaaatattcataaaattaacattggaagtaatccaacatcttaaatgaaggaatgattaaaaacttatactatgtgcatacaatagcattacaataattttatcaatgaaatattcaactacactgtcagccatattacaaataaagtgagttagaaaatgataaatataacaagat

SEQ ID NO: 94451 - DNA, 601 bp, Human
caattaaatattaaattctaagataatttcttataagagaaaaagacacttgacaaaatgtatcaggtgttttaaaaatgaatattgctatcagttttataatatgttcacgtgaaatcatacagagaaaaaaattaatcaaggtgtacctattaaacattatggaaaatattcataaaattaacattggaagtaatccaacatcttaaatgaaggaatgattaaaaacttatactatgtgcatacaatagcattacaataattttatcaatgaaatattcaactacactgtcagccatawtacaaataaagtgagttagaaaatgataaatataacaagatgacaagtttttgcaggaggaaaatgtatacataataagattaaaattatctaaataagtgtcacatgtgtacattgagctatgtaaataggacaaaagccatgatgaaaaaatatattttacataaataatatcacaacataaaaattttagaaaaattttatttaaaaaaatttttttcatgcttttataaaatttcttacattaatcttatattatttttattatgttatcacagaagaagaaacaaccagtccata

SEQ ID NO: 94452 - DNA, 601 bp, Human
aaaaatgaatattgctatcagttttataatatgttcacgtgaaatcatacagagaaaaaaattaatcaaggtgtacctattaaacattatggaaaatattcataaaattaacattggaagtaatccaacatcttaaatgaaggaatgattaaaaacttatactatgtgcatacaatagcattacaataattttatcaatgaaatattcaactacactgtcagccatattacaaataaagtgagttagaaaatgataaatataacaagatgacaagtttttgcaggaggaaaatgtatacayaataagattaaaattatctaaataagtgtcacatgtgtacattgagctatgtaaataggacaaaagccatgatgaaaaaatatattttacataaataatatcacaacataaaaattttagaaaaattttatttaaaaaaatttttttcatgcttttataaaatttcttacattaatcttatattatttttattatgttatcacagaagaagaaacaaccagtccatatcagtgatgaatctgtaaagaggctcgattccttcaacactgggtggataaataaggctctgggcatcaagct

SEQ ID NO: 94453 - DNA, 601 bp, Human
aaattttatttaaaaaaatttttttcatgcttttataaaatttcttacattaatcttatattatttttattatgttatcacagaagaagaaacaaccagtccatatcagtgatgaatctgtaaagaggctcgattccttcaacactgggtggataaataaggctctgggcatcaagctagtgagatgaaacactgaacaccagttacattaaatatggctacaggcaactgcaatcacacgcaatacctagatgccccaagtattacctggaatagcagtacaatgactctcatgttaagmttaaaaatcatattttaaaaaaacactctgtaatatgtggtctgcagagttaacatttggacttttttttctttgttttgtgaagaacagttaggaaaagttttaccccaatcattaaatctgaaagtatttaaatttaaacatcggcatatattggacaacgcaagtcagaataattctcaatcgattgcagccaagcacatcttcactaggaatgttacgtggtgtgtgtgagctactcaaaaaagagacaagatctcccctgcagaaaggcctggtggcctcttctgttctggtgca

SEQ ID NO: 94454 - DNA, 601 bp, Human
ttcatgcttttataaaatttcttacattaatcttatattatttttattatgttatcacagaagaagaaacaaccagtccatatcagtgatgaatctgtaaagaggctcgattccttcaacactgggtggataaataaggctctgggcatcaagctagtgagatgaaacactgaacaccagttacattaaatatggctacaggcaactgcaatcacacgcaatacctagatgccccaagtattacctggaatagcagtacaatgactctcatgttaagattaaaaatcatattttaaaaaaacactctgtaatatgtggtctgcagagttaacatttggacttttttttctttgttttgtgaagaacagttaggaaaagttttaccccaatcattaaatctgaaagtatttaaatttaaacatcggcatatattggacaacgcaagtcagaataattctcaatcgattgcagccaagcacatcttcactaggaatgttacgtggtgtgtgtgagctactcaaaaaagagacaagatctcccctgcagaaaggcctggtggcctcttctgttctggtgcaagtgctgcctctgagacacaaca

SEQ ID NO: 94455 - DNA, 601 bp, Human
ttttataaaatttcttacattaatcttatattatttttattatgttatcacagaagaagaaacaaccagtccatatcagtgatgaatctgtaaagaggctcgattccttcaacactgggtggataaataaggctctgggcatcaagctagtgagatgaaacactgaacaccagttacattaaatatggctacaggcaactgcaatcacacgcaatacctagatgccccaagtattacctggaatagcagtacaatgactctcatgttaagattaaaaatcatattttaaaaaaacactctrtaatatgtggtctgcagagttaacatttggacttttttttctttgttttgtgaagaacagttaggaaaagttttaccccaatcattaaatctgaaagtatttaaatttaaacatcggcatatattggacaacgcaagtcagaataattctcaatcgattgcagccaagcacatcttcactaggaatgttacgtggtgtgtgtgagctactcaaaaaagagacaagatctcccctgcagaaaggcctggtggcctcttctgttctggtgcaagtgctgcctctgagacacaacaaagtgat

SEQ ID NO: 94456 - DNA, 601 bp, Human
tcatgttaagattaaaaatcatattttaaaaaaacactctgtaatatgtggtctgcagagttaacatttggacttttttttctttgttttgtgaagaacagttaggaaaagttttaccccaatcattaaatctgaaagtatttaaatttaaacatcggcatatattggacaacgcaagtcagaataattctcaatcgattgcagccaagcacatcttcactaggaatgttacgtggtgtgtgtgagctactcaaaaaagagacaagatctcccctgcagaaaggcctggtggcctcttctrttctggtgcaagtgctgcctctgagacacaacaaagtgatgatgagagttcctcacatgcagttataaacagcacatcaatttaacagtgtgatttcagggaaaagttattccacctaaagaatcacctgaaaaatatgatcattcaactatgtaactatatacaattctgtatgataaatgagactcctggactaattcatagaaattccaaattacattaccagactccagaatgtcagcggttcttaaccaccagcttttatttattttattttttttagtttttgaaaaactacca

SEQ ID NO: 94457 - DNA, 601 bp, Human
aaagtttgaagtaatccaattatagaaacttctgataaatgtgaagttgaccaaaagttgaaaaattagaacaaggataatcttggagaaactatgagaagtttgaaaattgtggttgcatttttttttaaatggtgttaagtatgaacattcccctatgtaaatatgctgacaataaattgaatggagaaaggtatttaaaaagtgtttggagacttctcacctcctgtccataaaattttgaattgtgtatgtgatctacatagaaagaatattaaagagtagattgaactcttcatakctgaatatagccttaaatatgcttgtatagcatccaccgacagaagtaatagttgtgcctcagacttaggggttgcatgtggccctggaggagttactacccttggtatgcatgagtagttcctattagcatcagtgggaactcagtactccatatgtattcacaaaaggcaacttgagacccacagttatttttaatttctgatattaacactcatacatactgctgaatttaactcaatatatttcagttaagtgaaaatggtgcttaatgtagtctttagaatgactttcaggtgtt

SEQ ID NO: 94458 - DNA, 601 bp, Human
ataaattgaatggagaaaggtatttaaaaagtgtttggagacttctcacctcctgtccataaaattttgaattgtgtatgtgatctacatagaaagaatattaaagagtagattgaactcttcatagctgaatatagccttaaatatgcttgtatagcatccaccgacagaagtaatagttgtgcctcagacttaggggttgcatgtggccctggaggagttactacccttggtatgcatgagtagttcctattagcatcagtgggaactcagtactccatatgtattcacaaaaggcaayttgagacccacagttatttttaatttctgatattaacactcatacatactgctgaatttaactcaatatatttcagttaagtgaaaatggtgcttaatgtagtctttagaatgactttcaggtgttttcacaaaaaacgtatatccagaactgtgtccttttagaaatacaagtaaaatttttgataattagcttcaaaacagttttcctaatctcagcagtatccaatgagtgaagaacacttgactgactcttgggtcacctctattacttattgtactctggaagctcttggtgaat

SEQ ID NO: 94459 - DNA, 601 bp, Human
ggtgtatctgagtaatgttcagggtactattcagagacagaacagcctaggcggacagacaactatcccaagtacccacatagccagatagatttagagaaagagaaaaagcctgccctgctggactgcgcccagccaatgtctgaagcaggaagatgaaagggtggagatggatcctgccctgaaggtggaccctgtgcagtataaaatgtggccccacaaggactctgcactatcagattaacaactcctcccaatggaggaagcagaaggaaatatagaagggagtcaaacagaaggmggccaggcacagaaacaacttcagataccccctctataaaatatagtagaaatatattatcttttatatagaataagccagtgacctttgtgtatttgtcaattactttttaatttcctgcctgataaagctttcttgtaatgacctcttccaacttttgctgaaacctgagttactttaacactgatgtagcaaataaaagttaaacactgtaaattattgtttagtttatgaggattgcttgggagtttcaaaattagtaacttaaacataaaatgtcttggctatagcagaacatgt

SEQ ID NO: 94460 - DNA, 601 bp, Human
acagacaactatcccaagtacccacatagccagatagatttagagaaagagaaaaagcctgccctgctggactgcgcccagccaatgtctgaagcaggaagatgaaagggtggagatggatcctgccctgaaggtggaccctgtgcagtataaaatgtggccccacaaggactctgcactatcagattaacaactcctcccaatggaggaagcagaaggaaatatagaagggagtcaaacagaaggcggccaggcacagaaacaacttcagataccccctctataaaatatagtagaaatwtattatcttttatatagaataagccagtgacctttgtgtatttgtcaattactttttaatttcctgcctgataaagctttcttgtaatgacctcttccaacttttgctgaaacctgagttactttaacactgatgtagcaaataaaagttaaacactgtaaattattgtttagtttatgaggattgcttgggagtttcaaaattagtaacttaaacataaaatgtcttggctatagcagaacatgttaatcactattgtcaaagctttgtagcacgttgtctcagtgttaataatcagtt

SEQ ID NO: 94461 - DNA, 601 bp, Human
gtcaattactttttaatttcctgcctgataaagctttcttgtaatgacctcttccaacttttgctgaaacctgagttactttaacactgatgtagcaaataaaagttaaacactgtaaattattgtttagtttatgaggattgcttgggagtttcaaaattagtaacttaaacataaaatgtcttggctatagcagaacatgttaatcactattgtcaaagctttgtagcacgttgtctcagtgttaataatcagttaaccaaattcagcaagatacaattttgagttttttcaacagctrtgtttttattcatgacaccaacagattcttcatttctatgctgaaaaatatccaaaattagaaatactgataatactctgaatttgtgtcaaaaataaccacctgaaatttattttggaagtagtgcttgataatttataattccaatgaagttatacataaaacctttgcagcattaatctatttcttataagtagcttatttatggacttgttattttgtcaatcaaaggacaacaggctctaatataacaacctacacacaagtagatacatgtgaactacttcccaaattactcaa

SEQ ID NO: 94462 - DNA, 601 bp, Human
aaattcagcaagatacaattttgagttttttcaacagctgtgtttttattcatgacaccaacagattcttcatttctatgctgaaaaatatccaaaattagaaatactgataatactctgaatttgtgtcaaaaataaccacctgaaatttattttggaagtagtgcttgataatttataattccaatgaagttatacataaaacctttgcagcattaatctatttcttataagtagcttatttatggacttgttattttgtcaatcaaaggacaacaggctctaatataacaacctacayacaagtagatacatgtgaactacttcccaaattactcaaaaagatatgaatacattaaaattaaatttggaaaatgaaaactaatataaaatacataaaacaaaataagcacgcaggtcattacaaaattgttactattttttacactagaattataaggaatagctaaaatttttatacatttttagaatatttttaattttaaaaaattaaattaatttaacttttatttgtaacttttattttaagttcaaggggacatgtgtagtttttttacataggtaaacttgtgtcatgggg

SEQ ID NO: 94463 - DNA, 601 bp, Human
tttcaacagctgtgtttttattcatgacaccaacagattcttcatttctatgctgaaaaatatccaaaattagaaatactgataatactctgaatttgtgtcaaaaataaccacctgaaatttattttggaagtagtgcttgataatttataattccaatgaagttatacataaaacctttgcagcattaatctatttcttataagtagcttatttatggacttgttattttgtcaatcaaaggacaacaggctctaatataacaacctacacacaagtagatacatgtgaactacttccmaaattactcaaaaagatatgaatacattaaaattaaatttggaaaatgaaaactaatataaaatacataaaacaaaataagcacgcaggtcattacaaaattgttactattttttacactagaattataaggaatagctaaaatttttatacatttttagaatatttttaattttaaaaaattaaattaatttaacttttatttgtaacttttattttaagttcaaggggacatgtgtagtttttttacataggtaaacttgtgtcatggggggttattgtactgttcgtttcatcaccc

SEQ ID NO: 94464 - DNA, 601 bp, Human
atatttttaattttaaaaaattaaattaatttaacttttatttgtaacttttattttaagttcaaggggacatgtgtagtttttttacataggtaaacttgtgtcatggggggttattgtactgttcgtttcatcacccagatattaaggctaaaatcagttaattatttttcctgatcctcccaccctccaccctccaatacaccacagtgtatgttgttcctgtctatttgtccacatgttctcatctttcaccttccacttataagtgaggacatgccatatttatatttccatccckttgttagtttgctaaggataatggcctccagctccatccatatccctgcaaaatacataattttgttcttttttatgactgcataatattctgtagtgtatatgtaccatattttctctattcagcccataatcaatgggcatttaggttgattccatgtcgttgctattgtgaaaagtactgcaattaatacacctgtgcatgggtctttataaaagaaccatttatagtccgttggttatatacccagtaatgggattgctgggtttcatggtatttttacctctaggtttttgagga

SEQ ID NO: 94465 - DNA, 601 bp, Human
cctccaccctccaatacaccacagtgtatgttgttcctgtctatttgtccacatgttctcatctttcaccttccacttataagtgaggacatgccatatttatatttccatccctttgttagtttgctaaggataatggcctccagctccatccatatccctgcaaaatacataattttgttcttttttatgactgcataatattctgtagtgtatatgtaccatattttctctattcagcccataatcaatgggcatttaggttgattccatgtcgttgctattgtgaaaagtactgcarttaatacacctgtgcatgggtctttataaaagaaccatttatagtccgttggttatatacccagtaatgggattgctgggtttcatggtatttttacctctaggtttttgaggaatcgccagtcttccacaatggttgaactaacttacattcccaccaacagattataagcaagccttttctatactacctcaccagtatcatgatattttttgagtttttaataatagccattctgactggtgtgagatgctatctcattatggttttgatttgcatttctctaatgatgttaagctt

SEQ ID NO: 94466 - DNA, 601 bp, Human
tccacatgttctcatctttcaccttccacttataagtgaggacatgccatatttatatttccatccctttgttagtttgctaaggataatggcctccagctccatccatatccctgcaaaatacataattttgttcttttttatgactgcataatattctgtagtgtatatgtaccatattttctctattcagcccataatcaatgggcatttaggttgattccatgtcgttgctattgtgaaaagtactgcaattaatacacctgtgcatgggtctttataaaagaaccatttatagtcygttggttatatacccagtaatgggattgctgggtttcatggtatttttacctctaggtttttgaggaatcgccagtcttccacaatggttgaactaacttacattcccaccaacagattataagcaagccttttctatactacctcaccagtatcatgatattttttgagtttttaataatagccattctgactggtgtgagatgctatctcattatggttttgatttgcatttctctaatgatgttaagcttttttctttttttttttcatatgatggttggccacacgtaggttttct

SEQ ID NO: 94467 - DNA, 601 bp, Human
ccagctccatccatatccctgcaaaatacataattttgttcttttttatgactgcataatattctgtagtgtatatgtaccatattttctctattcagcccataatcaatgggcatttaggttgattccatgtcgttgctattgtgaaaagtactgcaattaatacacctgtgcatgggtctttataaaagaaccatttatagtccgttggttatatacccagtaatgggattgctgggtttcatggtatttttacctctaggtttttgaggaatcgccagtcttccacaatggttgaacwaacttacattcccaccaacagattataagcaagccttttctatactacctcaccagtatcatgatattttttgagtttttaataatagccattctgactggtgtgagatgctatctcattatggttttgatttgcatttctctaatgatgttaagcttttttctttttttttttcatatgatggttggccacacgtaggttttcttttaaaaggtgtaacaattttttaaatgcttgaaattttcattgataatctgattttttctaaggtactattttggaaaatcatgatttccttat

SEQ ID NO: 94468 - DNA, 601 bp, Human
tgatattttttgagtttttaataatagccattctgactggtgtgagatgctatctcattatggttttgatttgcatttctctaatgatgttaagcttttttctttttttttttcatatgatggttggccacacgtaggttttcttttaaaaggtgtaacaattttttaaatgcttgaaattttcattgataatctgattttttctaaggtactattttggaaaatcatgatttccttatatacctaactaattataaaagttgagaaaattaatgtgagtattctatttacattagtcttgaagtagttcttatttactaacatcccttgatctcattcctactctttatacagttctcacattctataacttttgaattccactcatggaataaaatattttctttattgtaacaggttctgtggagatttgatgggaataaaccagataccttaggtctcaatactcggctgtataagtggataccccagaatgaccttctaggtaagactctggtgaacaaatactgaatatattagtaacagcacattagagtgttaatagttcttcatgaaacaagcttattgaatatttgttaag

SEQ ID NO: 94469 - DNA, 601 bp, Human
tattttttgagtttttaataatagccattctgactggtgtgagatgctatctcattatggttttgatttgcatttctctaatgatgttaagcttttttctttttttttttcatatgatggttggccacacgtaggttttcttttaaaaggtgtaacaattttttaaatgcttgaaattttcattgataatctgattttttctaaggtactattttggaaaatcatgatttccttatatacctaactaattataaaagttgagaaaattaatgtgagtattctatttacattagtctttaagtagttcttatttactaacatcccttgatctcattcctactctttatacagttctcacattctataacttttgaattccactcatggaataaaatattttctttattgtaacaggttctgtggagatttgatgggaataaaccagataccttaggtctcaatactcggctgtataagtggataccccagaatgaccttctaggtaagactctggtgaacaaatactgaatatattagtaacagcacattagagtgttaatagttcttcatgaaacaagcttattgaatatttgttaaggaa

SEQ ID NO: 94470 - DNA, 548 bp, Human
ttgaaattttcattgataatctgattttttctaaggtactattttggaaaatcatgatttccttatatacctaactaattataaaagttgagaaaattaatgtgagtattctatttacattagtctttaagtagttcttatttactaacatcccttgatctcattcctactctttatacagttctcacattctataacttttgaattccactcatggaataaaatattttctttattgtaacaggttctgtggagatttgatgggaataaaccagataccttaggtctcaatactcggctstataagtggataccccagaatgaccttctaggtaagactctggtgaacaaatactgaatatattagtaacagcacattagagtgttaatagttcttcatgaaacaagcttattgaatatttgttaaggaaaaacaaaatgtaacttctttatattgattttccagtcttaagggagaaagaatacattataatttttggcattttatgatatacacccacattctttatagtctgaatcgggggaat

SEQ ID NO: 94471 - DNA, 545 bp, Human
aaattttcattgataatctgattttttctaaggtactattttggaaaatcatgatttccttatatacctaactaattataaaagttgagaaaattaatgtgagtattctatttacattagtctttaagtagttcttatttactaacatcccttgatctcattcctactctttatacagttctcacattctataacttttgaattccactcatggaataaaatattttctttattgtaacaggttctgtggagatttgatgggaataaaccagataccttaggtctcaatactcggctgtayaagtggataccccagaatgaccttctaggtaagactctggtgaacaaatactgaatatattagtaacagcacattagagtgttaatagttcttcatgaaacaagcttattgaatatttgttaaggaaaaacaaaatgtaacttctttatattgattttccagtcttaagggagaaagaatacattataatttttggcattttatgatatacacccacattctttatagtctgaatcgggggaat

SEQ ID NO: 94472 - DNA, 453 bp, Human
attaatgtgagtattctatttacattagtctttaagtagttcttatttactaacatcccttgatctcattcctactctttatacagttctcacattctataacttttgaattccactcatggaataaaatattttctttattgtaacaggttctgtggagatttgatgggaataaaccagataccttaggtctcaatactcggctgtataagtggataccccagaatgaccttctaggtaagactctggtgaacaaatactgaatatattagtaacagcacattagagtgttaatagttcwtcatgaaacaagcttattgaatatttgttaaggaaaaacaaaatgtaacttctttatattgattttccagtcttaagggagaaagaatacattataatttttggcattttatgatatacacccacattctttatagtctgaatcgggggaat

SEQ ID NO: 94473 - DNA, 601 bp, Human
gttagagtggacttcaacacaatgtcgagtacagacttgctgaatgcattgaagagagtaattaatgatccttcgtgagtagaacaatatttttcactaggtggtatttacagatagcttctcttgtcaatagtgagtgtgagtttcatcctttttataagagactaattttgaaagaatttaaatgatttaaccaatctgaaatctgcttttatttttataagttatttaaaaattgaatttgaaacacatacatctaaagaatagccagttagtgaaacaattttctacacaaaaatawttttaaaaggatatagataatacaaaaaatacatttcttaaaaatttgacataattaatccatagaagaaaggaagaataaacctgaaataatataataaaatattttaattagatatctaaaacacctcagagtataaccattttcttgctgaaaaattaacttttattattatcattattgtaacagacttgaaaatgagatttaatttttatagcataaaacccccctgtttatgttataaaatccaaatatatttagtatgtttacagagccatgaagccatcactattacataat

SEQ ID NO: 94474 - DNA, 601 bp, Human
atttttataagttatttaaaaattgaatttgaaacacatacatctaaagaatagccagttagtgaaacaattttctacacaaaaataattttaaaaggatatagataatacaaaaaatacatttcttaaaaatttgacataattaatccatagaagaaaggaagaataaacctgaaataatataataaaatattttaattagatatctaaaacacctcagagtataaccattttcttgctgaaaaattaacttttattattatcattattgtaacagacttgaaaatgagatttaattttkatagcataaaacccccctgtttatgttataaaatccaaatatatttagtatgtttacagagccatgaagccatcactattacataattttagaacatttttatcaacacaaaagaaactgcaatgacacagaagtcacttcctatgaccgcttagccctggtctaactaatttgtttcctttctctatagattattctctttagatatttcatatgaatggaatcatacagtttagggtgttgtgaaatgacatttcacctaggctaattttttgttgttttttttttctggttttagtt

SEQ ID NO: 94475 - DNA, 601 bp, Human
tagttgttcacttatcagttcattggccttttgattgttttcaattgtggctattaggaagattgctacacatgtttttgcataaacatgttttcctttctttagggttgatactataagtggaattgctgcttcatgtgggaactgtatgtttatgaagaactgctaaactgtcttccaaagtacttgtttcattcatgactaccaccagcagtacaacatggttccaattcctccatacttttgccaaacctgttattccctgactttttgttacagccttcttagtgggtgtaaaatratctctcatcctggtcttggattgcattttcattacggctaaaggtgttgagaatcttcatacgtgcctactgatcattcatatatcttctttgaaaacagtctatccaatccttggaacatttttaaactttgctatttgtcttattattaagtttaagaactatttatatattatgggtcatgtcagatatataacttgtaaatattttgtcccactctgggtgcactaaattttactttttgatgttggtctttgaagcacaaaaaatataattttgttaaatttttaataattgat

SEQ ID NO: 94476 - DNA, 601 bp, Human
cttcttagtgggtgtaaaataatctctcatcctggtcttggattgcattttcattacggctaaaggtgttgagaatcttcatacgtgcctactgatcattcatatatcttctttgaaaacagtctatccaatccttggaacatttttaaactttgctatttgtcttattattaagtttaagaactatttatatattatgggtcatgtcagatatataacttgtaaatattttgtcccactctgggtgcactaaattttactttttgatgttggtctttgaagcacaaaaaatataattttattaaatttttaataattgattttttcaaacccaaagatatcaatgtgcaaaattccttgtggagtccagctaccatcaattcagcatttatagctactatcaataatgtttttttatataagcagggtatcatctaaaggaatacttgaaaaatactttatcacaaaaaaagaaggataatgaatgataaaaatacctttaaagaagataggaaataattgaaaaagaacacaaaccagcttggacaaatagaaaaaaaatatataaagcaaattggtagatttaaatatgattatacaa

SEQ ID NO: 94477 - DNA, 601 bp, Human
tatataagcagggtatcatctaaaggaatacttgaaaaatactttatcacaaaaaaagaaggataatgaatgataaaaatacctttaaagaagataggaaataattgaaaaagaacacaaaccagcttggacaaatagaaaaaaaatatataaagcaaattggtagatttaaatatgattatacaaatactttcactcaatctaaacagactttagaaaagagcaagtaattagtaaagacataaaacatttgaagaacacaattaacaaatggaatcttataatgtaaaatgatacaaaygcacatacatacacacacaataaacatatatgtatcatatatatcaacttgaagacacattttcctagagcatgtcgaatagttatctgaagtgatatgtggtgggcaataaatcaagatttagtacatataataaggttcaatatcataaagactatatgatccagccatagtggaagtaagggaggttataaaaactataactaacatatctttaaattttagagatcaagaggtgaatcacaactatgtctccacttttatctcaacaattctactcccagttatatacccaacaga

SEQ ID NO: 94478 - DNA, 601 bp, Human
acacattttcctagagcatgtcgaatagttatctgaagtgatatgtggtgggcaataaatcaagatttagtacatataataaggttcaatatcataaagactatatgatccagccatagtggaagtaagggaggttataaaaactataactaacatatctttaaattttagagatcaagaggtgaatcacaactatgtctccacttttatctcaacaattctactcccagttatatacccaacagatatgtataaataaatctaataccatatagaatatttatgacagaattatcaataytgtccaaaaattgttagcaacccaaatatctattaatcataaaatgaagacataatctgtgctttatcaatcaacagaatactacacagcaatggaattacccaacaactgctacattaaaaaaagacactaatgagtacgtattatataattcaattacataaacaagcaaactaatgtatgctattcgaagtcaggctaatccttagttggtggacaaaagtggtgactaaatggttcagaaaaagagagttattctaggcaggttgtgatatcctataccacaatctgaacagtagg

SEQ ID NO: 94479 - DNA, 601 bp, Human
aaatgaaatccacaagcagacagcccagtgccacaccctgtgcctgatagttaaagatcgacccctgacctaaccagttatgttatctatagattccagacattgtatggaaaagcattgtaaaaatccctgtcctgttctgttccattctgattactggtgcatgcagcccccagttatgtacccactgcttgctcaatcgatcatgaccctctcacgcagacccccttagagttgtgagcccttaaaagggacaggaattgctcactcagggagttcagctcttgagagaggagtcttrccgatgctcccagccgaataaaacccttccttctttaactcggtgtctgaggggttttgtctgtaactcttcctgctacattactgtctttatttttatctttcagatataaagagaatgttatgaaattatcaagaattcaacatgatcaaccagtgaagcccctggatcgagcagtcttctggattgaatttgtcatgcgccacaaaggagctaaacaccttcgggttgcagcccacgacctcacctggttccagtaccactctttggatgtgattgggttcctgctggtctgtgtgg

SEQ ID NO: 94480 - DNA, 601 bp, Human
tctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatrtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatca

SEQ ID NO: 94481 - DNA, 601 bp, Human
ttacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcktaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtga

SEQ ID NO: 94482 - DNA, 601 bp, Human
aagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgctcgcacttctctctcctgccactaagtgagaagatccaagcttgcttccccttagcctttcaccatgattctaagtttcttgaggcatcccagtcatgtrgaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacact

SEQ ID NO: 94483 - DNA, 601 bp, Human
tatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgctygcacttctctctcctgccactaagtgagaagatccaagcttgcttccccttagcctttcaccatgattctaagtttcttgaggcatcccagtcatgtggaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaa

SEQ ID NO: 94484 - DNA, 601 bp, Human
gaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtcsagggagggacccagtggcaggtgattggatcatggtgtggattcctccatgctgttctcatgatattgagtgagctctcatgagatctgatagttttataagtgtctggtatttcccctgctcgcacttctctctcctgccactaagtgagaagatccaagcttgcttccccttagcctttcaccatgattctaagtttcttgaggcatcccagtcatgtggaactgagtctattaaacttcttttctttataaattacccagtctcaggtatttctttacagcagtgtgagaatggact

SEQ ID NO: 94485 - DNA, 601 bp, Human
caaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagakctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgctcgcacttctctctcctgccactaagtgagaa

SEQ ID NO: 94486 - DNA, 601 bp, Human
tcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctacyaaatctcttgtgtttatttggggtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggt

SEQ ID NO: 94487 - DNA, 601 bp, Human
tcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatrttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttc

SEQ ID NO: 94488 - DNA, 601 bp, Human
ttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgarcagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacag

SEQ ID NO: 94489 - DNA, 601 bp, Human
aaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgytttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagag

SEQ ID NO: 94490 - DNA, 601 bp, Human
ttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctyctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctatt

SEQ ID NO: 94491 - DNA, 601 bp, Human
cccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtagg

SEQ ID NO: 94492 - DNA, 601 bp, Human; identical to SEQ ID NO: 94480

SEQ ID NO: 94493 - DNA, 601 bp, Human; identical to SEQ ID NO: 94481

SEQ ID NO: 94494 - DNA, 601 bp, Human; identical to SEQ ID NO: 94482

SEQ ID NO: 94495 - DNA, 601 bp, Human; identical to SEQ ID NO: 94483

SEQ ID NO: 94496 - DNA, 601 bp, Human; identical to SEQ ID NO: 94484

SEQ ID NO: 94497 - DNA, 601 bp, Human; identical to SEQ ID NO: 94485

SEQ ID NO: 94498 - DNA, 601 bp, Human; identical to SEQ ID NO: 94486

SEQ ID NO: 94499 - DNA, 601 bp, Human; identical to SEQ ID NO: 94487

SEQ ID NO: 94500 - DNA, 601 bp, Human; identical to SEQ ID NO: 94488

SEQ ID NO: 94501 - DNA, 601 bp, Human; identical to SEQ ID NO: 94489

SEQ ID NO: 94502 - DNA, 601 bp, Human; identical to SEQ ID NO: 94490

SEQ ID NO: 94503 - DNA, 601 bp, Human; identical to SEQ ID NO: 94491

SEQ ID NO: 94504 - DNA, 601 bp, Human
caccacacccaactaatttttgtatttttagtagagacagggtttcaacatgttggccaggatggtcttgatctcttgacctcatgatccacccaccttggcctcccaaagtgccaggattacagacaggagccaccgtgcctggccaccggattctttttattacagacttaaactggacactgggctgtgaccatcagcagtgtaatgtgaacctggcctcatctgtgctgggataaagcaccaaagagaaccctgtggaagaaacctctgcgctcccctcccaggactagcacctccyggcttcctgcacaccaagtggaggtgaagataaagaaagagtcacagagaagaaataaaacacgtagccagcaaaacactcctttagatgatgagagagcagatgcaggaaggggctctaccaagcttcctatgtcgtacataatttccagctcctaacatatttgcaaagcttattacaataaaacactcatgtctgcaaaaggcataaagagatatttcacgtcacccctctacttctttgttccagtgagactctctctgtgcaagtacaagtcatgataacacaatacatatttta

SEQ ID NO: 94505 - DNA, 601 bp, Human
cccaaagaaagctggggttttgtttgtttgtttgtatgttttgagatggaatctcgtcctgtcacccaggctggagtgcagtggtacgatctcgactcaccgcaacctccatctcccaggttcaagcgattctcctgcctcagcctcccgagtagccgggactacaggcgcccgccaccacacccaactaatttttgtatttttagtagagacagggtttcaacatgttggccaggatggtcttgatctcttgacctcatgatccacccaccttggcctcccaaagtgccaggattacagrcaggagccaccgtgcctggccaccggattctttttattacagacttaaactggacactgggctgtgaccatcagcagtgtaatgtgaacctggcctcatctgtgctgggataaagcaccaaagagaaccctgtggaagaaacctctgcgctcccctcccaggactagcacctcctggcttcctgcacaccaagtggaggtgaagataaagaaagagtcacagagaagaaataaaacacgtagccagcaaaacactcctttagatgatgagagagcagatgcaggaaggggctctaccaag

SEQ ID NO: 94506 - DNA, 601 bp, Human
tcctcattttgagtctctttcatccccaaaatatgtgttccttcagctcctgagaggacctcccctggaattactacaagggaagcccaaagaaagctggggttttgtttgtttgtttgtatgttttgagatggaatctcgtcctgtcacccaggctggagtgcagtggtacgatctcgactcaccgcaacctccatctcccaggttcaagcgattctcctgcctcagcctcccgagtagccgggactacaggcgcccgccaccacacccaactaatttttgtatttttagtagagacagrgtttcaacatgttggccaggatggtcttgatctcttgacctcatgatccacccaccttggcctcccaaagtgccaggattacagacaggagccaccgtgcctggccaccggattctttttattacagacttaaactggacactgggctgtgaccatcagcagtgtaatgtgaacctggcctcatctgtgctgggataaagcaccaaagagaaccctgtggaagaaacctctgcgctcccctcccaggactagcacctcctggcttcctgcacaccaagtggaggtgaagataaagaaaga

SEQ ID NO: 94507 - DNA, 601 bp, Human
cagcagataagcaagacccctaccatggcagccactgcctagccaagagccctgcacagagggggagcccaatttatgtggatgaatcaccctgagatggactcaggcaaccgcattgaggatagcagggtccgcacagggagaggcaaagtccctgtctaccgtcactcagcagggctgtcacccacaggagcagaacagggcaccgcctgccctcacattctggaaggcgattaaatgcagagcgtggctgttattgccaaatgaggtaaaaacagagctgaagcatccacccacaggraaaaagcaaggataatgcaccgttaacctgggtcctgctactgggtcaccacccctaaataaatacagtctgtggtgatcaaatgataattacatcttgtaatctaatgctatcactttttgtgttaaaagcacttaattgctcagagtaaatattttaaatgattggactttgttagctcctcattttgagtctctttcatccccaaaatatgtgttccttcagctcctgagaggacctcccctggaattactacaagggaagcccaaagaaagctggggttttgtttgtttgtttgta

SEQ ID NO: 94508 - DNA, 601 bp, Human
aaaagcaagcaagcaacagcagcaacaaaactaggctgactgcatctgagtttcaggggaccacaaacacaggccttggttcgatatggaatctgaacgcgcttgccactggagaatgaacagcaggcccaggcctgcggtgggcagagctgagaaacagcctctgtcctgcgctttgcaaatgccccctcatccgcctaaccccacccctcagccgaccccctgcaccctctctccaggcactgggcagcacccctcctcctagaaagaatggaaactcaccaggagatgtgagttcccrgcaatagcttcacctgagatgatgggtgaaaggggctctctagcccgtaggacagtatcttgcagtgttctgactgacactaaagctaactaacagtctctaaaggaatgatcccccacggccatgagaaagccaaggagaggctccaggcgggcactccagcctctcttgttcccaccataagaagaggaaagagaaggggaaaaggagactctcataacttttaaattgcattcacggagcccttgctagaaagatctccccaaaaggagccaggggcttgcggtcccctgcctgggt

SEQ ID NO: 94509 - DNA, 601 bp, Human
tcccaagcagtataagagagtgctactacgagaattctatgccagtcagggccagggcctcgtgcctgtaatcccagcactgtgggaggccgaggcgtgtaggtcgcttgagcccaggagttcaagaccagtctgggcaacacagtgagaccctgtctttacaaaaaaatacaaaaattagctggatgtggtggcacacacctgtagtcccagctactttggaggctgagatgaaaggatcatctaagcctggggaggtggaggttgcagtgagctgtgatcacgccactgcactgcagcytgagcgatggagggagaccctcaaaataattctatctagaggctttgggttttagagcattcatatgcaaaggtctccccacttccaccctcgccccttcagggggttctcaacacaccagcaggaggggtcctcctaaagtgcccccagtcttacccagaggcaaaatccaagtccccgcaagtgggtgtcaggcaccaccgtggaatctctgcgcccgggttggcatggctgcccgtctctctcatcctcacagggtcagccccagcctctgaaacctccaaggcacacacctgcctt

SEQ ID NO: 94510 - DNA, 601 bp, Human
acgttaacgcttcctgcgattccatacctgagaagacaaaaggctgaatgaggaagtcactagggggtcttaactccagcaaagagcctgggaccctaaaacgccagcagtgcagtcccctctcgttctgtgtctctggagtctccaagtcacacgtgcagaagaaggcgattatgcctggcaggatacctctcagccttgcctcccttacaccttggagtcgttgtcatattttcttagccttccaatgagatgacccaggactcagtctcactaaaacacaaacccagtctcagcacgrggagatggagcagatggggggactcatcaaatcagacccattgccataactgaggactccaaaagtaaaggactgtggcctccagctcctggaatttgttttttcttttttccttttttttttgaaacggagtcttgctctgtcgcccaggctggagtgcagtggcacgaactctgctcactgcaagctccgcctcctgggctcacgccgttctcctgcctcagcctccggagtagctgggactacaggcgcccgccaccacgcccggctaatttttttctgtatttttagtagagacgg

SEQ ID NO: 94511 - DNA, 601 bp, Human
acgagggcaaaagtgccttttgcagtacctggcatagagcagaggttaaataaatttggctttactttaaattcttttccattcctccagctaatcacaaagaaatggcctcttgtctattgactatattgcagctgaacattgattgaaacttttggccattggcaaacctctctgtataataagctgtgtgtgaacccatagtgaatgcagaccctccccagccgtgccttccttcaccgacttcaccatcctacgaggtaagagcacaggaggcttgtggttttgtttctggaccagyctaacagcttgtcaggcactaagaaatctctgctgaaactgtaacccctcgcaaagtgccggctgggggcgggggtggaatgagaaggcggggcggtgagaggctgtacagtacagctcttccctggactccacaaggttaagcccccaaaaatttggctcttgttactgattaagtgaacagccacgaacaagcgcccactgaggcggttcctgcatcactctgaacaatttcctgaatgaatcactgtcctactgtggagtcttctttctctagacagcacaagatttccaagtagag

SEQ ID NO: 94512 - DNA, 601 bp, Human
gtttgtttccggggggtcagcgatcccggcagcaaggctggatttcatggcactgacattccagtgggagaacagacagagagcacacaggtcaggacacatacaagcaggctgtggcacgtgccctaacgaaaacccacataggctgggggctggagagccatgagggggggtcacatttgatgacagacctgactagaattaaggaatgaagaaacacacagagacctagaaagcaaaattgtttgttttcttgtttttgttttgttttgacagagtctcactctgttgcccaggatgragtgcagtggtgtggtcagagctcgctgcagcctagagatcctgggctcaagcaatcctcccacctcagactcccaagtagctgggactacaggtgcacaccaccatgccgagctaaatttttatcttttgtatctttatgttgcctaggctggtctcaaactcctgagctcaagcaattctcccacctcagactcccgagtagctgggactacaggtgcacaccaccatgccgagctaaatttttatcttttgtatctttatgttgcctaggctggtctcaaactcctgagctcaagca

SEQ ID NO: 94513 - DNA, 601 bp, Human
cagaccacgtatttcccctaaatcagagaggaaagcaccaactgatcagcacatcttcccattagcacaattgctctgtgtcagggctgtgcgtggcagagtacaccacatcaaaaagagattgagaaccacagcatatctttatcaaaaaacaccatgacttacggagggcagggtgccagtttatacacaaatactcctctgggttttgtatccatctcacctgtctgatgcgaagaccagaagataaagtgggtgtgtcttgagagaccaacgtcccccacacccacccactctgctrtcacaggcagctcaagccaccaagggaagccccaggtcctttttatagccccctgtgtgcaaggtcacgagagacccttagtgatggcgaccggaacccccaggccaattaaacacgggtaatgcaacttcaagagaaatgagggtcatttctccctccacttgatttagttttccctgactttccaatgagtattggcctagcttcatttgagctttgtttctgttttttttccttgctcagccagagtagaaaagttagataatttgtaaacttggaaattccccaacatctctataa

SEQ ID NO: 94514 - DNA, 601 bp, Human
cctcagcctcccaaagttctgggattacaggcgtgagccaccgcagctggcgaggttgctatggattttattgccgttgtacactttatatagaatgaaggacaagttttctgaattgtgaagtttctagtcctgctggatgtcacaaacccacccagctctctgttgctaggatttcagggtaggcagaatggcccaaaagatatgccagtccccaggatctgtgaatacccagcattacatggcaacaaagacttttcaggtgtactcaggggttcagatttcaaatagggagatcacygtggaccttccaggttagattagttcaatctaatccaatgagcgttagcagaaaactttctgtggctggggacaggagagatgaggcaagagggggagaggatgtcagagattcagaatgccacctggaacctaatgccatgtctgacatttgtgttgcacccagactttcaaaacaagatctcagctgtccttctgtgttaccctcccaggaatgccagaaagtaggcagagaaagaatcgccaatccagttcttctaatgaggagccccaggcagagaaaagttggtggtttgcctac

SEQ ID NO: 94515 - DNA, 601 bp, Human
ccctatctcaagactctgtaagagcacggtttaatcaacttcctaatacatagaagactctcaaatacaatgtaactggcactctgcttatttttctctttggttgctatggattgtttgtttgagagagtcttgctctgtcacccaggctggagtgcagtggcatgatctcagctcactgcaacctgcacttcctgggttcaagcaattctcttgcctcagcctcctgagtagctggaattacaggcgtgcaccatcaccctggctaatttttgtatttttagtagagacggggtttcaycatgtttcccagactggtctcgaccacctagcctcaaggcctcaagtgatccgcccgcctcagcctcccaaagttctgggattacaggcgtgagccaccgcagctggcgaggttgctatggattttattgccgttgtacactttatatagaatgaaggacaagttttctgaattgtgaagtttctagtcctgctggatgtcacaaacccacccagctctctgttgctaggatttcagggtaggcagaatggcccaaaagatatgccagtccccaggatctgtgaatacccagcattacat

SEQ ID NO: 94516 - DNA, 601 bp, Human
actcttgttgcccaggctggagtgcaatggtgcaatctcagctcactgcaacctctgcccccgggttcaagcaattctcctgtctcagcctcctgagtagcagggattataggcgcccgccactatgcccagctaatttttggtatttttagtagagatggagtttcaccatgttggccaggctggtctcaaactcctgacctcaggtgatccacccacctcagcctcccaaaatgctgggattacaggcatgagccaccatgcccagcctgttaaatatgtatattttgccaacctgttrtcaagccccacaggaaccccaaatataattgacagtggggaccatgaagtataagtaaaactaagtgctgtacatacttcctgaataatgcccaaaacataccctcagccccacaagacacagaaaagcaaactgctactatgtcttaatcccacaatgtctttaaatcatatggctttagatatcctaactacaacccaaggcaacacttgtgcatgaattaaggctgagaattagatatctaccagattattctcacaatataacccaaactatacaggccttaaatactcatatttc

SEQ ID NO: 94517 - DNA, 601 bp, Human
ggaccacagtcacatgccaccactcttggctaattttttttttttttttttgagacggagtctcgctctgtcacccaggctagagtgcagtggcgcgatcttggctcactacaagctctgcctcctgggttcacgccattctcctgcctcagcctcccaagtagctgggactacaggcacccaccaccacgcccggctaatttttttgtatttttagtagaggcagggtttcaccatgttagccaggatggtctcgatctcctgacctcgtgattcgcccgcctcggcctcccaaattgcwgggattacaggcatgagccacccttcccagccccctttttttttttttttttttttgagacacagtttcactcttgttgcccaggctggagtgcaatggtgcaatctcagctcactgcaacctctgcccccgggttcaagcaattctcctgtctcagcctcctgagtagcagggattataggcgcccgccactatgcccagctaatttttggtatttttagtagagatggagtttcaccatgttggccaggctggtctcaaactcctgacctcaggtgatccacccacctcagcctccca

SEQ ID NO: 94518 - DNA, 601 bp, Human
tgcatatttattcaatacacatatgtcaggaccatcttcataaatattcatagctcctcctataatctgttaaatatgtgtgtgtgtgcgtgtgtgtgtgtgtgtgtgtgtgtgtgtatagtttgtttgttttgagagggagtcttgctctgttgcccaggctggagtgcagcagtgcaatctcaactcactataacttccacctccaggttcaagcaattctcatgtctcagccgagtagctgggaccacagtcacatgccaccactcttggctaattttttttttttttttttgagacrgagtctcgctctgtcacccaggctagagtgcagtggcgcgatcttggctcactacaagctctgcctcctgggttcacgccattctcctgcctcagcctcccaagtagctgggactacaggcacccaccaccacgcccggctaatttttttgtatttttagtagaggcagggtttcaccatgttagccaggatggtctcgatctcctgacctcgtgattcgcccgcctcggcctcccaaattgctgggattacaggcatgagccacccttcccagcccccttttttttttttttttttttt

SEQ ID NO: 94519 - DNA, 601 bp, Human
ccaaaataaacatgggtcatacatgcatatttattcaatacacatatgtcaggaccatcttcataaatattcatagctcctcctataatctgttaaatatgtgtgtgtgtgcgtgtgtgtgtgtgtgtgtgtgtgtgtgtatagtttgtttgttttgagagggagtcttgctctgttgcccaggctggagtgcagcagtgcaatctcaactcactataacttccacctccaggttcaagcaattctcatgtctcagccgagtagctgggaccacagtcacatgccaccactcttggctaattttttttttttttttttgagacggagtctcgctctgtcacccaggctagagtgcagtggcgcgatcttggctcactacaagctctgcctcctgggttcacgccattctcctgcctcagcctcccaagtagctgggactacaggcacccaccaccacgcccggctaatttttttgtatttttagtagaggcagggtttcaccatgttagccaggatggtctcgatctcctgacctcgtgattcgcccgcctcggcctcccaaattgctgggattacaggcatgagccacccttcccagccc

SEQ ID NO: 94520 - DNA, 601 bp, Human
aggctcttgttccaccagccaagactacagctttaattagacaaaagactaaatttcagtagctctcctgataaaagaccaccaaccatgggctaggtctggccagtttacagaaagcacacactgtgtgcctttatgtcctagaaagatcttttgatatacaggacctaaatggaatacattccaccccaaaataaacatgggtcatacatgcatatttattcaatacacatatgtcaggaccatcttcataaatattcatagctcctcctataatctgttaaatatgtgtgtgtgtgcttgtgtgtgtgtgtgtgtgtgtgtgtgtatagtttgtttgttttgagagggagtcttgctctgttgcccaggctggagtgcagcagtgcaatctcaactcactataacttccacctccaggttcaagcaattctcatgtctcagccgagtagctgggaccacagtcacatgccaccactcttggctaattttttttttttttttttgagacggagtctcgctctgtcacccaggctagagtgcagtggcgcgatcttggctcactacaagctctgcctcctgggttcacgccattctcctg

SEQ ID NO: 94521 - DNA, 601 bp, Human
atatgatttattctatgccttaataccaaataattaaaatgcttaactacctataagcctcctttcctgtcattctcagaactaggctgggcttatgatactttaaaacattactaattctttgtattttgttttacctccagaattgaaactattcaatcccccaggcctaaagactatagtggaagaagtgagcgtctgacatagtaagggccagtcttatgggatcaaattaattcagagcctccaaatccaggacggacacagagaggcttcaacagctgaacaaaaggcttgtgtyttgtgcagctaagtgctactagccaagctcacagtagctcgatgtatagatttgtagataagtcaattttggaagcttgccttttggctttgggtttttggcttttacattgcttaaaaggggttttaaggttaatgaatgcctggccacctccattcccatctggcctggaacatttaactggcttccactgttttgactctaagtccctgggccataggggtcccatcgaggaacatcatggaccctgggaaggtaaccataccaccccagcatccacatgggacaaaataaaagctt

SEQ ID NO: 94522 - DNA, 601 bp, Human
cccggaaggcggagcttgcagtgagcggagcttgcaccactgcactccagcctgggcaacagagagagactctgtcaaaaaaaaaaaaaaaaaaaaaaaaaaaaaaaaaaaggttattttaaaagagagaataattttatatattaaaaaaaaaacttggccaggcacggtggcttatgcctgtaatcccagcattttgggaggccaaggcgggcagataacgaggtcaggagatggagaccatcctggctaacacggtgaaaccccgtctctactaaaaatacacaaaattagccgggcrtggtgccgggcgcctgtagtcccagctactcaggaggctgaggcaggagaatggtgtgaacccagtaggcggagcttgcagtgagccgagattatgccaccgcactccagcctgggcgacagagtgagactctgtctcaaaaaaaaaaaaaaaaaaaaaaaagttgtatggtaaattcttgtcctaaaaataatgactgatatctaaagaaacaaaattcaggacaagtcaaaaagtttaagcatgtcataaatggtttgtataaattgtattaaagtttgtggagaatttataaaagaa

SEQ ID NO: 94523 - DNA, 601 bp, Human
aaatatgggaaaacatggttctaaaattgtgaaatgacttcatctataaaatgctaacatctgacaaaccgttcaggacttcttgcttactaagtttccactaaaatttaaagttagtagaaataaaaattctaatgactatataattctatgaattgtattcgtattgtaaaaataattttataggctggacgtggtggctcaggcctgtaatcccagcactttggaaggctgaggcaggcggatcacaaggtcaggagatcgagaccatcctggctaacacggtgaaacccagtctctrctaaaaatacaaaaaattagctgggtgtggtggcgggcacctgtagtcccagctactcaggaggctgaggcaggagaatggcgtgaacccggaaggcggagcttgcagtgagcggagcttgcaccactgcactccagcctgggcaacagagagagactctgtcaaaaaaaaaaaaaaaaaaaaaaaaaaaaaaaaaaaggttattttaaaagagagaataattttatatattaaaaaaaaaacttggccaggcacggtggcttatgcctgtaatcccagcattttgggaggccaaggcgg

SEQ ID NO: 94524 - DNA, 601 bp, Human
ggttacatattctggcccatttttgtgcacattttaaactgatgggcaaattacaacaagaaaaattcagagttcaaatggttaacctacactgtggagttaagtagaatcttctttagctctctaccttcctctcttttctgcctgctttaaatctgctgttattaaactgctggcgcgagacaagactcattatttatggtctaaattgaatataaacattgaaaactcatttgaaactgaacagcaaaaaggggaaaagatttaaaaagaaaaaaacccaaactgccatagagactgstttaccccaaattttggctgccagctttccttggattacctatcagggcaaacaaagttagccacgtggacagcttccaattttgtcagaaaaacaacttgaagccagcttttataggtcagtgagtttgtgatgctatctcatgattagagttctcagataaaagctcttagacctttgtttgtgtatggatgtatacatgtttagatatgtttatgtaatgtacatgttatagttatgttctgtcgtgtctagcatgctaccaaattggctttataagtaagtgagtacacataaatt

SEQ ID NO: 94525 - DNA, 601 bp, Human
tatttgtggcacccttggggccttgctgggttcaggctgttccagggctggggttgggggggcattggaaactgaggtgagggatttgggactctactcagccctccctccccccacttcttccaagtcatcctcctgataatcttggggcacccacagccttattcctcttggccaaaagcacccacagctccctctggctagaaacatttcaccttgactggtgacttgcaaaggtgggaagggttcatcccacaccatgtaggtctggggcactgaggctctccctgacaggagatamacctgggtggtgagggtactgaccccaagccttgcagtggctgaaaggctcacaagcctcccctccttcctttctctttcctcttccttcctgtaaaacttgacctttgtcctctacatctctttcttttctttttctcatttcctgtccaatccaggggttcagccttgaaggagaaaaacagtttccaacatcatggcctctgattttgtcatcttctctgggactggttacatattctggcccatttttgtgcacattttaaactgatgggcaaattacaacaagaaaaattcagag

SEQ ID NO: 94526 - DNA, 601 bp, Human
cttggtatgcttagtctttttagatttagccactctggaagaggagaatggtgtctcactgtggttttaatttccatcttcctaacgtaactgggcagcttaacttcataatatattttaaaacatttttcccttctcttgggtttcaagatataaccttgaagcaaactgcagaagtcttttctcttagctataaaatagctccctttctcaccatatatactccctgcacatttagctaactgcatgctagtatctattatgtgccttcttagaagttccaggaggtaatcttgagacrgacagaccaagcatggagacctagctgcaaaattccagagattacttccatgcagctaattaacaactcggccactgttgagatgatgtcagcctgaggtccaggtggactggcaccaaagataatcataaaaacaagacccagagatactgtactcagcacaattctcttgcatgccctccttaatcaagttttcctcttttaaacccctcccttcccccgaaatagtcaaagtggttgctttgatgggaatctggccacttcccctttactagttgtggttaataaagtcactttcta

SEQ ID NO: 94527 - DNA, 601 bp, Human
cttggccatagtgtgtaaatatctgtttagcattagtaggtcctatcaaatgttttccaaagtagttatactatttgatagtcccaccaatgaggtataagaattccagtttctttgccaacacttggtatgcttagtctttttagatttagccactctggaagaggagaatggtgtctcactgtggttttaatttccatcttcctaacgtaactgggcagcttaacttcataatatattttaaaacatttttcccttctcttgggtttcaagatataaccttgaagcaaactgcagaagycttttctcttagctataaaatagctccctttctcaccatatatactccctgcacatttagctaactgcatgctagtatctattatgtgccttcttagaagttccaggaggtaatcttgagacagacagaccaagcatggagacctagctgcaaaattccagagattacttccatgcagctaattaacaactcggccactgttgagatgatgtcagcctgaggtccaggtggactggcaccaaagataatcataaaaacaagacccagagatactgtactcagcacaattctcttgcatgc

SEQ ID NO: 94528 - DNA, 601 bp, Human
cctagtgaagccaggcctagtagtctcttccagtcactatcacctcctgccaaaggtaacctctattctcacctttatcaccaaatctaactttatctggtttggaacatcatctaaatgaaatgacactgcatatgttcttttgtatggcttatgattttcaagtttatttctttgcaattttacctatgttgttatacatagcagtttgttctttttcattgctatgtagttttctgttgtatgactatatcacaatttatttctccattctcatgttgatatgcatttggatttttcyggtttggggctactatgactaatttctccatctttgggcagacacagaattcctttcttctgtgtgggtcccaggagtgaaattgcttggccatagtgtgtaaatatctgtttagcattagtaggtcctatcaaatgttttccaaagtagttatactatttgatagtcccaccaatgaggtataagaattccagtttctttgccaacacttggtatgcttagtctttttagatttagccactctggaagaggagaatggtgtctcactgtggttttaatttccatcttcctaacgtaact

SEQ ID NO: 94529 - DNA, 601 bp, Human
tttttttctacaccaataaatatctgagcccatcagataagtggtgcttcctaccactactttttggtaaaattaatgaaaattgcaagagctccatgtatttggtggtagaaattatgaaatgtggacttttttcctttttgttgaggtataaagcatatagcagagcatacaaatcttaatggtacatcttgataaatttttacaaatatataatatacacttatgtgtatttacagaatattttacataacatccagatccatttatataacatttccagcaacctagtggactttargcctagtgaagccaggcctagtagtctcttccagtcactatcacctcctgccaaaggtaacctctattctcacctttatcaccaaatctaactttatctggtttggaacatcatctaaatgaaatgacactgcatatgttcttttgtatggcttatgattttcaagtttatttctttgcaattttacctatgttgttatacatagcagtttgttctttttcattgctatgtagttttctgttgtatgactatatcacaatttatttctccattctcatgttgatatgcatttggattttt

SEQ ID NO: 94530 - DNA, 601 bp, Human
ttgccatgacacctttctcagtaaattttatagtagtttgcaaatgatttagtgcgtctttttatttttttctacaccaataaatatctgagcccatcagataagtggtgcttcctaccactactttttggtaaaattaatgaaaattgcaagagctccatgtatttggtggtagaaattatgaaatgtggacttttttcctttttgttgaggtataaagcatatagcagagcatacaaatcttaatggtacatcttgataaatttttacaaatatataatatacacttatgtgtatttayagaatattttacataacatccagatccatttatataacatttccagcaacctagtggactttaagcctagtgaagccaggcctagtagtctcttccagtcactatcacctcctgccaaaggtaacctctattctcacctttatcaccaaatctaactttatctggtttggaacatcatctaaatgaaatgacactgcatatgttcttttgtatggcttatgattttcaagtttatttctttgcaattttacctatgttgttatacatagcagtttgttctttttcattgctatgtagttt

SEQ ID NO: 94531 - DNA, 601 bp, Human
ttcttgtcttttctttctggttttattccccacctctctaccaaactcatcaactcatctgtaatttatttctatgcatggaaaaaaaagaatggttcagtttttgtatttgtctaacacggtcctgagatttcaaaaacccagtttatatcagcaatcttcattgccatgacacctttctcagtaaattttatagtagtttgcaaatgatttagtgcgtctttttatttttttctacaccaataaatatctgagcccatcagataagtggtgcttcctaccactactttttggtaaaatwaatgaaaattgcaagagctccatgtatttggtggtagaaattatgaaatgtggacttttttcctttttgttgaggtataaagcatatagcagagcatacaaatcttaatggtacatcttgataaatttttacaaatatataatatacacttatgtgtatttacagaatattttacataacatccagatccatttatataacatttccagcaacctagtggactttaagcctagtgaagccaggcctagtagtctcttccagtcactatcacctcctgccaaaggtaacctctattctcac

SEQ ID NO: 94532 - DNA, 601 bp, Human
tcaggatattcaacttcttgtttattttaatagctctttatatataaaggatattaatgtcttgtatatgttacaaatattttcctcgattgtcattgccttcttatttatggtgcctgtttttgcagtgcagttttaaaattaaaattattcatgacattccatatgttttcttctcttgtctttatgtttagactgaatttctcctacatcaagacagggtgacacaaatattcttgtcttttctttctggttttattccccacctctctaccaaactcatcaactcatctgtaatttwtttctatgcatggaaaaaaaagaatggttcagtttttgtatttgtctaacacggtcctgagatttcaaaaacccagtttatatcagcaatcttcattgccatgacacctttctcagtaaattttatagtagtttgcaaatgatttagtgcgtctttttatttttttctacaccaataaatatctgagcccatcagataagtggtgcttcctaccactactttttggtaaaattaatgaaaattgcaagagctccatgtatttggtggtagaaattatgaaatgtggacttttttcctttt

SEQ ID NO: 94533 - DNA, 601 bp, Human
gcatcaatttatacttttaccactaataataagagagttcattttaattcagcctggtaaacacaagatagcattgtcttttcaactttgtcaatttgacaggtggacaaaatgacatctcttttgttttaacttctattttttatgagtcaggtaaaaccttttatgtgtttattttgaccatttttattttgtaagttgtctctttcatgtcttgcttatttttctatcaggatattcaacttcttgtttattttaatagctctttatatataaaggatattaatgtcttgtatatgtyacaaatattttcctcgattgtcattgccttcttatttatggtgcctgtttttgcagtgcagttttaaaattaaaattattcatgacattccatatgttttcttctcttgtctttatgtttagactgaatttctcctacatcaagacagggtgacacaaatattcttgtcttttctttctggttttattccccacctctctaccaaactcatcaactcatctgtaatttatttctatgcatggaaaaaaaagaatggttcagtttttgtatttgtctaacacggtcctgagatttcaaaaa

SEQ ID NO: 94534 - DNA, 601 bp, Human
gcaacctgagattaacaatctactgcataaatacacaattctctgatcattttcccaagataaattcccaataattaaataattgggtaaaaatcttttgatacatattgaaaaattgtcttccagaaagagtgcatcaatttatacttttaccactaataataagagagttcattttaattcagcctggtaaacacaagatagcattgtcttttcaactttgtcaatttgacaggtggacaaaatgacatctcttttgttttaacttctattttttatgagtcaggtaaaaccttttatrtgtttattttgaccatttttattttgtaagttgtctctttcatgtcttgcttatttttctatcaggatattcaacttcttgtttattttaatagctctttatatataaaggatattaatgtcttgtatatgttacaaatattttcctcgattgtcattgccttcttatttatggtgcctgtttttgcagtgcagttttaaaattaaaattattcatgacattccatatgttttcttctcttgtctttatgtttagactgaatttctcctacatcaagacagggtgacacaaatattcttg

SEQ ID NO: 94535 - DNA, 601 bp, Human
ggtgagttagagtattgtagtttttgagacattggttcgtttcatctaagttgtcaaatgtatgcatgtggagttgtttctaatattctctttttatccttttgaaaaacaaggcaacctgagattaacaatctactgcataaatacacaattctctgatcattttcccaagataaattcccaataattaaataattgggtaaaaatcttttgatacatattgaaaaattgtcttccagaaagagtgcatcaatttatacttttaccactaataataagagagttcattttaattcagccyggtaaacacaagatagcattgtcttttcaactttgtcaatttgacaggtggacaaaatgacatctcttttgttttaacttctattttttatgagtcaggtaaaaccttttatgtgtttattttgaccatttttattttgtaagttgtctctttcatgtcttgcttatttttctatcaggatattcaacttcttgtttattttaatagctctttatatataaaggatattaatgtcttgtatatgttacaaatattttcctcgattgtcattgccttcttatttatggtgcctgtttttgc

SEQ ID NO: 94536 - DNA, 601 bp, Human
ttgggcatgagtttcttaatagtattgagccctgtagatagccattcaaagtatctattttatattgggtgagttagagtattgtagtttttgagacattggttcgtttcatctaagttgtcaaatgtatgcatgtggagttgtttctaatattctctttttatccttttgaaaaacaaggcaacctgagattaacaatctactgcataaatacacaattctctgatcattttcccaagataaattcccaataattaaataattgggtaaaaatcttttgatacatattgaaaaattgtcytccagaaagagtgcatcaatttatacttttaccactaataataagagagttcattttaattcagcctggtaaacacaagatagcattgtcttttcaactttgtcaatttgacaggtggacaaaatgacatctcttttgttttaacttctattttttatgagtcaggtaaaaccttttatgtgtttattttgaccatttttattttgtaagttgtctctttcatgtcttgcttatttttctatcaggatattcaacttcttgtttattttaatagctctttatatataaaggatattaatg

SEQ ID NO: 94537 - DNA, 601 bp, Human
ataatgaatgagtgttgaatttgttcaaatgttttttctccatcaatagatacgattgtgtgatttttcttctttagcctgttgatatggtggattacactgactgattctgaatactggatcagtcttccatcaccagaataaaccccactcagccatggtgtataatttattttatgtattgttgaattctatttgccaatattttgttaagagtttttgcatttattgataaggaatattggtctgtggtatttttttgaacaatctttgtctggtttttgtatcaggataacactgrtttcataaaatgaattgggaagtgttccttcctattatcttttctggaagagactgaataatctgtgaatatttgttatgtttttccagtaaaccatctgagcctggagatttcttttcttgggcatgagtttcttaatagtattgagccctgtagatagccattcaaagtatctattttatattgggtgagttagagtattgtagtttttgagacattggttcgtttcatctaagttgtcaaatgtatgcatgtggagttgtttctaatattctctttttatccttttgaaaaacaagg

SEQ ID NO: 94538 - DNA, 601 bp, Human
gagttaagggacgctcctcctctatttcttgttttctaagactttctgttttttcagagacagggtcttgctctgttgcccagggtggagtgcagtggcttggtcatggctcactgcagcctccaactcctgggcttaagtcatcctcccatctcaacttcttgagtagctgggactacgggtatgcactaccaccccgctctccagctaatgtcttttttgagatgggggtcttgctatgttgcccaggctggtctcaaactcctggcctcaagcaatcctcctacctcagcaagtttatttttaaataatgaatgagtgttgaatttgttcaaatgttttttctccatcaatagatacgattgtgtgatttttcttctttagcctgttgatatggtggattacactgactgattctgaatactggatcagtcttccatcaccagaataaaccccactcagccatggtgtataatttattttatgtattgttgaattctatttgccaatattttgttaagagtttttgcatttattgataaggaatattggtctgtggtatttttttgaacaatctttgtctggtttttgtatcaggata

SEQ ID NO: 94539 - DNA, 601 bp, Human
agagttaagggacgctcctcctctatttcttgttttctaagactttctgttttttcagagacagggtcttgctctgttgcccagggtggagtgcagtggcttggtcatggctcactgcagcctccaactcctgggcttaagtcatcctcccatctcaacttcttgagtagctgggactacgggtatgcactaccaccccgctctccagctaatgtcttttttgagatgggggtcttgctatgttgcccaggctggtctcaaactcctggcctcaagcaatcctcctacctcagcaagtttmtttttaaataatgaatgagtgttgaatttgttcaaatgttttttctccatcaatagatacgattgtgtgatttttcttctttagcctgttgatatggtggattacactgactgattctgaatactggatcagtcttccatcaccagaataaaccccactcagccatggtgtataatttattttatgtattgttgaattctatttgccaatattttgttaagagtttttgcatttattgataaggaatattggtctgtggtatttttttgaacaatctttgtctggtttttgtatcaggat

SEQ ID NO: 94540 - DNA, 601 bp, Human
acagtggcgagtgaggacatccttgctttgttactgatcttagagtataagcattcagtctttcaccattaaatgtaatgctagctgtagatgtacttgatagagttaagggacgctcctcctctatttcttgttttctaagactttctgttttttcagagacagggtcttgctctgttgcccagggtggagtgcagtggcttggtcatggctcactgcagcctccaactcctgggcttaagtcatcctcccatctcaacttcttgagtagctgggactacgggtatgcactaccaccccsctctccagctaatgtcttttttgagatgggggtcttgctatgttgcccaggctggtctcaaactcctggcctcaagcaatcctcctacctcagcaagtttatttttaaataatgaatgagtgttgaatttgttcaaatgttttttctccatcaatagatacgattgtgtgatttttcttctttagcctgttgatatggtggattacactgactgattctgaatactggatcagtcttccatcaccagaataaaccccactcagccatggtgtataatttattttatgtattgttgaattc

SEQ ID NO: 94541 - DNA, 601 bp, Human
ttgctaatatatagaaatctagttgattttgtatcttgatcttgtatcctgtgaccttgctaaactcactagttctagaagtgttttggttttctgtttgtaggttccttgggattttctacatagaccatcatgtcgtctgcaagaacagtgttattacctgctttccaatctgtatgtgtttcatcatcttccttgccttattgtgctggctacaactttcaggattacatatgttgggtaacagtggcgagtgaggacatccttgctttgttactgatcttagagtataagcattcastctttcaccattaaatgtaatgctagctgtagatgtacttgatagagttaagggacgctcctcctctatttcttgttttctaagactttctgttttttcagagacagggtcttgctctgttgcccagggtggagtgcagtggcttggtcatggctcactgcagcctccaactcctgggcttaagtcatcctcccatctcaacttcttgagtagctgggactacgggtatgcactaccaccccgctctccagctaatgtcttttttgagatgggggtcttgctatgttgcccaggctggtc

SEQ ID NO: 94542 - DNA, 601 bp, Human
tggtacatccaaccggtgcaaaatgattcttcctcacccccttatccaaaatggggactcttagctgctacatttgtattgagttaccccgtctcccacgacacacacacacgcacacttatttgatggggtcaaggatagattcatagattagtgattcaaactggcccaatgtgagtctctcctccagaaacctagaattggagtacagcattgttgtgatgtacgtagaagctttgtaaacccgaatgttcttgcctccatgttctgacctcatggtctggtcttccagcgcttgacrccatgagcactcagagctgcttctctgaagctcccaacacattttcattcacgggcttagtgtctgacttcccagctagactgtgagcaacttggtggcaagtaccaactccgtcttgttcctgtctgtttacccatcacctagcacaatccagtccacagatattgcatttaattcacacacacacacaacacacacatgagtttacacacacacatatatacatgcatacatgcagtgattttcagcataagaatcctatacacattttttggatttatactgttccattttttgtgt

SEQ ID NO: 94543 - DNA, 601 bp, Human
gtggcccttggtacatccaaccggtgcaaaatgattcttcctcacccccttatccaaaatggggactcttagctgctacatttgtattgagttaccccgtctcccacgacacacacacacgcacacttatttgatggggtcaaggatagattcatagattagtgattcaaactggcccaatgtgagtctctcctccagaaacctagaattggagtacagcattgttgtgatgtacgtagaagctttgtaaacccgaatgttcttgcctccatgttctgacctcatggtctggtcttccagygcttgacgccatgagcactcagagctgcttctctgaagctcccaacacattttcattcacgggcttagtgtctgacttcccagctagactgtgagcaacttggtggcaagtaccaactccgtcttgttcctgtctgtttacccatcacctagcacaatccagtccacagatattgcatttaattcacacacacacacaacacacacatgagtttacacacacacatatatacatgcatacatgcagtgattttcagcataagaatcctatacacattttttggatttatactgttccatt

SEQ ID NO: 94544 - DNA, 601 bp, Human
tgcacaactcgcccagcagcaggaagccctgattctgcctttctctctgactctgtggatgctccttctcacttgcttctcttcccggcagcacctcttcctctgattccttaaatgttggtgctccttctggtccttctgtggcccttggtacatccaaccggtgcaaaatgattcttcctcacccccttatccaaaatggggactcttagctgctacatttgtattgagttaccccgtctcccacgacacacacacacgcacacttatttgatggggtcaaggatagattcatagattwgtgattcaaactggcccaatgtgagtctctcctccagaaacctagaattggagtacagcattgttgtgatgtacgtagaagctttgtaaacccgaatgttcttgcctccatgttctgacctcatggtctggtcttccagcgcttgacgccatgagcactcagagctgcttctctgaagctcccaacacattttcattcacgggcttagtgtctgacttcccagctagactgtgagcaacttggtggcaagtaccaactccgtcttgttcctgtctgtttacccatcacctagcacaatcc

SEQ ID NO: 94545 - DNA, 601 bp, Human
agcaccatcacctccatggctcagagggagaactctgagagcaaaaccacctaagattaacaacctactgcagctggagcggctgcacaactcgcccagcagcaggaagccctgattctgcctttctctctgactctgtggatgctccttctcacttgcttctcttcccggcagcacctcttcctctgattccttaaatgttggtgctccttctggtccttctgtggcccttggtacatccaaccggtgcaaaatgattcttcctcacccccttatccaaaatggggactcttagctgctwcatttgtattgagttaccccgtctcccacgacacacacacacgcacacttatttgatggggtcaaggatagattcatagattagtgattcaaactggcccaatgtgagtctctcctccagaaacctagaattggagtacagcattgttgtgatgtacgtagaagctttgtaaacccgaatgttcttgcctccatgttctgacctcatggtctggtcttccagcgcttgacgccatgagcactcagagctgcttctctgaagctcccaacacattttcattcacgggcttagtgtctgact

SEQ ID NO: 94546 - DNA, 601 bp, Human
agaaaagcactcccagatgctaaaaccatagcccctcttcatcataagccatgttcccaagccacgatactcacaactcagatcactgagctgagcgtgcagtgtctcactctgcacactcaacagccctttggggcagatagcaccatcacctccatggctcagagggagaactctgagagcaaaaccacctaagattaacaacctactgcagctggagcggctgcacaactcgcccagcagcaggaagccctgattctgcctttctctctgactctgtggatgctccttctcacttgcytctcttcccggcagcacctcttcctctgattccttaaatgttggtgctccttctggtccttctgtggcccttggtacatccaaccggtgcaaaatgattcttcctcacccccttatccaaaatggggactcttagctgctacatttgtattgagttaccccgtctcccacgacacacacacacgcacacttatttgatggggtcaaggatagattcatagattagtgattcaaactggcccaatgtgagtctctcctccagaaacctagaattggagtacagcattgttgtgatgtacgt

SEQ ID NO: 94547 - DNA, 601 bp, Human
aacctgcggccacaatattgcggccacactgcagggcatccttttcagaaggctcatcctctgaggtctgtggaagagagggataaatgccatgtgttattgttgtctctggagagaacactttgccaggggcctgggcttcagatctcctcgaatcactgaaggaagcgcggttctttgaattttaagctgctgcaaatccatccagaggaaacgagtggccatgttgccaacagttctagctgagccatggcaaaggccattcttggacttcttccttcctgttttccaaacgcatgtstctgtagcctgacaagaaaagcactcccagatgctaaaaccatagcccctcttcatcataagccatgttcccaagccacgatactcacaactcagatcactgagctgagcgtgcagtgtctcactctgcacactcaacagccctttggggcagatagcaccatcacctccatggctcagagggagaactctgagagcaaaaccacctaagattaacaacctactgcagctggagcggctgcacaactcgcccagcagcaggaagccctgattctgcctttctctctgactctgtggatgc

SEQ ID NO: 94548 - DNA, 601 bp, Human
agggcagaaaacagaggctctgtctgtgcctgggaatctttgaattgggtccctgagtcaaagcatctcccatcacctttagaactgctcagaatgttcatggagatattttgcttgtactcaagagcagttgtgttggaaatttagtgtggtagagtaattaaagcacagactgctggagcatgactcctgacaccagtcactagcttgaccttgcgcaagttactcactctctctacgcctcactttccccatctgaaaatgggaataattgtaggacatatctcatagggccactgtracatttaaatgcattaatagatgtaaatttcataggacaggtactttacattcctaccacttacgaagaattatctaactcttagctgttattctacaacaactttagaaagggtgttttattgtctgagggtaatatttgcaagccatagaatttctcagggtttgccagcttctttgaacataaagggaaattggggcattagcaaactgacacagcaatgggtcttggtctaatgggcatacaggtgaaaagattctatttgaaaagtttctgggtttccatactgtaaactctgtt

SEQ ID NO: 94549 - DNA, 601 bp, Human
cccacagacctcacaggctcagtttgacccaccagggaatgctgcctccataagctactggccgccttccatggcatttctatctgtgacaactgccacaagctacctccgctggatgtcaaacaggcactaagctttgtgcactgggtctttgctcaaatgtcctttttagtagggagatgtgatccaaaggggtttcaggctaatacatagagatccggaaagatgctatggttcatctcttccttctgtcatgttgacaagctctggtgcccacctatgtccagactgggccctgctktcatgactgagggcagaaaacagaggctctgtctgtgcctgggaatctttgaattgggtccctgagtcaaagcatctcccatcacctttagaactgctcagaatgttcatggagatattttgcttgtactcaagagcagttgtgttggaaatttagtgtggtagagtaattaaagcacagactgctggagcatgactcctgacaccagtcactagcttgaccttgcgcaagttactcactctctctacgcctcactttccccatctgaaaatgggaataattgtaggacatatctcatag

SEQ ID NO: 94550 - DNA, 601 bp, Human
tggtcaccaacaacggctgatttttaatatgggctctcatacaccctgttaccgattatcagacaccagatcctggtcacaagaaacaacagctcccatttgtaaatgaatgccttgacattgagctttacccacaatggagagttggttaacaggaggtggtctctctgtgcctgaacaatatgtgtgttctgacaaaatcaaatcaccagccctgcaatcccacagacctcacaggctcagtttgacccaccagggaatgctgcctccataagctactggccgccttccatggcatttstatctgtgacaactgccacaagctacctccgctggatgtcaaacaggcactaagctttgtgcactgggtctttgctcaaatgtcctttttagtagggagatgtgatccaaaggggtttcaggctaatacatagagatccggaaagatgctatggttcatctcttccttctgtcatgttgacaagctctggtgcccacctatgtccagactgggccctgctgtcatgactgagggcagaaaacagaggctctgtctgtgcctgggaatctttgaattgggtccctgagtcaaagcatctcc

SEQ ID NO: 94551 - DNA, 601 bp, Human
tgcgagaccactgccgtgcttcctgcttcctggtcctctagtcctgcccgttcctagccagggtcctcagctttcccatcaatgcagtaactcctttcacttaattgagccggggtcaattttgctgttgctttccagcaaagaggatggagatgcacaactgtcatctgaacagtggcactcactcaccacctgaacagaggcgctcattctgcatcagggcgggtgaaaacgccttacgttgatccactcctggggctggggccgggactctcaggccctgggaatattgtttccacarttttattaacctggaaaatgtgttcctttgttctgattgtgtggtcaccaacaacggctgatttttaatatgggctctcatacaccctgttaccgattatcagacaccagatcctggtcacaagaaacaacagctcccatttgtaaatgaatgccttgacattgagctttacccacaatggagagttggttaacaggaggtggtctctctgtgcctgaacaatatgtgtgttctgacaaaatcaaatcaccagccctgcaatcccacagacctcacaggctcagtttgacccaccaggga

SEQ ID NO: 94552 - DNA, 601 bp, Human
ggttggtgtccaggccagaccggccatgttgcgagaccactgccgtgcttcctgcttcctggtcctctagtcctgcccgttcctagccagggtcctcagctttcccatcaatgcagtaactcctttcacttaattgagccggggtcaattttgctgttgctttccagcaaagaggatggagatgcacaactgtcatctgaacagtggcactcactcaccacctgaacagaggcgctcattctgcatcagggcgggtgaaaacgccttacgttgatccactcctggggctggggccgggacwctcaggccctgggaatattgtttccacaattttattaacctggaaaatgtgttcctttgttctgattgtgtggtcaccaacaacggctgatttttaatatgggctctcatacaccctgttaccgattatcagacaccagatcctggtcacaagaaacaacagctcccatttgtaaatgaatgccttgacattgagctttacccacaatggagagttggttaacaggaggtggtctctctgtgcctgaacaatatgtgtgttctgacaaaatcaaatcaccagccctgcaatcccacagac

SEQ ID NO: 94553 - DNA, 601 bp, Human
tgcaacaccccatggttcctctgcagtgcctcctaattctaacttcgggttattacaggtgcacgagtgatggtctttgactcatgacctttaacttgctgtgggtgtctgttgctttggagcagcccagcgctgatttctacttctgaaaagtgccctgacttgctttgaattggatgccagtctaggaagactcatatctgggcctcttgtaggccaaggtcaggcatgtaccttagcttgaaaatgagatacgcctccctaggatttgaaacctgagtgagaggcgcagcactggggktggtgtccaggccagaccggccatgttgcgagaccactgccgtgcttcctgcttcctggtcctctagtcctgcccgttcctagccagggtcctcagctttcccatcaatgcagtaactcctttcacttaattgagccggggtcaattttgctgttgctttccagcaaagaggatggagatgcacaactgtcatctgaacagtggcactcactcaccacctgaacagaggcgctcattctgcatcagggcgggtgaaaacgccttacgttgatccactcctggggctggggccgggactct

SEQ ID NO: 94554 - DNA, 601 bp, Human
gtcagaaacaagtcagtgccaaggagactcaataacaaaaacaactaaacaatcctttcctgcctaacatgagtgacaactgcttctatatcagtgacttcaatctctctgcctcctagataaaaatgattaaggtaactagtcattaattgcacccacttccagacaatatccaatccagactgaccctctcttcctcaaatcctctttagaatcaccaagcaaaaccccaagtcctataagcccatctcaactccctccttatgcaacaccccatggttcctctgcagtgcctcctaawtctaacttcgggttattacaggtgcacgagtgatggtctttgactcatgacctttaacttgctgtgggtgtctgttgctttggagcagcccagcgctgatttctacttctgaaaagtgccctgacttgctttgaattggatgccagtctaggaagactcatatctgggcctcttgtaggccaaggtcaggcatgtaccttagcttgaaaatgagatacgcctccctaggatttgaaacctgagtgagaggcgcagcactggggttggtgtccaggccagaccggccatgttgcgagacca

SEQ ID NO: 94555 - DNA, 601 bp, Human
tccctgtcagaaacaagtcagtgccaaggagactcaataacaaaaacaactaaacaatcctttcctgcctaacatgagtgacaactgcttctatatcagtgacttcaatctctctgcctcctagataaaaatgattaaggtaactagtcattaattgcacccacttccagacaatatccaatccagactgaccctctcttcctcaaatcctctttagaatcaccaagcaaaaccccaagtcctataagcccatctcaactccctccttatgcaacaccccatggttcctctgcagtgcctsctaattctaacttcgggttattacaggtgcacgagtgatggtctttgactcatgacctttaacttgctgtgggtgtctgttgctttggagcagcccagcgctgatttctacttctgaaaagtgccctgacttgctttgaattggatgccagtctaggaagactcatatctgggcctcttgtaggccaaggtcaggcatgtaccttagcttgaaaatgagatacgcctccctaggatttgaaacctgagtgagaggcgcagcactggggttggtgtccaggccagaccggccatgttgcga

SEQ ID NO: 94556 - DNA, 601 bp, Human
gggcatctctcaaatacccctatgtctagttctggtgatagcagtcactaaaaatgggatcagcttgtggcagataccaccttaaatgctcatgtctgtctaagtcactaggaggaaaaccagagcctggaaaccagatccattttgatgaatgtccaagattttgagagtgaaaaactccaaaatgacagctcacagttggcagctaggccagaaggttcccaaggaacatcagaggtattcccggaatataaagaggcaaggccacagaatgactccacatagcagaggtgttgctacragaggtgacactgtccctgtcagaaacaagtcagtgccaaggagactcaataacaaaaacaactaaacaatcctttcctgcctaacatgagtgacaactgcttctatatcagtgacttcaatctctctgcctcctagataaaaatgattaaggtaactagtcattaattgcacccacttccagacaatatccaatccagactgaccctctcttcctcaaatcctctttagaatcaccaagcaaaaccccaagtcctataagcccatctcaactccctccttatgcaacaccccatggttc

SEQ ID NO: 94557 - DNA, 601 bp, Human
cccatttttcttcagcaaataacattaaaaagactgccttaagattaaattcccagtatctcagttcgttacagatggattaaagggttggtatgaagccttacaaaagcatctgaacttgatggagcttatgttgagaaataaagtttatattttatgtttctaatctcttttaatttcatttttccatgaactttttgaaggcctctcatataattatttattctaaaagcaaatgcaactgagtgagtctataggttggagcttagattaaacaaatgacttcagagaggatctggcstgagctctgaattttgtaaatgtgatctctgccttctttataaagaatttatcctggaaaaactcaaatgtaaagataagtactacctttagaaggtaaattttagctatataagatactgaatgcttatgaagaaaggcagagtcccatcatcttcatactgaccacagccataaacagtggcaccaacctctttcagcaaagcccctgaagccaccacccaaacaggaccccatggggacagcattctgtctgccacccacctggctttcttcactcacctcagggaatttctttttc

SEQ ID NO: 94558 - DNA, 601 bp, Human
ggcccatcccttcctttcccataagggatacttttagttaatcgaatatctatagaaacaatgctaatgactggcttgctgttaataaataggtgggtaaatctgtttggggctctcaactctgaaggctgtgatttcccacttcacacctctatatttctgtgtgtgtgtctttaattcctctagctctgctgggttagggtctcccccaccaagctggtcttggcagggcacccatttttcttcagcaaataacattaaaaagactgccttaagattaaattcccagtatctcagttcrttacagatggattaaagggttggtatgaagccttacaaaagcatctgaacttgatggagcttatgttgagaaataaagtttatattttatgtttctaatctcttttaatttcatttttccatgaactttttgaaggcctctcatataattatttattctaaaagcaaatgcaactgagtgagtctataggttggagcttagattaaacaaatgacttcagagaggatctggcctgagctctgaattttgtaaatgtgatctctgccttctttataaagaatttatcctggaaaaactcaa

SEQ ID NO: 94559 - DNA, 601 bp, Human
gtaacttgggggaggagagcaagggcctctgaaggtgtagggtacaatttgcccttgactaattacacccattcatttttacaacattggggagaaacatccttggcccacatgtgcttattttgagagtgttctgagaaagccacagttttagcagaaaaagcccaggaaagttcaccgtagagttcttctccaccacatgaatgctcctgcttaatcttctcatcaaacaatggcaattttgcaagagttttgatggaaaatcactataatcctgatttagctccttttgacttctttwtgtttcctaatcttaaaaaacctttaaagggcactgttgggaacaggccccccaaaacctggccataaactggccccaaaactggccataaacaaagtctctgcagcactgtgacatgttcatgatggtcttaatgcccacgctggaaggttttgggtttaccggaatgagggcaaggaacacctggcccgcccagggcggaaaaccgcttaaaggcattcttaagccacaaacaatagcacgagtgatctgtgccttaaggacatgctcctgctgcagttaaccagcccaacctattcc

SEQ ID NO: 94560 - DNA, 601 bp, Human
agatataggtagatagatgatagatagatagaaaatagatacatagatgatagatagatgatagataggtgagagtgagggagggagcgagggcaggagggagggataactatagatgctcgtaacttgggggaggagagcaagggcctctgaaggtgtagggtacaatttgcccttgactaattacacccattcatttttacaacattggggagaaacatccttggcccacatgtgcttattttgagagtgttctgagaaagccacagttttagcagaaaaagcccaggaaagttcaccrtagagttcttctccaccacatgaatgctcctgcttaatcttctcatcaaacaatggcaattttgcaagagttttgatggaaaatcactataatcctgatttagctccttttgacttctttttgtttcctaatcttaaaaaacctttaaagggcactgttgggaacaggccccccaaaacctggccataaactggccccaaaactggccataaacaaagtctctgcagcactgtgacatgttcatgatggtcttaatgcccacgctggaaggttttgggtttaccggaatgagggcaagga

SEQ ID NO: 94561 - DNA, 601 bp, Human
acaggtgtttctactctaacttacctttgctctataaagaaaagctacgagaaatctctcagttaaagatataggtagatagatgatagatagatagaaaatagatacatagatgatagatagatgatagataggtgagagtgagggagggagcgagggcaggagggagggataactatagatgctcgtaacttgggggaggagagcaagggcctctgaaggtgtagggtacaatttgcccttgactaattacacccattcatttttacaacattggggagaaacatccttggcccacatstgcttattttgagagtgttctgagaaagccacagttttagcagaaaaagcccaggaaagttcaccgtagagttcttctccaccacatgaatgctcctgcttaatcttctcatcaaacaatggcaattttgcaagagttttgatggaaaatcactataatcctgatttagctccttttgacttctttttgtttcctaatcttaaaaaacctttaaagggcactgttgggaacaggccccccaaaacctggccataaactggccccaaaactggccataaacaaagtctctgcagcactgtg

SEQ ID NO: 94562 - DNA, 601 bp, Human
caggaactagagatggaacccatattcctaagctcctagttttttagcccagaaggacttgacataacagagacaggtgtttctactctaacttacctttgctctataaagaaaagctacgagaaatctctcagttaaagatataggtagatagatgatagatagatagaaaatagatacatagatgatagatagatgatagataggtgagagtgagggagggagcgagggcaggagggagggataactatagatgctcgtaacttgggggaggagagcaagggcctctgaaggtgtaggrtacaatttgcccttgactaattacacccattcatttttacaacattggggagaaacatccttggcccacatgtgcttattttgagagtgttctgagaaagccacagttttagcagaaaaagcccaggaaagttcaccgtagagttcttctccaccacatgaatgctcctgcttaatcttctcatcaaacaatggcaattttgcaagagttttgatggaaaatcactataatcctgatttagctccttttgacttctttttgtttcctaatcttaaaaaacctttaaagggcactgttggg

SEQ ID NO: 94563 - DNA, 601 bp, Human
ttatgtgatgtgttacacaggaacacaatttttatatttggggaaaacattaagtcataaaatcaaaacatttaaatacagaaagaatctttcagcagacacacagtgaactatcaggaactagagatggaacccatattcctaagctcctagttttttagcccagaaggacttgacataacagagacaggtgtttctactctaacttacctttgctctataaagaaaagctacgagaaatctctcagttaaagatataggtagatagatgatagatagatagaaaatagatacatagattatagatagatgatagataggtgagagtgagggagggagcgagggcaggagggagggataactatagatgctcgtaacttgggggaggagagcaagggcctctgaaggtgtagggtacaatttgcccttgactaattacacccattcatttttacaacattggggagaaacatccttggcccacatgtgcttattttgagagtgttctgagaaagccacagttttagcagaaaaagcccaggaaagttcaccgtagagttcttctccaccacatgaatgctcctgcttaatcttctcatca

SEQ ID NO: 94564 - DNA, 601 bp, Human
gtttacattttcttatattttttgttgtctttatgtgatgtgttacacaggaacacaatttttatatttggggaaaacattaagtcataaaatcaaaacatttaaatacagaaagaatctttcagcagacacacagtgaactatcaggaactagagatggaacccatattcctaagctcctagttttttagcccagaaggacttgacataacagagacaggtgtttctactctaacttacctttgctctataaagaaaagctacgagaaatctctcagttaaagatataggtagatagattatagatagatagaaaatagatacatagatgatagatagatgatagataggtgagagtgagggagggagcgagggcaggagggagggataactatagatgctcgtaacttgggggaggagagcaagggcctctgaaggtgtagggtacaatttgcccttgactaattacacccattcatttttacaacattggggagaaacatccttggcccacatgtgcttattttgagagtgttctgagaaagccacagttttagcagaaaaagcccaggaaagttcaccgtagagttcttctccacca

SEQ ID NO: 94565 - DNA, 601 bp, Human
ataaagaaatgtgctacatatacacaatggaatactatgcagccataaagaagaatgagatcatgtttttgcaggaacatgggtggagctgaaggcctaattatcttaagtaaactaacacggaaataggaaaccaaatgccacatgttctcacttataagtaggagctaaatgatgagaacacatggacacaaagagggaaacaacagacactggggcctacgtgagggtggagggagggaggagggggaggagcagaaaagataagtattggataccaggtttagtacctgggagacaracaatctatacagcaaacccccatgacaggagtttacttatataacaaacctgcacaactacccctgaatctaaaataaaagtgtagaaaataaaattacacctgcatcataggaatatgttatagtgttctgaaccactgtaggatgaatatatttaacaataatatatgacatattttcaaaaagctagaaggaggatattgaatgttcccaacacaaagaaataataaatgtctgagatgatggatttcctaattatactgatctgatcactgtatattatatataatgaaacatca

SEQ ID NO: 94566 - DNA, 601 bp, Human
atagcaaagatatggaatcaacctaaatgcccatcagtggtagactggataaagaaatgtgctacatatacacaatggaatactatgcagccataaagaagaatgagatcatgtttttgcaggaacatgggtggagctgaaggcctaattatcttaagtaaactaacacggaaataggaaaccaaatgccacatgttctcacttataagtaggagctaaatgatgagaacacatggacacaaagagggaaacaacagacactggggcctacgtgagggtggagggagggaggagggggagsagcagaaaagataagtattggataccaggtttagtacctgggagacaaacaatctatacagcaaacccccatgacaggagtttacttatataacaaacctgcacaactacccctgaatctaaaataaaagtgtagaaaataaaattacacctgcatcataggaatatgttatagtgttctgaaccactgtaggatgaatatatttaacaataatatatgacatattttcaaaaagctagaaggaggatattgaatgttcccaacacaaagaaataataaatgtctgagatgatggatttc

SEQ ID NO: 94567 - DNA, 601 bp, Human
catgtatgttcactgcaacactattcacaatagcaaagatatggaatcaacctaaatgcccatcagtggtagactggataaagaaatgtgctacatatacacaatggaatactatgcagccataaagaagaatgagatcatgtttttgcaggaacatgggtggagctgaaggcctaattatcttaagtaaactaacacggaaataggaaaccaaatgccacatgttctcacttataagtaggagctaaatgatgagaacacatggacacaaagagggaaacaacagacactggggcctacktgagggtggagggagggaggagggggaggagcagaaaagataagtattggataccaggtttagtacctgggagacaaacaatctatacagcaaacccccatgacaggagtttacttatataacaaacctgcacaactacccctgaatctaaaataaaagtgtagaaaataaaattacacctgcatcataggaatatgttatagtgttctgaaccactgtaggatgaatatatttaacaataatatatgacatattttcaaaaagctagaaggaggatattgaatgttcccaacacaaaga

SEQ ID NO: 94568 - DNA, 601 bp, Human
ccaccatggagcccacatacctggccccatagggagcactgccatcctagaagacagaaagcgaagagacaagatccagtggctttcaggattagccagcacctgctcgtggtcacaagtccagttggtgtgacctctgccttcttgaatccctatcctccacccactagtgtaggaattgaaaagattatataattgtgcatttcatttattatgagctcctcaaaccttaccttgtgactggacttaacaaatgcaggactgcttaaagtatgagacaatatcctgcagcaatcttaaragagccgctaaacaaacaaagaaaaaggaagtcacccatcccacatgcagtgccacctataggctcaaaataaagggatggaagccaaacatatagaaagcagaaaaaagcaggggctgcaatcctaatttcagacaaaatagactttaaaccaataaagttcaaaaaagacaaaaaggacattacataatggtaaagggctcaattcaacaagaagacttaactatcctaaataatatgcacctaacacaggggcacccagattcataaagcaagtccttagagaccttcaaagagact

SEQ ID NO: 94569 - DNA, 601 bp, Human
tagagacggggtttcactgtgttagccaggatggtctcgatcttctgacctcgtgatccacccgccttggcctcccaaagtactaggattacaggcgtgagccaccgcagccagccatgacctgtactttctctgcaattaaatctacacagctatacagatgcagacacacacaggataggagtgtgcacatgcacacacagacacacacacacacagagacgtcggcacagggaccatgacagcagaaatgcggagattaggatccaacagaactttcagtatgggtggtggttatgcrcagcaaacgcagatctatctatggagtgacatgtgcttaagggacatgagtatgtgatcccatgtgagtattttctgactcatttacgatcatttgaataattagtaataactgatctttatgttctccccaatgtaactgagtaagtgaccagagtggttctaagaatttccatgtcttcgccgggcgctgtgactcatacctgtaatcccagcactttgggaggccaaggcgggcggatcacgaggtcaggagatcgagaccatcctggctaacatggtgaaaccccgtctctactaa

SEQ ID NO: 94570 - DNA, 601 bp, Human
tttttttttttttttttttttttgagatggaatctcactctgtcacccaggctggagtgcagtggcgcgatctcagctcactgcaagctccgcctcccaggttcacgccattctcctgcctcagcctcccgagtagctggaaccacaggcacatgccaccacgcctggctaattattttttgtatttttagtagagacggggtttcactgtgttagccaggatggtctcgatcttctgacctcgtgatccacccgccttggcctcccaaagtactaggattacaggcgtgagccaccgcasccagccatgacctgtactttctctgcaattaaatctacacagctatacagatgcagacacacacaggataggagtgtgcacatgcacacacagacacacacacacacagagacgtcggcacagggaccatgacagcagaaatgcggagattaggatccaacagaactttcagtatgggtggtggttatgcgcagcaaacgcagatctatctatggagtgacatgtgcttaagggacatgagtatgtgatcccatgtgagtattttctgactcatttacgatcatttgaataattagtaat

SEQ ID NO: 94571 - DNA, 601 bp, Human
gggatttggggtatcagataataaagtctcagattgtaatcaattatcctgttgagtcaactactttaatcaaaaaaagctcagcattagtacctaatgcgcttgtcttggagccaagttacttttgttctgacctcagatgcccctgttgtaggaaatttaatatcaaaatgcccagggcttcatggcaccttggcctgcaggccatgtgacatgtgacctgtattttttttttttttttttttttttgagatggaatctcactctgtcacccaggctggagtgcagtggcgcgatctcrgctcactgcaagctccgcctcccaggttcacgccattctcctgcctcagcctcccgagtagctggaaccacaggcacatgccaccacgcctggctaattattttttgtatttttagtagagacggggtttcactgtgttagccaggatggtctcgatcttctgacctcgtgatccacccgccttggcctcccaaagtactaggattacaggcgtgagccaccgcagccagccatgacctgtactttctctgcaattaaatctacacagctatacagatgcagacacacacaggataggag

SEQ ID NO: 94572 - DNA, 601 bp, Human
ccacgggattgcattcatacaggagccggagctgtggaggaacagaggcaggtgagtaaactctgcaagtggccaaatgtcccgagccatgcccctaaagctgggggaggagtttgtactgcggtgcttccatctggctagcatgagcgcaccatgcaccttgcaagagtgggcccgagctttagagcctacagcaggccagatgcatcagatggcactcatccagaagccttgggggcccctctggccaggtgactgagccatgtatctacccatcttgtgatccttgtgcttatgagaracctgcctcttgacttggaaatatgagatctaggcatctatttcttggttcaacaagaagcaaactgatgctgcaggcctgggtggaagcctttatatgtgagacctcaaggctggtaaagagtcaagcttggatgggacagtaaggtcaccttgaccatgccggcttgtctctctggggacagccacagtggctgggattgtgtggaggaactccacatcttaagctttgacttgtctaactagtttgccggtgtttcaatggtcttgtcttttgacccttagactaagtgaaatccca

SEQ ID NO: 94573 - DNA, 601 bp, Human; identical to SEQ ID NO: 19381

SEQ ID NO: 94574 - DNA, 601 bp, Human; identical to SEQ ID NO: 19382

SEQ ID NO: 94575 - DNA, 601 bp, Human; identical to SEQ ID NO: 19383

SEQ ID NO: 94576 - DNA, 601 bp, Human; identical to SEQ ID NO: 19384

SEQ ID NO: 94577 - DNA, 601 bp, Human; identical to SEQ ID NO: 19385

SEQ ID NO: 94578 - DNA, 601 bp, Human; identical to SEQ ID NO: 19386

SEQ ID NO: 94579 - DNA, 601 bp, Human; identical to SEQ ID NO: 19387

SEQ ID NO: 94580 - DNA, 601 bp, Human; identical to SEQ ID NO: 19388

SEQ ID NO: 94581 - DNA, 601 bp, Human; identical to SEQ ID NO: 19389

SEQ ID NO: 94582 - DNA, 601 bp, Human; identical to SEQ ID NO: 19390

SEQ ID NO: 94583 - DNA, 601 bp, Human; identical to SEQ ID NO: 19391

SEQ ID NO: 94584 - DNA, 601 bp, Human; identical to SEQ ID NO: 19392

SEQ ID NO: 94585 - DNA, 601 bp, Human
ccgaggcagctacagctggatgatggtttcagtaaatagaaatgccttcattctggatgccacatgctgcaaacagacccaaatacatccaaacacacaggttttgtgtttaagggaactgttgttcctgttctcctcttgcattaaaaaaaaaaaaaaaggcagccacgcgtggtggctcatgcctgtaatcccagcactttgggaggctgtggcgggtggatcacttgaggtcagaagttcaggaccagcctggtcaacatggtgaaaccccgtctctactaaaaatataaaaattagycgggcgtggtggcgggcacctgtaatcccagctactcagaatgctgaggcaggagaatcacttgaacccaggaggcagaggctgcagtgagctgagatcgcgccactgcactccagcctgggcgacgagtaagactctgcctaaaaagccatctgtccactgggaaaacataagaaggacacaatacttgggaaggaagcacactgtcaccctggcagaaggaaagcagggcagctctgagcgagcgtgagggagcacagccaccctgcagcctgctgggaacaccatgggcttggacta

SEQ ID NO: 94586 - DNA, 601 bp, Human
gttgatatgcccgaggcagctacagctggatgatggtttcagtaaatagaaatgccttcattctggatgccacatgctgcaaacagacccaaatacatccaaacacacaggttttgtgtttaagggaactgttgttcctgttctcctcttgcattaaaaaaaaaaaaaaaggcagccacgcgtggtggctcatgcctgtaatcccagcactttgggaggctgtggcgggtggatcacttgaggtcagaagttcaggaccagcctggtcaacatggtgaaaccccgtctctactaaaaatayaaaaattagtcgggcgtggtggcgggcacctgtaatcccagctactcagaatgctgaggcaggagaatcacttgaacccaggaggcagaggctgcagtgagctgagatcgcgccactgcactccagcctgggcgacgagtaagactctgcctaaaaagccatctgtccactgggaaaacataagaaggacacaatacttgggaaggaagcacactgtcaccctggcagaaggaaagcagggcagctctgagcgagcgtgagggagcacagccaccctgcagcctgctgggaacaccatgg

SEQ ID NO: 94587 - DNA, 601 bp, Human
agcaaaacatgcagagctggtgggagtttccaagggaacgaatactgtatttttccttcctgtgaggctgtaaaagtttcctcccaccccaggttgcatctgagacaaaacagttaaccatttggttaaattcaaccattcatcaagccagtgccagcaatagattacccgatgcaaatgtgagacagaccacctgcatactggacagaatgacattttggcagaagcgatcattgccttctctttataccatggaaactggacttaatgagtgattctgtgtgtgttggatggagcttcrcctattctaaaagcaataaaaaaaatccatggtggtgtctggctacagacatctggaaagcagaccggctcctccaaacagtgtgatattgtttgcaactctgtgtgcattccttttacgattctccgaaggcttttgggttggaattcagtgtattatacgtcttggcattcacttttaaatattaacttttttattgtatgccttttcatgcagtctgcctactgagcgacagctttctgcaggtgtttcctgagtctatttccacataggtgtcatggctagttttgaaaaaccaaa

SEQ ID NO: 94588 - DNA, 601 bp, Human
gccattcccccagccttctccatgacgtaggccatggggttgcattcgtacagcagtctcagctggaaaacaagaccgggtagcggcctccttgtatcagaaggtattgcgtaaaaaagagacttttctgcagcaaaacatgcagagctggtgggagtttccaagggaacgaatactgtatttttccttcctgtgaggctgtaaaagtttcctcccaccccaggttgcatctgagacaaaacagttaaccatttggttaaattcaaccattcatcaagccagtgccagcaatagattaccygatgcaaatgtgagacagaccacctgcatactggacagaatgacattttggcagaagcgatcattgccttctctttataccatggaaactggacttaatgagtgattctgtgtgtgttggatggagcttcacctattctaaaagcaataaaaaaaatccatggtggtgtctggctacagacatctggaaagcagaccggctcctccaaacagtgtgatattgtttgcaactctgtgtgcattccttttacgattctccgaaggcttttgggttggaattcagtgtattatacgtcttggc

SEQ ID NO: 94589 - DNA, 601 bp, Human
tacaccttcaggaactcgagcacgtcgtcgggggaccccaagatcaccggcgccctctggtgaatgtctgtgggaatgacgtctaacacggcctccttcccagtggtggccattcccccagccttctccatgacgtaggccatggggttgcattcgtacagcagtctcagctggaaaacaagaccgggtagcggcctccttgtatcagaaggtattgcgtaaaaaagagacttttctgcagcaaaacatgcagagctggtgggagtttccaagggaacgaatactgtatttttccttcctrtgaggctgtaaaagtttcctcccaccccaggttgcatctgagacaaaacagttaaccatttggttaaattcaaccattcatcaagccagtgccagcaatagattacccgatgcaaatgtgagacagaccacctgcatactggacagaatgacattttggcagaagcgatcattgccttctctttataccatggaaactggacttaatgagtgattctgtgtgtgttggatggagcttcacctattctaaaagcaataaaaaaaatccatggtggtgtctggctacagacatctggaaagc

SEQ ID NO: 94590 - DNA, 601 bp, Human; identical to SEQ ID NO: 19393

SEQ ID NO: 94591 - DNA, 601 bp, Human; identical to SEQ ID NO: 19394

SEQ ID NO: 94592 - DNA, 601 bp, Human
cctcataattccctgagtaagaaattaaagaagtggtatcataaaaggttgatgttttttaatatacagaagtttctggaatgacctattaatttactgtcaatggccttactgatgctttgtccagaacaatgccattgctcctgcttactttggggaggttttgggataatttagttgtatggtcctttttcaattgttttacttttttttttatgaaatgttctaaatgtatagaaaattagagacattagtataataaacagccatatgcccattatgcactttaaaagttgttaayattttgccatagttgcttcttctatgccttttttttttttttttttttttttgctgagagttttttgtttggttttgttttgttttattttgagacagggtctccctgtccccaggctgtagtgcagtggcaccatcacagctcactgcagcctcaagtgatcatcccaccacagcctcccaagtagctgggactacaggtgtgcaccaccatgcctggcaaatttttgaaatttttagtacaggcaaattctgtgttgcccaggctggtcttgaactcctgagttcaagcaatcttccc

SEQ ID NO: 94593 - DNA, 601 bp, Human
tgttaaaagggaaaactatcttactctactgttgatatatacaatgagagcagacttttaaagaccaaagtatgctaatgacacctcaaaattgcagcttttggcttatgctaaatgatgtattacctacatccttgaagaaacaatctactttaactgatccagaatcttactcttttactcctcaatttattttaggggatttctagagttttaagatgcttcacactctatcagttccttgtcatatcttgaaattctttttagaataagtaagtgtgggccgggcacagtggctcaygcctgtaatcccagcactttgggagaccgaggcagatggatcacctgaggtcaggagttcgagaccagcctgcctaacatggcaaaaccccatctccactaaaaatacaaaaaattagctgggtgtggtggcaggtgcctgtaatcccagccactcgggaggctgaggcaggagacttgcttgaacccgggaggtggaggttgcagaggattgcgccattgtacttcagcctgggcgacagagtgagactctgtctcaaataaatacataaaaaataaacgtggaattcactttgcagtt

SEQ ID NO: 94594 - DNA, 601 bp, Human; identical to SEQ ID NO: 27880

SEQ ID NO: 94595 - DNA, 601 bp, Human
tggttgggaaaaatcatgcaaaggaagatggggcaaggaatggggaagcttggtcagcagagtgcagctccctggccccagccactttgtgaccttcccctacccagggtgactcatctactcctgtaccaggaacattcctctcttctcacactttctttcccaagtgacttattcagggagactgcacgggggaaaccgaggcatgagaaaggctgtatggatatctcatcaccctttcacctggtgcccccagaaaactaggaaactaggagccgcctccaaataggacctggagctrgagttcccctaaggaatgtagaggccgggtccccaactcccgaacggagtgggtgaagccaaaaaggctagggctgtgcagagatgtcttgggtagcttcgtgggccacctggacagggtaagtttgggtgctggatcgctccatcgttccccttttcccagcgcagagaacaagcgcttcaggccccaggatgggacctagaggcagatggccaaagagaggggccctaagagtctgcggtcccgggacggactgaggcgacactgagggcggtgcctgaaagtccgggctccaggagg

SEQ ID NO: 94596 - DNA, 601 bp, Human
atacatgaaaaggtcacacattgcccatctccccaaatactcatacatagagccacatatcacaggacattcaggcttatacgcagtcacacggaaacacaggtcactcagtcacagacacacaaagggatacatccagtgttacttcctcagttttagaggaaaaaaggaaagagcccaggatgactttcctgccccactatccaacggcctcagtttttcctataataaaccaagtcctatgccgtggacttgatcattcctcacagcccacttccttgggccaaagcctaaaaaggtyagcaacaccaagacccagggaatcgcttcctatccttctcaggcctacagagacctctatctccagccctttaggaaagtggtgagagagtgaagatgattcttggagcacttgctggtagctagaactgagaacccatagagcaagtcacacacctgagaaaaagtgtcttactgtctcaacgggaatgtaggggtcacacagggaatggggaagggggagggaacacatagaaagaattatgccccataaccaaaaatcacaattcataccacatgccaaaagtcttccacacagtca

SEQ ID NO: 94597 - DNA, 601 bp, Human
tccccctccccattgtgacaactaaaaatatccccagacattaccaaatgtttcctgaggggcaaagccacactcctagttgagagtcactgatgtagacatacatgaaaaggtcacacattgcccatctccccaaatactcatacatagagccacatatcacaggacattcaggcttatacgcagtcacacggaaacacaggtcactcagtcacagacacacaaagggatacatccagtgttacttcctcagttttagaggaaaaaaggaaagagcccaggatgactttcctgccccacyatccaacggcctcagtttttcctataataaaccaagtcctatgccgtggacttgatcattcctcacagcccacttccttgggccaaagcctaaaaaggtcagcaacaccaagacccagggaatcgcttcctatccttctcaggcctacagagacctctatctccagccctttaggaaagtggtgagagagtgaagatgattcttggagcacttgctggtagctagaactgagaacccatagagcaagtcacacacctgagaaaaagtgtcttactgtctcaacgggaatgtaggggtcac

SEQ ID NO: 94598 - DNA, 601 bp, Human; identical to SEQ ID NO: 20572

SEQ ID NO: 94599 - DNA, 601 bp, Human; identical to SEQ ID NO: 19555

SEQ ID NO: 94600 - DNA, 601 bp, Human
gagcccagggagaatatgctggactggccactatccgagcctacttaaaccagaaaggagaggggcacagaacggtttgcctcattctgaaatcaacacatgggaccaacccaacaagtgcccacatggcaggcatgaagattcagcctgtggaggtggataaatgtgggaatatcaatgcagttcacctcaaggccatggtggataagcacaaggagaacctagcagccatcatgattacatacccatccaccaatggggtgtttgaagagaacatcagtgacgtgtgtgacctcatccmtcaacatggaggataggtctacctagacggggcaaatatgaacgctcaggtgggaatctgtcgccctggagactttgggtctgatgtctcgcacctaaatcttcacaagaccttctgcattccccacagaggaggtggtcctggcatggggcccattggcgtaagaaataccttgccccgtttttgcccaatcatcccatcatttcactaaagcggaatgaggatgcctgtcctgtgggaaccgtcagtgcggccccatggggctccagttccatcttgcccatttcctgggcttatatc

SEQ ID NO: 94601 - DNA, 601 bp, Human
cttaaaccagaaaggagaggggcacagaacggtttgcctcattctgaaatcaacacatgggaccaacccaacaagtgcccacatggcaggcatgaagattcagcctgtggaggtggataaatgtgggaatatcaatgcagttcacctcaaggccatggtggataagcacaaggagaacctagcagccatcatgattacatacccatccaccaatggggtgtttgaagagaacatcagtgacgtgtgtgacctcatccatcaacatggaggataggtctacctagacggggcaaatatgaaygctcaggtgggaatctgtcgccctggagactttgggtctgatgtctcgcacctaaatcttcacaagaccttctgcattccccacagaggaggtggtcctggcatggggcccattggcgtaagaaataccttgccccgtttttgcccaatcatcccatcatttcactaaagcggaatgaggatgcctgtcctgtgggaaccgtcagtgcggccccatggggctccagttccatcttgcccatttcctgggcttatatcaagatgatgggaggcaagggccttaaacaagccacggaaactg

SEQ ID NO: 94602 - DNA, 601 bp, Human
taaatgtgggaatatcaatgcagttcacctcaaggccatggtggataagcacaaggagaacctagcagccatcatgattacatacccatccaccaatggggtgtttgaagagaacatcagtgacgtgtgtgacctcatccatcaacatggaggataggtctacctagacggggcaaatatgaacgctcaggtgggaatctgtcgccctggagactttgggtctgatgtctcgcacctaaatcttcacaagaccttctgcattccccacagaggaggtggtcctggcatggggcccattggmgtaagaaataccttgccccgtttttgcccaatcatcccatcatttcactaaagcggaatgaggatgcctgtcctgtgggaaccgtcagtgcggccccatggggctccagttccatcttgcccatttcctgggcttatatcaagatgatgggaggcaagggccttaaacaagccacggaaactgcgatattaaatgccaactacatggccaagcgattagaaaaacactacagaattcttttcaggggtgcaagaggttatgtgggtcatgaatttattttggacacgagacccttcaaaa

SEQ ID NO: 94603 - DNA, 601 bp, Human; identical to SEQ ID NO: 32982

SEQ ID NO: 94604 - DNA, 601 bp, Human; identical to SEQ ID NO: 32983

SEQ ID NO: 94605 - DNA, 601 bp, Human; identical to SEQ ID NO: 32984

SEQ ID NO: 94606 - DNA, 601 bp, Human; identical to SEQ ID NO: 32985

SEQ ID NO: 94607 - DNA, 601 bp, Human; identical to SEQ ID NO: 32986

SEQ ID NO: 94608 - DNA, 601 bp, Human
atcaccatcaccactcataattagtccctgttggccagcatggtggctcacgcccttaatcccagcactttgggaggccaaggtgggcggatcacctgaggcggggtagtttgagactagcctgaccaacatggagaaatcctgtctctactaaaaatacaaaattagccaggcgtggtggcgcatgcctgtaatcccagctgctcagtaggctgaggcaagagaattgcttgaactttaggaggcagaggttgtaagccgagatcacgccatcaagagcgaaactctatcttgaaaaaamagtccctattgtcaaagtattcaagtggccaagttaaaaagtaatgttagcattggtggtcttgcttgaatgggtagccctgattgactcttggtgaactaccacttttactttttatttttatattttttttggagacggagtcttgctctgtcgtctaggctggagtgcagtagtgcgatctcagctcaccacaacctccgcttcccaggttcaagcgattctcctgcctcagcctcctgaatagctgggattacaggcgcgcaccaccatgcccggctgattcttgtatttttagta

SEQ ID NO: 94609 - DNA, 601 bp, Human
ggcggatcacctgaggcggggtagtttgagactagcctgaccaacatggagaaatcctgtctctactaaaaatacaaaattagccaggcgtggtggcgcatgcctgtaatcccagctgctcagtaggctgaggcaagagaattgcttgaactttaggaggcagaggttgtaagccgagatcacgccatcaagagcgaaactctatcttgaaaaaaaagtccctattgtcaaagtattcaagtggccaagttaaaaagtaatgttagcattggtggtcttgcttgaatgggtagccctgatkgactcttggtgaactaccacttttactttttatttttatattttttttggagacggagtcttgctctgtcgtctaggctggagtgcagtagtgcgatctcagctcaccacaacctccgcttcccaggttcaagcgattctcctgcctcagcctcctgaatagctgggattacaggcgcgcaccaccatgcccggctgattcttgtatttttagtagagatggggtttcaccatgttggtcaggctggtctcgaactcctgacctcatgatccacccactttggcctcccaaagtactggg

SEQ ID NO: 94610 - DNA, 601 bp, Human
ggctatgcacggttgttcacacctgtaatcctagcgctttgggaaaccatggtgagcggatcatcggaggtcagaagttcaagaccaggctggccaacatggtggtaccccatctctgctaaaatacaaaaattagcctggcatgatggcgggtgcctgtaatcccagctactccggaggctgagacaggagaatcacttgaacccgggagacggtggttgcagtgagccgagattgcgccattgcactccagcctgggcagctgagcgagactcagtctcaaaaaaaaaaaaaaaaaaaatttctttgccattctctcttggtttttgttttgttttgtttttatttttaagggaattaatttaaaaacttaaattgagaggcttgtatttgtgtatttttcactgcggctttaacctcctaggctcaaacgatcctcccacctcagcctctggagtaggtggcactgtaggcttgtgctataacatgtggctaatttaaaaatttttttgtacacagggtctcactaggttgcccagactggtctcaacctccttagctcaagcaatcttcctcacctcatcctcccaaaagtgctagg

SEQ ID NO: 94611 - DNA, 601 bp, Human
aaacagacaattggtagatttataaagaagagaacctgttactagaattgggaaaaagaatttaaaattgtttgtacagggcaaaagttaatattcaggtaggtactaattagaaaatcttgatgaatatattttaatataagcaagacttcatggcaataaagtaaaaattacgggagaaaaagaacggagcaaataaatcatgccatcaaattttaaacagaaaatttctacatcctccctttccgttcaccattccttaggtggaccctcgcaccttgatggatgcatgcttgctctrtagatctccttattcatcagagttataaaatggtgctattttaattataattattttattagtgtgtaaatatgaagagaagagataaattccacttatctatttactcatgatgtaggaaagacaggatacgtaagagtcttccccttgattgatcgattgattgagatggagtctcaccctgtcgtccaggctggagtgcaatggcacgatttcagctcactgtaacctccgcctcctgggttcaagtgattctcctgcctcagcctcccgagtagctgggattacaggcatgcacca

SEQ ID NO: 94612 - DNA, 601 bp, Human
ggaaaaagaatttaaaattgtttgtacagggcaaaagttaatattcaggtaggtactaattagaaaatcttgatgaatatattttaatataagcaagacttcatggcaataaagtaaaaattacgggagaaaaagaacggagcaaataaatcatgccatcaaattttaaacagaaaatttctacatcctccctttccgttcaccattccttaggtggaccctcgcaccttgatggatgcatgcttgctctatagatctccttattcatcagagttataaaatggtgctattttaattatarttattttattagtgtgtaaatatgaagagaagagataaattccacttatctatttactcatgatgtaggaaagacaggatacgtaagagtcttccccttgattgatcgattgattgagatggagtctcaccctgtcgtccaggctggagtgcaatggcacgatttcagctcactgtaacctccgcctcctgggttcaagtgattctcctgcctcagcctcccgagtagctgggattacaggcatgcaccaccacgcctggctaagtttttgtatctttagtagagatggggtttcaccat

SEQ ID NO: 94613 - DNA, 601 bp, Human
acggagcaaataaatcatgccatcaaattttaaacagaaaatttctacatcctccctttccgttcaccattccttaggtggaccctcgcaccttgatggatgcatgcttgctctatagatctccttattcatcagagttataaaatggtgctattttaattataattattttattagtgtgtaaatatgaagagaagagataaattccacttatctatttactcatgatgtaggaaagacaggatacgtaagagtcttccccttgattgatcgattgattgagatggagtctcaccctgtygtccaggctggagtgcaatggcacgatttcagctcactgtaacctccgcctcctgggttcaagtgattctcctgcctcagcctcccgagtagctgggattacaggcatgcaccaccacgcctggctaagtttttgtatctttagtagagatggggtttcaccatattggccagactggtctccagctcctggtctccaactcctgacctcttgattcgcctgcctcggcttcccaaagtgctgggattacaggcgtgagccactgcgcccagccttttttatttatttatttttttgaga

SEQ ID NO: 94614 - DNA, 601 bp, Human
ggagcaaataaatcatgccatcaaattttaaacagaaaatttctacatcctccctttccgttcaccattccttaggtggaccctcgcaccttgatggatgcatgcttgctctatagatctccttattcatcagagttataaaatggtgctattttaattataattattttattagtgtgtaaatatgaagagaagagataaattccacttatctatttactcatgatgtaggaaagacaggatacgtaagagtcttccccttgattgatcgattgattgagatggagtctcaccctgtcgyccaggctggagtgcaatggcacgatttcagctcactgtaacctccgcctcctgggttcaagtgattctcctgcctcagcctcccgagtagctgggattacaggcatgcaccaccacgcctggctaagtttttgtatctttagtagagatggggtttcaccatattggccagactggtctccagctcctggtctccaactcctgacctcttgattcgcctgcctcggcttcccaaagtgctgggattacaggcgtgagccactgcgcccagccttttttatttatttatttttttgagatg

SEQ ID NO: 94615 - DNA, 601 bp, Human
aaatcatgccatcaaattttaaacagaaaatttctacatcctccctttccgttcaccattccttaggtggaccctcgcaccttgatggatgcatgcttgctctatagatctccttattcatcagagttataaaatggtgctattttaattataattattttattagtgtgtaaatatgaagagaagagataaattccacttatctatttactcatgatgtaggaaagacaggatacgtaagagtcttccccttgattgatcgattgattgagatggagtctcaccctgtcgtccaggctgragtgcaatggcacgatttcagctcactgtaacctccgcctcctgggttcaagtgattctcctgcctcagcctcccgagtagctgggattacaggcatgcaccaccacgcctggctaagtttttgtatctttagtagagatggggtttcaccatattggccagactggtctccagctcctggtctccaactcctgacctcttgattcgcctgcctcggcttcccaaagtgctgggattacaggcgtgagccactgcgcccagccttttttatttatttatttttttgagatggagtcttgc

SEQ ID NO: 94616 - DNA, 601 bp, Human
tttagtagagatggggttttactatgttggccaggcttgccttgaactcctgacctcaggtgatccacctgccttggcctcccaaagtgctgggatttacaggtgtgagctaccgcacctggctgggaattttatgtattgatttatttttgagacagggccttgctctgttgcccaggttggagttcagtagcacattcacaactcactgctacttcaaattcctgggcttaagcggtcctcccgcctttgcctcccgagtagctaggactacaggtgcactccactatgcctggctaattttttttttttttttttctttgagacacagtctcgctgtcacctaggctggagtgaagtagtgcgatctcagctcactgcaacctctgcctcctgggttaaagcaattctcgtgtctcagcctcctgaataggtgggattactggtgtgcaacaccacgcccagctaattttttttgtatttttagtagagatggggtttcaccgtgttggccaggctggtttcaaactcctggcctcaaggtatccgcccaccttggcctcccaaagttaattttgttttgatttattttgctcaggtt

SEQ ID NO: 94617 - DNA, 601 bp, Human; identical to SEQ ID NO: 32987

SEQ ID NO: 94618 - DNA, 601 bp, Human
tttggttaatatttgtttcaactgattttcccatgtttcttttctttctggtcatttagtgtttaatttcattaaccagtttatttttcttgtgggggttggatatcttctaggctgaacaatgccgcaaaatatctgccagtttacagtcccaaagtcccgagcatctcttacctgtgttaatccaagctgcccagctctgccgtgaaaagcagcacacaaaagcaatagagctgcttcaggtaaaataattacttgaatgaggtgtcagacatttgcagctttgtttcattttcattgygttgtaataacctactagcatgtaaatttaatgggaaaactaatcagaaatgtaccactacacaaatttcattgtcattttagttaactcttgggttacagagctttatataaatttctttgtgttatataaatttctataatgtaaatatttgttataaatgctgaagaatgctgttttgtttggagatctgtttaacctgagttaggggatcatttaggcatgtataattccagaacatacttaacctcttttgcaataatctgatctccagtgagttctactccagaacctcaatta

SEQ ID NO: 94619 - DNA, 601 bp, Human
acactgctgatctccctcttatccaattctcacatttctttgctttccttgtctctttttccttctcctcagccctgtcttctcttccttgccctttacttgatctttcctcctatgtttagtttattttttcaaggattatttattatcttgaaattactgacaatctgtcatggttttttgtttgtttttaaagactgggaattttgagttattgaggtttgcagtgaatacaaaatcagaatttaacaccataggaaattttccattgcactcatgtctacagtaacatatttcaagrcctttagggaaggacccccaccttcaagttacagcccaaaaaagaagaaatagaactcaacagactgggagctgggagacttcttttctggtagcagctctgccattaactttctttgtgagcttaagcaaggtatattatttctttagaactcaatttccttatctctaaatgaacagagttcaccatccccaagaccccaaagtttatatgtttagcgatgttacaaaacatgagttatggttgctttcctaaggaaaagtagtgggaggaagtaaaatttcttgtatttttttttca

SEQ ID NO: 94620 - DNA, 601 bp, Human
tttttttctttttccctctgattagcctgtccagaggtttatcagttttactgattgttcttaaagatccagctttttgtttgtttcctttctatcctcatctcctactgctcagcatccccctccccctccactccagctatgtaggcctccttcctgtccctcagccacaccaggcaccctttttactggcttcaaacagctcatgccacatgggattcatcatgagagttcagccgctctatgtatgcctcactgatcatacacttaaatgtccagcagtgtcttattgtagaaacayttctaagggcttattctcaacttctgtacttaccaaaccatttgtgaactggcactgctttaaaggaaagttttattttacagatatctaccttcatatttggaaaacacggttgttcatggtatttctagaagtaaagttaactatgttctctaaagggagtagcttttatgataaatcaggtattagcggagagcctttatttgctatttcttcagcgttttttattttcaaaagcggtattctgggagtgaagggggagttcactaatttatacctttggctgtgtaggtatctgca

SEQ ID NO: 94621 - DNA, 601 bp, Human
cacatttatatttattgaagctccttgctgtatgtgtacatgcatttgtgtatgtaatctcaagaaataataatagtacatgattgcatatttaagagatcgtcttaaatggctagagagcccatgggtggtagtaattagtacaacagtaatacatggaatagttgtttatcatgtctctatctagtaggaatatcttaatttccagtatggatctctgcatgggcagtatccaacttaaaattatacatacgctgtgcaggtggcatttatactgttagtactgttagcagtggagggktatcagtgctctgggaaagtattatattaaattaatgtttgagaactatggtggcatatctttaagatttgattattataggggaatgtttccagttgtagacactaaatagatataggttgttttccagattcatcaattggtgattacttgtacaattaataatttgtccacctgctttcctctacatgtgtggatgattttgttgtttcaggcattcagtgaaacttaagatgagggatctaatgcataggtgtatttcttaaaggtctaatgaatataactgcatgcacttgctag

SEQ ID NO: 94622 - DNA, 601 bp, Human
tctagtaggaatatcttaatttccagtatggatctctgcatgggcagtatccaacttaaaattatacatacgctgtgcaggtggcatttatactgttagtactgttagcagtggaggggtatcagtgctctgggaaagtattatattaaattaatgtttgagaactatggtggcatatctttaagatttgattattataggggaatgtttccagttgtagacactaaatagatataggttgttttccagattcatcaattggtgattacttgtacaattaataatttgtccacctgctttsctctacatgtgtggatgattttgttgtttcaggcattcagtgaaacttaagatgagggatctaatgcataggtgtatttcttaaaggtctaatgaatataactgcatgcacttgctagatatttaacttgaaactttttttttctttttattgaaactgtagccaaaatctcctgctcatttgtccttgataagagaagctgcaaacttcaaactcaaatatgggcggaagaaggaggcaattagtgacctacaacagctgtggaagtaagctctgaaacgtggagttgtagaaataaca

SEQ ID NO: 94623 - DNA, 601 bp, Human
ttatacatacgctgtgcaggtggcatttatactgttagtactgttagcagtggaggggtatcagtgctctgggaaagtattatattaaattaatgtttgagaactatggtggcatatctttaagatttgattattataggggaatgtttccagttgtagacactaaatagatataggttgttttccagattcatcaattggtgattacttgtacaattaataatttgtccacctgctttcctctacatgtgtggatgattttgttgtttcaggcattcagtgaaacttaagatgagggatstaatgcataggtgtatttcttaaaggtctaatgaatataactgcatgcacttgctagatatttaacttgaaactttttttttctttttattgaaactgtagccaaaatctcctgctcatttgtccttgataagagaagctgcaaacttcaaactcaaatatgggcggaagaaggaggcaattagtgacctacaacagctgtggaagtaagctctgaaacgtggagttgtagaaataacacatttattgttgctacttgatatgagggagttacttgtttatattactttctccagtttta

SEQ ID NO: 94624 - DNA, 601 bp, Human
aaaaatgagaatttattgatcagtgtgactgaaaaatgcggcgatagatccaacttagggttcagtttcatccagaagcaaaaatgaagtcaaaagggtatggcctcttttcctccaggttcaagatcagcagcaaggtaaagaaaaagcatattttatgtgggtacttttgcatgattctgaaatgttattttcagattcaactacttaggtcacttgcttatctcaaatagttacctgataagcgaatttggtgcccttattgagcttggatcatatgtgctactctaaatcagagtgygttcccaaaactgaggtgggttggtggatgctaagcagtcacaagtcataaacttgatagttgttttggaatagagtttgtattaagccaccaccttgctccacatcactgtgttaaggaatagagaattagattatgactcctcatgttctcctttcagaatactgtatgtactatataattgatatgacttgttattgtatagaagatttaggaacattttttgcttttgttgaaggtcatcaagaaaagacagtcttccagtgtcaatagatacattggcaaacatatatatctata

SEQ ID NO: 94625 - DNA, 601 bp, Human
tttacagcaagcttggacttgtttggaataaaataaacaatcaaacataatctcaaagacatttctgctgaacagtgtatcctggggacaaattatgcaaaacaatacaaatcaaagaaataggaaggaaaaacaaaatggtcagaaggttgacaacaaagtgcatcacaaaaacagtcttcaaagagtttgtattttatttttgcccacaaataattagctagttagattactgtttgagaacctataatttttagaaagtggactattttcttcaatactaagaaatcagggctgtgcrcggtggtttatgcctgtaatcccagcaggccgggattacttgagctcaggagttcgagaccagcctaggcaacatagtgaaactccgtcgctataaaacaaaacaaaacaaaacaaaaaaacaaaaattggccaggcgtggtggcacaggcttatagtcccagctacttgggaggctgaggcaggaggatcgcttgaggcagaggttgcagtgggccaagatcgtgccactgccctccaccctaggcgacagagcaagatcctatcttttaaaaaaaaaagtctgtctggaagtccttac

SEQ ID NO: 94626 - DNA, 601 bp, Human
ctataaagttccccattgtaatgtttataagaaaatctcaatatttggaataaattcttaaataacgcacatttatcttttcatgatgtgaccgacaaataagatccaaagtatcaaataactgtttctattgtaaacatatgcagattattttgggttgcaattttctaagtttaaggtgatgatactataaatagttactagtgagttacacaatttaaggctttcaatagtgaactctgaaattgatgacatacaacctattagtttgtggacttctgggaaaagctctaaagaaagwatttggaaattctggagaaagtctgaactgtgttaaagaagcaacagcttctgtaacctcagaactgcctcctctcccttttctaccttggctaagatcaggagctgccaacattgaatgtctgactttcccttgaaaatactgccaatggaaaatgttatttcaggcattagagttaaaatttctatgtgtgtgtgtatgtgcgtgtatttgcaagtccagactttattttcttctttctttctttcttttttttttgagatggggtctctgtctgtcacccaggctggagtgctgtca

SEQ ID NO: 94627 - DNA, 601 bp, Human
atttcctattctgtgcaaagccccagtatgaaatggcacagaagtaaatggcactctgtccagtttgcttctatgattgtcaaaacccatccaggtgtcagaagaaatatttaggggatgtgatagggatcagtctattgtctctgctgtggaaagtttctgctgtgggaaaggcttcccattctcttctgctctctttggcattctcctataaatggtctctgccatttagaactcatctctctcaatttaggatgagaagaaatggctaatttaagtcaaggtttccagttttagatgytgttttctctaacatttccccaaatataaagaaaagccaggccggaaccctcaaagggtttgcagtctggagaggtactgagctgggtgtacatggtaatgaggttatgaaactggttctatatgactgtcagtctcaatattttataatcagactgtgtgagtgtttggtgatgtaagtagcaggtgagaaaaaggaatattaagtataaactagaaattgacaacacttgaacaatcaccaagctaaccttctgctctgataaggcaagtatctgccattttgaaaaaactataaagt

SEQ ID NO: 94628 - DNA, 601 bp, Human
aacttaagtttcttctgagaatagaagggaacctagaggtctagaggaacctagacaatgcatttcctattctgtgcaaagccccagtatgaaatggcacagaagtaaatggcactctgtccagtttgcttctatgattgtcaaaacccatccaggtgtcagaagaaatatttaggggatgtgatagggatcagtctattgtctctgctgtggaaagtttctgctgtgggaaaggcttcccattctcttctgctctctttggcattctcctataaatggtctctgccatttagaactcatstctctcaatttaggatgagaagaaatggctaatttaagtcaaggtttccagttttagatgttgttttctctaacatttccccaaatataaagaaaagccaggccggaaccctcaaagggtttgcagtctggagaggtactgagctgggtgtacatggtaatgaggttatgaaactggttctatatgactgtcagtctcaatattttataatcagactgtgtgagtgtttggtgatgtaagtagcaggtgagaaaaaggaatattaagtataaactagaaattgacaacacttgaacaatc

SEQ ID NO: 94629 - DNA, 601 bp, Human
accaaagcggctgaaatgggattgccaaagagctcagatttaaaagactatgaacaaaaggtataatcagtaattggaatacagaagcatcatgttctcttccaactatgaaattttattatatatcttagcttctttgtatcaacttctttttattaaatggaatcttcaaattcccccttctggttatccatgacttcagggacctcaatacaatctaatggcagtaaattcataatgacagttccaagatttgaaattatttgctgattatctttcagacatattttcaagcagatcrctttgcctcctaccagagaggtatggaaaacaagcagaccaagatctcttcccagttgggtaagtggtgatcttagaaaggaggaagactggggcaagctccagggctccagggcaagtgctctgggaggtgagtttgtaacttgtacagatactttcttaatcagcaacatcaaatctgttttgtacatccctggtatatagcacctagtacagtgctgactcaagttagctgctcaataaatgcacgttaaatggaaccaaagaccagagggcagattgaatcacaccattgtggctg

SEQ ID NO: 94630 - DNA, 601 bp, Human
atcttaacttctctgctatactgcctcttatatacagatacacggtacacgtggaataaatattagttgaaacaatggctggatgcatagctctagaagaacaaatacatcattttggggtgggggaaagtcagaatgcttctcagagaaactgacagagctgatccttgaaggctaggtaacagcccattttttaaatttttttttttttttttttgagatggagtcttgctcttttgcccaggcaggagtgcagtggtgctatcttggatcactgcaagctctgcctcccaggttcacrccattctcctgcctcagcctcccgagtagctgggactacaggtgcccgccaccacgcctggctaattttctgtatttttagtagagacggtgtttcattgtgttagccaggatggtctcgatctcctgatctcgtgatccgcccgcctcggcctcccaaagtgctgggattacaggcgtgagccatggcgcctggctgcccatttttaaaatttttattattatttttctttcatgtcagacaggtaatgtgccaatgtcataaaaggtttgggggcgacatacctcacacatgtgtatg

SEQ ID NO: 94631 - DNA, 601 bp, Human
agtgaggaaaaccctgggcagacaggtcaaataacttgctcaaggctatagttagtaagtggtcaagattcacaccaagggagtctggcttgagagctcctcatcttaacttctctgctatactgcctcttatatacagatacacggtacacgtggaataaatattagttgaaacaatggctggatgcatagctctagaagaacaaatacatcattttggggtgggggaaagtcagaatgcttctcagagaaactgacagagctgatccttgaaggctaggtaacagcccattttttaaatttttttttttttttttttgagatggagtcttgctcttttgcccaggcaggagtgcagtggtgctatcttggatcactgcaagctctgcctcccaggttcacaccattctcctgcctcagcctcccgagtagctgggactacaggtgcccgccaccacgcctggctaattttctgtatttttagtagagacggtgtttcattgtgttagccaggatggtctcgatctcctgatctcgtgatccgcccgcctcggcctcccaaagtgctgggattacaggcgtgagccatggcgcctggctg

SEQ ID NO: 94632 - DNA, 601 bp, Human
ccatcactcagcgctcccattgctctgtgacagcgtctcagctccttaaggggtcacaggccctcccctatcactgggctctgtcacgcagccagctgcctccttctccctaggcagtcccaccaaacctcatgcgagtccttctgctggctatgctctggttatctcctttctcttaaaaaattgttttaactgataactgaaaattgtatatatatggtatacaacatgatgttctgatgcatgtagacattttggaatggctaaatcaggctatttaacatatgcattacctcatacrcttctttgtgtgtgtggtaacaacatttaaagtctatgatcttagaacttttcttttttttttttcttttcttttttttttttttttttttgaggcagggtcttgccctgttacccaggctggagtgcagtggtatgatcatggctcactgcagatttgacctcctgggctcaagtaatcctcccgcctcagcctaccaagtagctgggactacaggtgtgtgccaccacacccagctaatttttttattttttttatagagacgaggtctcactatgttgcccaggctggcaattttca

SEQ ID NO: 94633 - DNA, 601 bp, Human
ggttacactcatattccctggcttaaaaattcttttgacgataattcagggttccccagctgctaaaaacaagatgttatttgtctaacaatgaaaaacacagatgaggtcagattgtttgtggggtaggggtggcttgaggtaaaggaagcatcataatctcatccactgtagggaggaattttgaatcagtgaaggctagctggccttggactccatccaagggtgttctgtcactgaactatccaagagagccttataaggcggtttcttctagaaggccagtctacagtggaccccragggcaggctctagggacaggatggaaatcgtatttcaggatgttaacaaatgcctgctcagcttaatcattccatctcaaagctgtatagtttaagagatttaaaaattataaaatcctcccccagatgtggcccctccccctcaagttatttctcagctctcctaaagagagtctcctgacttctgcctgaacacggtatcctattcaatagtttttactggaaagttcttcctgctgtgtcatctaaatgtgccttgtggctatttaattccaggccttttaatgctgtcctcctga

SEQ ID NO: 94634 - DNA, 601 bp, Human
agggcttgagaaaaagagaaacaaggctttgccagccctcttaaggacccaaggagagctccaagggcacgtgtggtaaaaatgttgtaagtaaattcttttctagttttaataagtggagcaggaaacaggctgtccctcacaggaggagaataacagcacatatcagaaactgaagtgaaacaagcggtcaaatcatggtctcagtattatgcagggaagttgcatttaaagagctgctgagattcaacctggaggtatgccattgactgtagtcaaatagaatagtagagaccttttyttttcttctgtgaaaaaaaatcttaaagacaaaacctccaaatttcacaaagtttttcccgtttacatctcagatgggtggctgcccttacaacaaacattttcaagctgctctagtaagaatgcggatgctttttatgaacctcaattcaattatgtacaaaggaatattctttccttctccctgttattttgaaatatttgattgatcaaattgaacttaaaaaaagaaaactattatagtacacatatcctttctgttcttgctggaataactcttcatgatctgagatagaaacca

SEQ ID NO: 94635 - DNA, 601 bp, Human
aacaaaacatgtgagagcaacagtttatttgatcaccttttctagtttagttaacatttttcacagaaaatgaaattatacattggttattttattcagcagagctcagagatccaggccatgtgtattctttgggagttggatcacctgtaattaaccacgcatataggaacctgggggataattttatcatgctatgttagacaactgccactgccaacacctggaatttaagttgctttaatttaccaaaacaaagccttagagtctctggatgtgtttcttcaaaaacacacacacrgttgaacaaaacaggcaaaagcatatgcacttccacatactggtaatgaccagagtaactggagactgtggaaatgcagagtattaactatgcagggaatttaatgtaggagatacaagattaggaatggaagaaccatgaatgaatgaatgagtgagtgaagcatatttatgtttaactgcttctgacactcaattttagcttcctttggattgaaatgtgggtacatgtgtgtgtgtccgtgtacacaccaactcacctggattcctcattccagcttcattcaattcccattagcag

SEQ ID NO: 94636 - DNA, 601 bp, Human
tctgtaatcccagcattttgggaggtcaaggcaggcggatcatctggaggtcaggagttcgagaccagcctggccaacgtgctgaaaccccatctctaccaaaaaaatacaaaaattagctgggtgtggtgttgggcacctgtaatcctagctacttgggaggctgaagcaggagaatcgctcaaacctgggaggcagaggtggcagcgagtggagatcacaccactgcattccagcctgagcaacagagtgagactctgtctcaaaaaaataaaaaaaaaaaaaaagagaggcaacttgycatttaataatcacacatttagtaagtgggggagtggggatttgaaccccaccctctccaaaacattaatctccataacatgtatgacttaaataagcttaaaaacactacaataattagaaattcaccttacttagatctgaggatgaattgaagtttatacaatttataaaaatgaaagtagacttttttaaagcagttttactgcatctatccatatacaattataactttttctgtttttgagttcattttaaaattatccctttccacatattaaattaaatcaggcaggaaccc

SEQ ID NO: 94637 - DNA, 601 bp, Human
aacttgctggctgggcacggtggctcacgtctgtaatcccagcattttgggaggtcaaggcaggcggatcatctggaggtcaggagttcgagaccagcctggccaacgtgctgaaaccccatctctaccaaaaaaatacaaaaattagctgggtgtggtgttgggcacctgtaatcctagctacttgggaggctgaagcaggagaatcgctcaaacctgggaggcagaggtggcagcgagtggagatcacaccactgcattccagcctgagcaacagagtgagactctgtctcaaaaaaawaaaaaaaaaaaaaaagagaggcaacttgtcatttaataatcacacatttagtaagtgggggagtggggatttgaaccccaccctctccaaaacattaatctccataacatgtatgacttaaataagcttaaaaacactacaataattagaaattcaccttacttagatctgaggatgaattgaagtttatacaatttataaaaatgaaagtagacttttttaaagcagttttactgcatctatccatatacaattataactttttctgtttttgagttcattttaaaattatccctttcc

SEQ ID NO: 94638 - DNA, 601 bp, Human
attgtgtggcaagcactatgcttagaacctcatatgaagttaatactctcaccaaccctttgggtaagcaatattgtccccactttaaagatgacaaaactgaggttaagaggagcaacttgctggctgggcacggtggctcacgtctgtaatcccagcattttgggaggtcaaggcaggcggatcatctggaggtcaggagttcgagaccagcctggccaacgtgctgaaaccccatctctaccaaaaaaatacaaaaattagctgggtgtggtgttgggcacctgtaatcctagctacwtgggaggctgaagcaggagaatcgctcaaacctgggaggcagaggtggcagcgagtggagatcacaccactgcattccagcctgagcaacagagtgagactctgtctcaaaaaaataaaaaaaaaaaaaaagagaggcaacttgtcatttaataatcacacatttagtaagtgggggagtggggatttgaaccccaccctctccaaaacattaatctccataacatgtatgacttaaataagcttaaaaacactacaataattagaaattcaccttacttagatctgaggatgaattgaa

SEQ ID NO: 94639 - DNA, 601 bp, Human
cccatctctagatatccctccagaaaaagagggaagaatgaaggtaaaagtaccatagtatgacatttgagggctgtttctgaagcattagccactactactaatgataaaagcaacggccagattgagaccctattgtgtggcaagcactatgcttagaacctcatatgaagttaatactctcaccaaccctttgggtaagcaatattgtccccactttaaagatgacaaaactgaggttaagaggagcaacttgctggctgggcacggtggctcacgtctgtaatcccagcattttggraggtcaaggcaggcggatcatctggaggtcaggagttcgagaccagcctggccaacgtgctgaaaccccatctctaccaaaaaaatacaaaaattagctgggtgtggtgttgggcacctgtaatcctagctacttgggaggctgaagcaggagaatcgctcaaacctgggaggcagaggtggcagcgagtggagatcacaccactgcattccagcctgagcaacagagtgagactctgtctcaaaaaaataaaaaaaaaaaaaaagagaggcaacttgtcatttaataatcacacattta

SEQ ID NO: 94640 - DNA, 601 bp, Human
cctaccactctcagtttctgcttctacccttcatcccatctctagatatccctccagaaaaagagggaagaatgaaggtaaaagtaccatagtatgacatttgagggctgtttctgaagcattagccactactactaatgataaaagcaacggccagattgagaccctattgtgtggcaagcactatgcttagaacctcatatgaagttaatactctcaccaaccctttgggtaagcaatattgtccccactttaaagatgacaaaactgaggttaagaggagcaacttgctggctgggcrcggtggctcacgtctgtaatcccagcattttgggaggtcaaggcaggcggatcatctggaggtcaggagttcgagaccagcctggccaacgtgctgaaaccccatctctaccaaaaaaatacaaaaattagctgggtgtggtgttgggcacctgtaatcctagctacttgggaggctgaagcaggagaatcgctcaaacctgggaggcagaggtggcagcgagtggagatcacaccactgcattccagcctgagcaacagagtgagactctgtctcaaaaaaataaaaaaaaaaaaaaag

SEQ ID NO: 94641 - DNA, 601 bp, Human
tataataccatccaatcattcctaccactctcagtttctgcttctacccttcatcccatctctagatatccctccagaaaaagagggaagaatgaaggtaaaagtaccatagtatgacatttgagggctgtttctgaagcattagccactactactaatgataaaagcaacggccagattgagaccctattgtgtggcaagcactatgcttagaacctcatatgaagttaatactctcaccaaccctttgggtaagcaatattgtccccactttaaagatgacaaaactgaggttaagagragcaacttgctggctgggcacggtggctcacgtctgtaatcccagcattttgggaggtcaaggcaggcggatcatctggaggtcaggagttcgagaccagcctggccaacgtgctgaaaccccatctctaccaaaaaaatacaaaaattagctgggtgtggtgttgggcacctgtaatcctagctacttgggaggctgaagcaggagaatcgctcaaacctgggaggcagaggtggcagcgagtggagatcacaccactgcattccagcctgagcaacagagtgagactctgtctcaaaa

SEQ ID NO: 94642 - DNA, 601 bp, Human
tcctagtctcaagtgatcttcctgcctcagcctcccaaagtattgggattagaggtgtgagccaccatgcccaggcagtttagtgctttttgcagcactattgctgtatctgaaaagcatggtgatgtaaactgccacaaatataatgttaaaataaggtaggctataaattgtaagtatataaaaatattgaggttccgaccagtttgggcaagaacagccctcattttctccatataataccatccaatcattcctaccactctcagtttctgcttctacccttcatcccatctctagwtatccctccagaaaaagagggaagaatgaaggtaaaagtaccatagtatgacatttgagggctgtttctgaagcattagccactactactaatgataaaagcaacggccagattgagaccctattgtgtggcaagcactatgcttagaacctcatatgaagttaatactctcaccaaccctttgggtaagcaatattgtccccactttaaagatgacaaaactgaggttaagaggagcaacttgctggctgggcacggtggctcacgtctgtaatcccagcattttgggaggtcaaggca

SEQ ID NO: 94643 - DNA, 601 bp, Human
ctgagtagctgggactacagatatgcactaccacacctggctaattttttttttgttttgttttgtggagacagggtctcactatgttgcccagactggtcttgaactcctagtctcaagtgatcttcctgcctcagcctcccaaagtattgggattagaggtgtgagccaccatgcccaggcagtttagtgctttttgcagcactattgctgtatctgaaaagcatggtgatgtaaactgccacaaatataatgttaaaataaggtaggctataaattgtaagtatataaaaatattgasgttccgaccagtttgggcaagaacagccctcattttctccatataataccatccaatcattcctaccactctcagtttctgcttctacccttcatcccatctctagatatccctccagaaaaagagggaagaatgaaggtaaaagtaccatagtatgacatttgagggctgtttctgaagcattagccactactactaatgataaaagcaacggccagattgagaccctattgtgtggcaagcactatgcttagaacctcatatgaagttaatactctcaccaaccctttgggtaagcaa

SEQ ID NO: 94644 - DNA, 601 bp, Human
taatggactcacagtttcacatggcttgggaggcctcacaatcatggtggaaggcaaaggaggagcaaaggtacatcttacatggtgtcaggcaagagagcatgcagaggggaactgccctttataaaaccatcagatctcgtgagacttactcactgtcatgagaacagcatgggaaaaacctgcctccatgattcaatgaccttccaccaggtctctcccatgacacttggagattatggagttacaattcaatgtgagatttgggtgggaacacagccaaaccatatcaggagccccrgctgggggttttgagagttcacgggacccaggctactcaagccccttccaccctttgggtcccttgcactcacccactaatggactttccagtgaaaacctgttggctatgttgagatttacctattattggatctgtcatcacctcattactgccctctgtgtctttccacctagctgctgacagcctgcaggcttggtggcataggtggcttgttccaacccacttatattttggcatttgtggggatagcttgtcacctttttgtggtaaatgttttccatggggcttgggttttgg

SEQ ID NO: 94645 - DNA, 601 bp, Human
ttccttcttcagtgactcctgttatccgtatgctagatctgctctgcatatcttcagtggttgctgcttttgatcattcctcctttctttttaatttaataattttcctccttttaacctcctagtcttttaagggattctctattgttcttattcgctattgtgtttcttttggtttcatttctgaaataacaactgagatcttcaccacattttcgagttattctaattttggcttgttactctttatttgtattatttaaaaaatgtcttttagctcatgttattcagatagtcagtagtagttttcacctgtttgcagacgtgctttcattgcaggtagggatgttattccctttctctctctcactcttctcttatataaaatttctttctagtatggggtttggccttaatctttctctgtgcttttttaaaatgtaaaattggttttccacagccttacaaggagacattgtccaaaatacctttttgcaactcctcagaactccattttgtgttgttttcatttagtgttaaaaacagtaacatgctttctgtgattttctgggtttgtttccctccttcacttttatttggt

SEQ ID NO: 94646 - DNA, 601 bp, Human
ctttttctttaaagtgcagtattgttttcactagaatatcaataggtatttgtcattctagatccatattctcaggtatactgtctggtcttccaaaatgtagttctacatttttcttgtatttcagtgaagttttttggagttataatttttagtgttggcttgctttcttgctttggtttccttcttcagtgactcctgttatccgtatgctagatctgctctgcatatcttcagtggttgctgcttttgatcattcctcctttctttttaatttaataattttcctccttttaacctyctagtcttttaagggattctctattgttcttattcgctattgtgtttcttttggtttcatttctgaaataacaactgagatcttcaccacattttcgagttattctaattttggcttgttactctttatttgtattatttaaaaaatgtcttttagctcatgttattcagatagtcagttgtagttttcacctgtttgcagacgtgctttcattgcaggtagggatgttattccctttctctctctcactcttctcttatataaaatttctttctagtatggggtttggccttaatcttt

SEQ ID NO: 94647 - DNA, 601 bp, Human
ttacagatgtgagccactgcacctgggctagatccttttttctttttctttaaagtgcagtattgttttcactagaatatcaataggtatttgtcattctagatccatattctcaggtatactgtctggtcttccaaaatgtagttctacatttttcttgtatttcagtgaagttttttggagttataatttttagtgttggcttgctttcttgctttggtttccttcttcagtgactcctgttatccgtatgctagatctgctctgcatatcttcagtggttgctgcttttgatcattcytcctttctttttaatttaataattttcctccttttaacctcctagtcttttaagggattctctattgttcttattcgctattgtgtttcttttggtttcatttctgaaataacaactgagatcttcaccacattttcgagttattctaattttggcttgttactctttatttgtattatttaaaaaatgtcttttagctcatgttattcagatagtcagttgtagttttcacctgtttgcagacgtgctttcattgcaggtagggatgttattccctttctctctctcactcttctctta

SEQ ID NO: 94648 - DNA, 601 bp, Human
tggtctcgaactcctgggatcaagcgatccacccaccttggattcccaaagtgctgggattacagatgtgagccactgcacctgggctagatccttttttctttttctttaaagtgcagtattgttttcactagaatatcaataggtatttgtcattctagatccatattctcaggtatactgtctggtcttccaaaatgtagttctacatttttcttgtatttcagtgaagttttttggagttataatttttagtgttggcttgctttcttgctttggtttccttcttcagtgactcctrttatccgtatgctagatctgctctgcatatcttcagtggttgctgcttttgatcattcctcctttctttttaatttaataattttcctccttttaacctcctagtcttttaagggattctctattgttcttattcgctattgtgtttcttttggtttcatttctgaaataacaactgagatcttcaccacattttcgagttattctaattttggcttgttactctttatttgtattatttaaaaaatgtcttttagctcatgttattcagatagtcagttgtagttttcacctgtttgca

SEQ ID NO: 94649 - DNA, 601 bp, Human
ctgatgtcggcagtttaaacattttccaagatttctttaagatgcaatcattccacctcctccatgaagccctcctaggtggaagtcatggctacttcctctgaacacgtgcagcaattcttgcttccaccacttataaggcactgcccaaaaatggcttgcaaggaaacctgaattgcctctattattcaatggcttctagtttctgtggtaaaatcaggggctgtcaaatgatctgatgataatgtaatcttttcccttataagtcatttaatctttttactcagatgtttaaaaaagkttttttttttttttttttttgggacaaggtctcactgtgttgcccaggctggattatagtcatgtgatcacagctcactgcaacctcagactcctgggctcagtttgtcctaccacctcagcctcccaagtagctggaactacaggtgtgtgacatcatgcctggataattttttttaaaaatggatacagggtctcactatgttgcctgggctggtctcgaactcctgggatcaagcgatccacccaccttggattcccaaagtgctgggattacagatgtgagccactgcacctgggc

SEQ ID NO: 94650 - DNA, 601 bp, Human
tctgatgtcggcagtttaaacattttccaagatttctttaagatgcaatcattccacctcctccatgaagccctcctaggtggaagtcatggctacttcctctgaacacgtgcagcaattcttgcttccaccacttataaggcactgcccaaaaatggcttgcaaggaaacctgaattgcctctattattcaatggcttctagtttctgtggtaaaatcaggggctgtcaaatgatctgatgataatgtaatcttttcccttataagtcatttaatctttttactcagatgtttaaaaaargttttttttttttttttttttgggacaaggtctcactgtgttgcccaggctggattatagtcatgtgatcacagctcactgcaacctcagactcctgggctcagtttgtcctaccacctcagcctcccaagtagctggaactacaggtgtgtgacatcatgcctggataattttttttaaaaatggatacagggtctcactatgttgcctgggctggtctcgaactcctgggatcaagcgatccacccaccttggattcccaaagtgctgggattacagatgtgagccactgcacctggg

SEQ ID NO: 94651 - DNA, 601 bp, Human
tctcacttttcacccagggtggagtgcagtagcatgatcatggctcactgcagcctctaactcataggctcaagtgatcctcccactccagcctcctaagtggctgggactacagatgtgcaccaccacacctggctgacattttcttttcttactttttatttagaactgaccagagagaatactagtcttactcactcaccctatgcctaccgtgcacaccgatccaggaaatgtcaggagacaaaccaaacagccaatgaaaaggaaaatgctaaaagacattagctggatcagcacyaccaatgaaagtgtgttgggtcacaaaaacgacctgcagctttcctttccactgccaaggggatatctctgttggcttccgctcatcaatctctcctccttggccctggccaatgttctcagaatgtctccggtgggctgaggatgctgacagatgccatctggtccttctcacctttcctttcctggaagtcaacacccatttcctctatggagcttcccccttttgtcagcaggggaagtgaagatcccaacctgggtacttaaaatgggccttgagtgatactttctggaacattct

SEQ ID NO: 94652 - DNA, 601 bp, Human
ctatgcttattaccccattgtagagatgaggaattggaggctttgagaggttaaataacttgcccagaatcacagagcacatgggaagcagagccaggattcagggtaggtttgactctagaacttccatcctgaccacgattcccacggttttctgagtgatggcctattgacatggccctttagcccaacacagggtctcccacagggcttggtgggtacctgaatgaatgaatgactacaagaatgaatgaaccaatgacaaagtgaatgagatttctgaagactggattttcaaaawaacatactttatctcagtaagaaaagcaagaaatgtctaaaactgagtatgggaatacttaggactttaaaatgagataatttctctacctgtctaagattcaaaggagggaaattgacactgctgcattctactcacattgcccgagtgctccagcctacaggggttatagctgaaacaacggaagctgatatattcaaaagaatattgattgcagacacacgaagggttttcctaaagttggtatcagaacctttcttccaatactgagtccccatcttcccatttagaggaagattt

SEQ ID NO: 94653 - DNA, 601 bp, Human
aaaaagagcagagccttgcttatctctgtgttacacattaacacagtcctcctttgcagaggttcttcaaggtagacagactttaaaaagtcaaataattgacagaataattaccctggcactccaaggccaatgcaaatgctgggatgtagccttcagctaaattctacactgaagtttcagtcttcaggaaagtaatagaaaatgaaatgcaaaggaaagggaatttcccaatttctccactaagattttttttaaacctcaagtgaaaaaaatctagtaagtcaaattctatatgaartcttcccagttatcttctgtccaacatctaacagcgcttttcctatcactctcatgctatttgtctcattaataattgttaataataaaagttactactgtccttaccattgcctctattatcatttactgagtttactgtatgccaggcacagtgcaggctcatccatatattatctcaggtaatcctcacagaaatctagttaagtggctatgcttattaccccattgtagagatgaggaattggaggctttgagaggttaaataacttgcccagaatcacagagcacatgggaagca

SEQ ID NO: 94654 - DNA, 601 bp, Human
ttctctttgctgtcttgttaaacacgatcgtttcttcaagcgaggtttatattgtcttgtgatttcccttttttggtgtgtgtgtgtgtgttttaaaaaaacaaattgcaggtgatacgtggcattttgcattgctaaaattcacatcccactgtacttcattagtaaaagccatttatcccccacctttcaacactgctggctgagacgcaaatagaaccatttcagttttccagttgaacagccatgggaaaaaaaaaagagcagagccttgcttatctctgtgttacacattaacacrgtcctcctttgcagaggttcttcaaggtagacagactttaaaaagtcaaataattgacagaataattaccctggcactccaaggccaatgcaaatgctgggatgtagccttcagctaaattctacactgaagtttcagtcttcaggaaagtaatagaaaatgaaatgcaaaggaaagggaatttcccaatttctccactaagattttttttaaacctcaagtgaaaaaaatctagtaagtcaaattctatatgaaatcttcccagttatcttctgtccaacatctaacagcgcttttcct

SEQ ID NO: 94655 - DNA, 601 bp, Human
ggcccccagttctctggctcaattcaatacctcctgctgcggtggcttgtttcttcttgtcctgaatgttgttcttcagagctgatgattaatgccttccatttagggtgagaaaaatgaccttgctgtctatgcaagtgaggatcatttattccatctacaaaagcagcacacatctacttggctcaactcagagtatttctctttgctgtcttgttaaacacgatcgtttcttcaagcgaggtttatattgtcttgtgatttcccttttttggtgtgtgtgtgtgtgttttaaaaaaacaaattgcaggtgatacgtggcattttgcattgctaaaattcacatcccactgtacttcattagtaaaagccatttatcccccacctttcaacactgctggctgagacgcaaatagaaccatttcagttttccagttgaacagccatgggaaaaaaaaaagagcagagccttgcttatctctgtgttacacattaacacagtcctcctttgcagaggttcttcaaggtagacagactttaaaaagtcaaataattgacagaataattaccctggcactccaaggccaatgcaaatgctggg

SEQ ID NO: 94656 - DNA, 601 bp, Human
ccctgctgatctgggagctgctacctgggctgagctggctcccgtccacagggcccccagttctctggctcaattcaatacctcctgctgcggtggcttgtttcttcttgtcctgaatgttgttcttcagagctgatgattaatgccttccatttagggtgagaaaaatgaccttgctgtctatgcaagtgaggatcatttattccatctacaaaagcagcacacatctacttggctcaactcagagtatttctctttgctgtcttgttaaacacgatcgtttcttcaagcgaggtttatrttgtcttgtgatttcccttttttggtgtgtgtgtgtgtgttttaaaaaaacaaattgcaggtgatacgtggcattttgcattgctaaaattcacatcccactgtacttcattagtaaaagccatttatcccccacctttcaacactgctggctgagacgcaaatagaaccatttcagttttccagttgaacagccatgggaaaaaaaaaagagcagagccttgcttatctctgtgttacacattaacacagtcctcctttgcagaggttcttcaaggtagacagactttaaaaagtcaaa

SEQ ID NO: 94657 - DNA, 601 bp, Human
agctgttagggctcaagaggaccagctccaccacccacccctgctgatctgggagctgctacctgggctgagctggctcccgtccacagggcccccagttctctggctcaattcaatacctcctgctgcggtggcttgtttcttcttgtcctgaatgttgttcttcagagctgatgattaatgccttccatttagggtgagaaaaatgaccttgctgtctatgcaagtgaggatcatttattccatctacaaaagcagcacacatctacttggctcaactcagagtatttctctttgctgtcttgttaaacacgatcgtttcttcaagcgaggtttatattgtcttgtgatttcccttttttggtgtgtgtgtgtgtgttttaaaaaaacaaattgcaggtgatacgtggcattttgcattgctaaaattcacatcccactgtacttcattagtaaaagccatttatcccccacctttcaacactgctggctgagacgcaaatagaaccatttcagttttccagttgaacagccatgggaaaaaaaaaagagcagagccttgcttatctctgtgttacacattaacacagtcctcctttgc

SEQ ID NO: 94658 - DNA, 601 bp, Human
cctaaaattctgcctcaacaaattaattagccactgcacaagtaaactacttggtgtagctgatgggaaagcggtaaaactcgatttcaaacttgtctaaaaaaaaaaaagaaaaatggtaaaagatccactgtttgccttcagtctcctcttagtcttcaatgcagttcttccagctcttaatctgaagagcttcgctcctgcttaatgatttctcttcctcccctctcacagaacacccttacccttgatgggccagtgatataaatatgcatttcccattcacttgtgagtttaggatttttttttttttaaagagctctaccatgttcctttgatctttgctttttatgcagacggggtccacagagaaccagctaatccagagcctacagagcccggagcacagtcaggcatttcagaaatgcacttggatggtaactaggagatttcttgaacaaagaaagttcccaacaaagctgttagggctcaagaggaccagctccaccacccacccctgctgatctgggagctgctacctgggctgagctggctcccgtccacagggcccccagttctctggctcaattcaatacctcct

SEQ ID NO: 94659 - DNA, 601 bp, Human
ttccatattacctcataggtaacctaaaattctgcctcaacaaattaattagccactgcacaagtaaactacttggtgtagctgatgggaaagcggtaaaactcgatttcaaacttgtctaaaaaaaaaaaagaaaaatggtaaaagatccactgtttgccttcagtctcctcttagtcttcaatgcagttcttccagctcttaatctgaagagcttcgctcctgcttaatgatttctcttcctcccctctcacagaacacccttacccttgatgggccagtgatataaatatgcatttcycattcacttgtgagtttaggatttttttttttttaaagagctctaccatgttcctttgatctttgctttttatgcagacggggtccacagagaaccagctaatccagagcctacagagcccggagcacagtcaggcatttcagaaatgcacttggatggtaactaggagatttcttgaacaaagaaagttcccaacaaagctgttagggctcaagaggaccagctccaccacccacccctgctgatctgggagctgctacctgggctgagctggctcccgtccacagggcccccagttct

SEQ ID NO: 94660 - DNA, 601 bp, Human
catggttcctgtcaacaaccacattctattatcctgtttcatgttactcttttcccccctcaactcattcctgccacgcaccacccaccccacccaactgtggccacggtaacaaaatcaacagcaatacctgttcactgactgctcactatgggcattcatatgtgtaaataatttaaccctcacgacagccctgtgaggttcgtactgtctcctattttacagaggacgaaactgagacacagaaaggtcgagtaacttgcccagtgctacaaggctcataaatgatagagctgggatyaaaaagctagacacctcctaaccactattccatattacctcataggtaacctaaaattctgcctcaacaaattaattagccactgcacaagtaaactacttggtgtagctgatgggaaagcggtaaaactcgatttcaaacttgtctaaaaaaaaaaaagaaaaatggtaaaagatccactgtttgccttcagtctcctcttagtcttcaatgcagttcttccagctcttaatctgaagagcttcgctcctgcttaatgatttctcttcctcccctctcacagaacacccttacccttga

SEQ ID NO: 94661 - DNA, 601 bp, Human
tcaaaacaattattttaaaatgcaataggatttgtttccttggttaagggggagctggaccggatgactttcatggttcctgtcaacaaccacattctattatcctgtttcatgttactcttttcccccctcaactcattcctgccacgcaccacccaccccacccaactgtggccacggtaacaaaatcaacagcaatacctgttcactgactgctcactatgggcattcatatgtgtaaataatttaaccctcacgacagccctgtgaggttcgtactgtctcctattttacagaggasgaaactgagacacagaaaggtcgagtaacttgcccagtgctacaaggctcataaatgatagagctgggatcaaaaagctagacacctcctaaccactattccatattacctcataggtaacctaaaattctgcctcaacaaattaattagccactgcacaagtaaactacttggtgtagctgatgggaaagcggtaaaactcgatttcaaacttgtctaaaaaaaaaaaagaaaaatggtaaaagatccactgtttgccttcagtctcctcttagtcttcaatgcagttcttccagctct

SEQ ID NO: 94662 - DNA, 601 bp, Human
aaagtatttttcaaaatatgtactctgtatgtcagtatagtgtggaaacagaaaaacaaaaaaacaaaatatggtgctctgggtttatatgaaagagacaaagcagaataaggcatgcattcatggatgttatacattcacttctgtgagaccacagaacgcatccaaacagtcctccttttatagcagttcttcaagaaaggcatatttatttatttattgagacagagtctcactctgtctgtcgcccaggctgggatgtagtgatgtgatctcggctcactgcaacctccatctcccrggttcaagcgattctcctgcctcagcctcctgagtagctgagattacaagcacatgccaccatacctggctaatttttgtatttttagtagaaacggggtttgaccatgttggccaggctggtctcaaactcctgacttcaagtgatctgcatgcctcagcatcccaaagtgctagggttacagtcgtgagccaccacagctgaccaaaagcaggcatattttaaaaggtcaaataattgacagaacatattactctggcactccaaggccaatgcaaatgctggaatgcagccttcagt

SEQ ID NO: 94663 - DNA, 601 bp, Human
ttgcttaactaacctcctgcccactaaaggagacatattttctaagataagctctgccttcaaaggactcaggagatcccatagaataatattaactgaagtgcatttcttttaaaataatgtttcattgtttccttaatctgtgttatttttattttgccaggcttaggatatcttctcctcccctaaaatgcattaaaataaatcctggcccctgcaggagtgatcaaagctctaccattcacagaggaatgtctattcctccaagcttggggaggtttcctaactaatgaactagaayattgtcagatgtctcattgccaagtaatatattaaagtgcttttctaatgagatttctgcaaggtaaccataaaaccataaaaagcacactaagcttcagtgaagcaaaaacattaaaaaaaataaccaaatgccttttagagatagaagaggtcaacacaacagctaaaaaaagctaaagagaatttgacaagtagaaaaataaagtccagataattttcgcatttgaaaaaaaaggtagacacaaggcagaggaatgtggtgggtagacaggtcatcaaggagctacctgaatatctg

SEQ ID NO: 94664 - DNA, 601 bp, Human
acactttttcagacagcttgcttcttttaagtctttcaattaaaagaaagaaagaaaagatacagcacccaactaaaacacagccacaagcacccaaggactgtcatgcttcaggaatttaaattgtacttcatttggcataatctgtgttaaaacaatatagcattatctgctttgaatgcactaggcaccctcagggtggagttgcattttgtatgagttattaaatctggttggaactcaacaagaaacagtgccatgtggggaaatccgtgctgattggacccttgactgatcacaygtcaaagcctcgtgctttgctaaagggcatcttcctttaaaaataagcaatcctattactcagagccttctctgcacaccgtgtctttgaaggaatttgatagtttgcaaattcaaagttggaaattaaaatcccacaaataagacttgaatccatttattcatgctaaaatgagtatagctttggaaagtctttccttattaggatcatttcagtataatctgtgatctggtgtgaggttgcttaactaacctcctgcccactaaaggagacatattttctaagataagctctgccttc

SEQ ID NO: 94665 - DNA, 601 bp, Human
caggggcttacgtcacttttgcccagactctcccatttctttcctctacctcttaaagttggaggaaggccctttttccatagcatcctctgcctctgtcctatttataccatttgaaaaccaagctcttttaaacactttttcagacagcttgcttcttttaagtctttcaattaaaagaaagaaagaaaagatacagcacccaactaaaacacagccacaagcacccaaggactgtcatgcttcaggaatttaaattgtacttcatttggcataatctgtgttaaaacaatatagcatyatctgctttgaatgcactaggcaccctcagggtggagttgcattttgtatgagttattaaatctggttggaactcaacaagaaacagtgccatgtggggaaatccgtgctgattggacccttgactgatcacatgtcaaagcctcgtgctttgctaaagggcatcttcctttaaaaataagcaatcctattactcagagccttctctgcacaccgtgtctttgaaggaatttgatagtttgcaaattcaaagttggaaattaaaatcccacaaataagacttgaatccatttattcatgc

SEQ ID NO: 94666 - DNA, 601 bp, Human
gctcacccagccactgtcctggcaccagcaagcgagcttccaaactctgcccatcgtactttcctctttggaaaatgcatctctctctctctctctctttttttttcttttgagacacagtctcgctgtgtcacccaggctggagtgcagtggagcaatcccagctcactacaacctccacctcccaagttcaagcgattctcctgtctcagcctcccgagtagctgggattacaggtgcgtgccaccacgcctggctaattttggtatttttagtggagacggggtcttgccatgttggycagtcttgtcttgaactcctggcctcaagtgatctgcttgcctctgcctcccaaagtgctgggattacaggcgtgagccacctcgtccggcctgaaaatttacctctaatcccaaataaaaacattccccccacccaccattttctcctgcctctgaaggtgttaaaaagttaaaaagaagctgcaactggcatctggcctctacttcccattcaggggagtgtgaaagtactataggcttcacccatttctctcctcacatgagacacaaaagagtctccagcctgacttcaggggctt

SEQ ID NO: 94667 - DNA, 601 bp, Human
aaaggtgaggaaaaacggaagaggaaagatgggaggacctagcgactttcccaagggcagcagctcacccagccactgtcctggcaccagcaagcgagcttccaaactctgcccatcgtactttcctctttggaaaatgcatctctctctctctctctctttttttttcttttgagacacagtctcgctgtgtcacccaggctggagtgcagtggagcaatcccagctcactacaacctccacctcccaagttcaagcgattctcctgtctcagcctcccgagtagctgggattacaggtkcgtgccaccacgcctggctaattttggtatttttagtggagacggggtcttgccatgttggccagtcttgtcttgaactcctggcctcaagtgatctgcttgcctctgcctcccaaagtgctgggattacaggcgtgagccacctcgtccggcctgaaaatttacctctaatcccaaataaaaacattccccccacccaccattttctcctgcctctgaaggtgttaaaaagttaaaaagaagctgcaactggcatctggcctctacttcccattcaggggagtgtgaaagtactatagg

SEQ ID NO: 94668 - DNA, 601 bp, Human
tgccaattccactgtcaccaccaccacctccatggccacagcccatttgtggtgagccttctaaagcgtgttctctttatctgatcctcaggacagtcctgtggagttgatcgggagtgatcataatctctatcgcacaaaggtgaggaaaaacggaagaggaaagatgggaggacctagcgactttcccaagggcagcagctcacccagccactgtcctggcaccagcaagcgagcttccaaactctgcccatcgtactttcctctttggaaaatgcatctctctctctctctctctttctttttcttttgagacacagtctcgctgtgtcacccaggctggagtgcagtggagcaatcccagctcactacaacctccacctcccaagttcaagcgattctcctgtctcagcctcccgagtagctgggattacaggtgcgtgccaccacgcctggctaattttggtatttttagtggagacggggtcttgccatgttggccagtcttgtcttgaactcctggcctcaagtgatctgcttgcctctgcctcccaaagtgctgggattacaggcgtgagccacctcgtccggcctgaaaatt

SEQ ID NO: 94669 - DNA, 601 bp, Human
atgccaattccactgtcaccaccaccacctccatggccacagcccatttgtggtgagccttctaaagcgtgttctctttatctgatcctcaggacagtcctgtggagttgatcgggagtgatcataatctctatcgcacaaaggtgaggaaaaacggaagaggaaagatgggaggacctagcgactttcccaagggcagcagctcacccagccactgtcctggcaccagcaagcgagcttccaaactctgcccatcgtactttcctctttggaaaatgcatctctctctctctctctcttcttttttcttttgagacacagtctcgctgtgtcacccaggctggagtgcagtggagcaatcccagctcactacaacctccacctcccaagttcaagcgattctcctgtctcagcctcccgagtagctgggattacaggtgcgtgccaccacgcctggctaattttggtatttttagtggagacggggtcttgccatgttggccagtcttgtcttgaactcctggcctcaagtgatctgcttgcctctgcctcccaaagtgctgggattacaggcgtgagccacctcgtccggcctgaaaat

SEQ ID NO: 94670 - DNA, 601 bp, Human
gatgccaattccactgtcaccaccaccacctccatggccacagcccatttgtggtgagccttctaaagcgtgttctctttatctgatcctcaggacagtcctgtggagttgatcgggagtgatcataatctctatcgcacaaaggtgaggaaaaacggaagaggaaagatgggaggacctagcgactttcccaagggcagcagctcacccagccactgtcctggcaccagcaagcgagcttccaaactctgcccatcgtactttcctctttggaaaatgcatctctctctctctctctctctttttttcttttgagacacagtctcgctgtgtcacccaggctggagtgcagtggagcaatcccagctcactacaacctccacctcccaagttcaagcgattctcctgtctcagcctcccgagtagctgggattacaggtgcgtgccaccacgcctggctaattttggtatttttagtggagacggggtcttgccatgttggccagtcttgtcttgaactcctggcctcaagtgatctgcttgcctctgcctcccaaagtgctgggattacaggcgtgagccacctcgtccggcctgaaaa

SEQ ID NO: 94671 - DNA, 601 bp, Human
caggctacaagccaacccagatgccaattccactgtcaccaccaccacctccatggccacagcccatttgtggtgagccttctaaagcgtgttctctttatctgatcctcaggacagtcctgtggagttgatcgggagtgatcataatctctatcgcacaaaggtgaggaaaaacggaagaggaaagatgggaggacctagcgactttcccaagggcagcagctcacccagccactgtcctggcaccagcaagcgagcttccaaactctgcccatcgtactttcctctttggaaaatgcacctctctctctctctctctttttttttcttttgagacacagtctcgctgtgtcacccaggctggagtgcagtggagcaatcccagctcactacaacctccacctcccaagttcaagcgattctcctgtctcagcctcccgagtagctgggattacaggtgcgtgccaccacgcctggctaattttggtatttttagtggagacggggtcttgccatgttggccagtcttgtcttgaactcctggcctcaagtgatctgcttgcctctgcctcccaaagtgctgggattacaggcgtgagcc

SEQ ID NO: 94672 - DNA, 601 bp, Human
aagcaggtcaccagccaggagccctgacccaggctgcccagcctgtccttgtgtcgtctttttaagttttccttagatggtctgtcctttctgtgatttttgtatagcactctgtatcttgagctgtggtattattattattattagtcttttaagcctccagttgagtgcttgtgatgtatattaaataaatgcattttgggttgggcatggtggtgcaggtctgtgatcccagcactttgggaggctgagaggggaggattgcttgagttcaggagttcaagaccagcccggacaacayagcaaaaccctgtctccataaaaaatgtaaaaattagctgggcatggtggtgtgtgcctgtagttccagctactcgggggactgaggtgggaggattgctcaagccagagaagttgaggttgaaataagctgagattcctgccagtgcactccagcatgggtgacagagtgaccctgactcaaaaaaaaaaattaaataaataaataaataacaacaaaatgccccagaactgcccaagattactagtgtctctggctcatgaggtcagactaggaggggcctcttcaaacagccctcta

SEQ ID NO: 94673 - DNA, 601 bp, Human
gttcctcacgccctgctaccaccccaacatggacacccagggtaatatctgcctggacatcctgaaggacaagtggtctgccctgtatgatgtcaggaccatcctgctctccatccacagccttcgaggcaaacccaacattgatagctcgttgaacaggcatgctgccaagctctggaaaccccccacagcttttaagaagcacctgcaagaaacctacttaaagcaggtcaccagccaggagccctgacccaggctgcccagcctgtccttgtgtcgtctttttaagttttccttagayggtctgtcctttctgtgatttttgtatagcactctgtatcttgagctgtggtattattattattattagtcttttaagcctccagttgagtgcttgtgatgtatattaaataaatgcattttgggttgggcatggtggtgcaggtctgtgatcccagcactttgggaggctgagaggggaggattgcttgagttcaggagttcaagaccagcccggacaacacagcaaaaccctgtctccataaaaaatgtaaaaattagctgggcatggtggtgtgtgcctgtagttccagctactcgg

SEQ ID NO: 94674 - DNA, 601 bp, Human
caatgcctagtgacacagggatttctgccttgcctgaatcaggcaaccttttcaaatgggtggggaccatccattgagcagctggcacagcatatgaagacctgaggtataagctctccctagagctccccaggggctacccttacaatgtacccatggtgaagttcctcacgccctgctaccaccccaacatggacacccagggtaatatctgcctggacatcctgaaggacaagtggtctgccctgtatgatgtcaggaccatcctgctctccatccacagccttcgaggcaaacccarcattgatagctcgttgaacaggcatgctgccaagctctggaaaccccccacagcttttaagaagcacctgcaagaaacctacttaaagcaggtcaccagccaggagccctgacccaggctgcccagcctgtccttgtgtcgtctttttaagttttccttagatggtctgtcctttctgtgatttttgtatagcactctgtatcttgagctgtggtattattattattattagtcttttaagcctccagttgagtgcttgtgatgtatattaaataaatgcattttgggttgggcatggtg

SEQ ID NO: 94675 - DNA, 601 bp, Human
accttcacaatgcctagtgacacagggatttctgccttgcctgaatcaggcaaccttttcaaatgggtggggaccatccattgagcagctggcacagcatatgaagacctgaggtataagctctccctagagctccccaggggctacccttacaatgtacccatggtgaagttcctcacgccctgctaccaccccaacatggacacccagggtaatatctgcctggacatcctgaaggacaagtggtctgccctgtatgatgtcaggaccatcctgctctccatccacagccttcgaggcraacccaacattgatagctcgttgaacaggcatgctgccaagctctggaaaccccccacagcttttaagaagcacctgcaagaaacctacttaaagcaggtcaccagccaggagccctgacccaggctgcccagcctgtccttgtgtcgtctttttaagttttccttagatggtctgtcctttctgtgatttttgtatagcactctgtatcttgagctgtggtattattattattattagtcttttaagcctccagttgagtgcttgtgatgtatattaaataaatgcattttgggttggg

SEQ ID NO: 94676 - DNA, 601 bp, Human
gaccttcacaatgcctagtgacacagggatttctgccttgcctgaatcaggcaaccttttcaaatgggtggggaccatccattgagcagctggcacagcatatgaagacctgaggtataagctctccctagagctccccaggggctacccttacaatgtacccatggtgaagttcctcacgccctgctaccaccccaacatggacacccagggtaatatctgcctggacatcctgaaggacaagtggtctgccctgtatgatgtcaggaccatcctgctctccatccacagccttcgaggyaaacccaacattgatagctcgttgaacaggcatgctgccaagctctggaaaccccccacagcttttaagaagcacctgcaagaaacctacttaaagcaggtcaccagccaggagccctgacccaggctgcccagcctgtccttgtgtcgtctttttaagttttccttagatggtctgtcctttctgtgatttttgtatagcactctgtatcttgagctgtggtattattattattattagtcttttaagcctccagttgagtgcttgtgatgtatattaaataaatgcattttgggttgg

SEQ ID NO: 94677 - DNA, 601 bp, Human
tatctctacaaaaatatataaaattagctgagtgtgtttgtgtggggtgcccctgtggtcccagctacttaggaggctgtggcagaaggattgcttgagcccaggaggttgatgatacaacgagctgtgttcacgccactgcactccagcctgggttacagagggagaccctgtctcaaaaaaattaaataggcagttgcagttgtgttctttaagttcctatctttctgtcagtgccacctagatggcctgtcaaaaccttgacccagccaccaccagcgttgctgctgcctagccaccmccagcaggggtgctgcccggtaccttgtgggcaaaaggctacagcaggagttggtgaccttcacaatgcctagtgacacagggatttctgccttgcctgaatcaggcaaccttttcaaatgggtggggaccatccattgagcagctggcacagcatatgaagacctgaggtataagctctccctagagctccccaggggctacccttacaatgtacccatggtgaagttcctcacgccctgctaccaccccaacatggacacccagggtaatatctgcctggacatcctgaaggacaagt

SEQ ID NO: 94678 - DNA, 601 bp, Human
ggtaagggaggtgattattaaaaatgtcctaggcttggtgcagtggctcatgcctgtaatcccagcacattgggaggctgagatggaaagattgcttgaggccagaagttcgagaccagcctgggaaacatggtgagacccctatctctttttttaaatttaaattttaataaaaaaaaacttttattttaggtttgggggtacatgtgaaggtttgttacataggtaaatttgtgtcacgggggtctgttgtacagattgtttcatcacccaggtattaagctcagtactcgatagttayctttcctgctcctctccctcctcccaccctccactgtcaggtagaccccagtgtctgttatatccttttttgggttcatgagttctcatcatttagctcccacttataagtgagaacacatggtatttggttttctgtttctacgttagtttgctaaggataatggcctccagctccattcatgttcccacaaaagacacgatctcattcttttttatggctgcagataccctatctctacaaaaatatataaaattagctgagtgtgtttgtgtggggtgcccctgtggtcccagctac

SEQ ID NO: 94679 - DNA, 601 bp, Human
gcccagaataagggactgatctcagttgatatcagaataggtctaagggagccacatcagccttgctgtggcgtatttggtcatggaggctagcagggtactcctaggcaggtttcatatgggctgtcaaagctttgggtctgcttaggaaggtttgtcttgaacagctttttctctgaggattgggaaccttggctggggtaagggaggtgattattaaaaatgtcctaggcttggtgcagtggctcatgcctgtaatcccagcacattgggaggctgagatggaaagattgcttgaggmcagaagttcgagaccagcctgggaaacatggtgagacccctatctctttttttaaatttaaattttaataaaaaaaaacttttattttaggtttgggggtacatgtgaaggtttgttacataggtaaatttgtgtcacgggggtctgttgtacagattgtttcatcacccaggtattaagctcagtactcgatagttacctttcctgctcctctccctcctcccaccctccactgtcaggtagaccccagtgtctgttatatccttttttgggttcatgagttctcatcatttagctccc

SEQ ID NO: 94680 - DNA, 601 bp, Human
tgttggtcaaaagtgatgcccatcaatgcagtactccagatcctactgaaaacactgtttttgatatattgggggggaatgaaatacttggtgtttacaaagaatgttcctcctgctgcagcctctggaaagccacttctagtcaaccattcaattccatgctgtcattgaatatacatacatctcagcaagtcagagaggtctgcatgctttaggagagcaggatctgtcagtaggaggcctatttggggcttttacatctgatgtgtctatttcctttctttatctgtgctgacaactmagtttgcactcagtctggtatcatagctggttcttaatcacttggggttagattaagcaaccctggatctctaacactggccatgttgcaacacacacaaggaaattgggtctctctttctttttccctgggtggtcactgtgtgggcagtgtcctctaacagcacacatgtggccatcaggctctccgcccagaataagggactgatctcagttgatatcagaataggtctaagggagccacatcagccttgctgtggcgtatttggtcatggaggctagcagggtactcctaggcagg

SEQ ID NO: 94681 - DNA, 601 bp, Human
ctgaagtcccgagggtccatgtgcataaggtggtggcaaagcctgtctagaagaagtgtgtgaatctatataaggtaccgcatgagcatatgttggtcaaaagtgatgcccatcaatgcagtactccagatcctactgaaaacactgtttttgatatattgggggggaatgaaatacttggtgtttacaaagaatgttcctcctgctgcagcctctggaaagccacttctagtcaaccattcaattccatgctgtcattgaatatacatacatctcagcaagtcagagaggtctgcatgckttaggagagcaggatctgtcagtaggaggcctatttggggcttttacatctgatgtgtctatttcctttctttatctgtgctgacaactaagtttgcactcagtctggtatcatagctggttcttaatcacttggggttagattaagcaaccctggatctctaacactggccatgttgcaacacacacaaggaaattgggtctctctttctttttccctgggtggtcactgtgtgggcagtgtcctctaacagcacacatgtggccatcaggctctccgcccagaataagggactgatct

SEQ ID NO: 94682 - DNA, 601 bp, Human
cacacttaacaaatccctttggggacagaaaaaagtgcaaaccatttaaaaatattagtttgtgggaggaagaagtcagttgcaaatcactcctctgcattatcctctagttaaatgagttggatgccccaggccacatttataatgatgtaaggctctcaatctcttactgcaggcctgaatcataactgttctcaaatcaaacatgcaatgtacaaccaaaaggttcaataagaagacctttgttttctcttctgaaagtctaagacaacacaagccagctcacaaactggccgcaggrgtaatgagcattggatacaagggatgttcagtgcatttttctacttgattaaaatcgattaattctaaaacacaaatgtgttcaagcttgtggatcagtgttgaatgctgtaacacacacatctcaatgtattaaataatctgttcacataaaattgctaattaaaaagtccaattcatttgaagacgggttctccctgcacctattcattgcacactacttcgtatttcttctgctctgaacacacctggccctgcaagttactgaagtcccgagggtccatgtgcataaggtggtggc

SEQ ID NO: 94683 - DNA, 601 bp, Human
ccacaactaaacaaaaaatttgattgtcttattatgttaacacagattcagtttatctatgcatttccattatggctaacaaataaaaaaagtacatgtcctgctgaaaatcacacttaacaaatccctttggggacagaaaaaagtgcaaaccatttaaaaatattagtttgtgggaggaagaagtcagttgcaaatcactcctctgcattatcctctagttaaatgagttggatgccccaggccacatttataatgatgtaaggctctcaatctcttactgcaggcctgaatcataacwgttctcaaatcaaacatgcaatgtacaaccaaaaggttcaataagaagacctttgttttctcttctgaaagtctaagacaacacaagccagctcacaaactggccgcaggggtaatgagcattggatacaagggatgttcagtgcatttttctacttgattaaaatcgattaattctaaaacacaaatgtgttcaagcttgtggatcagtgttgaatgctgtaacacacacatctcaatgtattaaataatctgttcacataaaattgctaattaaaaagtccaattcatttgaagacgg

SEQ ID NO: 94684 - DNA, 601 bp, Human
cccttccccacaactaaacaaaaaatttgattgtcttattatgttaacacagattcagtttatctatgcatttccattatggctaacaaataaaaaaagtacatgtcctgctgaaaatcacacttaacaaatccctttggggacagaaaaaagtgcaaaccatttaaaaatattagtttgtgggaggaagaagtcagttgcaaatcactcctctgcattatcctctagttaaatgagttggatgccccaggccacatttataatgatgtaaggctctcaatctcttactgcaggcctgaaycataactgttctcaaatcaaacatgcaatgtacaaccaaaaggttcaataagaagacctttgttttctcttctgaaagtctaagacaacacaagccagctcacaaactggccgcaggggtaatgagcattggatacaagggatgttcagtgcatttttctacttgattaaaatcgattaattctaaaacacaaatgtgttcaagcttgtggatcagtgttgaatgctgtaacacacacatctcaatgtattaaataatctgttcacataaaattgctaattaaaaagtccaattcatttg

SEQ ID NO: 94685 - DNA, 601 bp, Human
atggtctgtccttctgtggtggcacctgcctgtagtcacagctactcgggaggtggaggtagaagcattgcttgactccaggagtttgaggcttcagtgagccatgatgtcaccactgcactccagcctgggtgacagagaaggccctatctctaaaaaaacaaacaaacaaaaaagacagcaaataagcagagagaaggtgggcaggagccacacattacagaaacttctcattattgagatttctatctttctaggctgtttatggtctctcacaacaaaacaaaatggggtcaggtgyggtggctccctcctgcaatcccagcactttgggaggccgaggcaggtgaatcacttgaggtcagcagtttcagaacagactggccaacatgacaaaaccctgtctctactaaaaatataaaacagctgggcatggtggtgtacacctgtaatcccagctactcgggaggctgaggcaggagaattgcttgaaccccagaggcagaggttgcagtgagccggaatcgtgccattgcactccagcctgggtggcaaagtgagatcctgtctcaaaaaaacaaaagacaaaaaacaccgaaat

SEQ ID NO: 94686 - DNA, 601 bp, Human
aaaagctaattctgtgaagctttccatggccacttttggatgcaggccccttctgaaggacacgagagaaatgtgaaagtggtaaggaagcctttctggccaagattggagaaattctctgagcccctcacccagccattaggcctagagggtcttatgtgggtggttgaatcaccagtttgaaccgccaggcttgcccctcccaggcctccttctaggggtgtttttaggaggaaggagacctcatgtactttcctggcattgtttcaagacaggatctcaccaagacatcttgagttgyccagtaaagaaactcaacttagtggggaagcttgactgcccatttggggtcttgggccatctgtggggctggagggagcagaaaagagaatcaagacagcaaataggcctggggtgatggctcatgcctataatcccagtgctttgggaggccgaggtgagaggattgttggggccagatgttcgagaccagcctgggcaacatagtgaggtctggtctctacaaaaaataaaacaaaaaataaaaaattagccaggtctggtggctgtccagcctgtccttgtgctgtctttttaagtt

SEQ ID NO: 94687 - DNA, 601 bp, Human
atcagtaacggcagagaaaaataaaggaggctgagatactttctattcagtagtgcatggttggagtcaaaaatgaagaacatacaaatggcaggattttgtcatattattttccacagaaaaaataaaagaaaatatcaaaagatgggaattggcacatgaaaggttgaactgtcacagtgcatgtatataattatcactgccaagcagtaaaccaagaatgggattagttgaaggcaccgagggaagtgaaaggaaaccggatatacaaggagaaagggacagattgtgtttaaatttrgaacatgggctcatgccctcaaagttgactgatagctggagcatgctttctcttcagtcattcctccatttgctacttttttttttacaataaaagctaattctgtgaagctttccatggccacttttggatgcaggccccttctgaaggacacgagagaaatgtgaaagtggtaaggaagcctttctggccaagattggagaaattctctgagcccctcacccagccattaggcctagagggtcttatgtgggtggttgaatcaccagtttgaaccgccaggcttgcccctcccaggcc

SEQ ID NO: 94688 - DNA, 601 bp, Human
gactgacatcatcagtttactatctaatttcccctatagcaaagatgtgtagacacaacacccaagggaggcgggggaaatggcagccagtgacaagcgatgacaataagtaatgagctaatgcacagataagatgggcctagaaacacatcagtaacggcagagaaaaataaaggaggctgagatactttctattcagtagtgcatggttggagtcaaaaatgaagaacatacaaatggcaggattttgtcatattattttccacagaaaaaataaaagaaaatatcaaaagatgggaaytggcacatgaaaggttgaactgtcacagtgcatgtatataattatcactgccaagcagtaaaccaagaatgggattagttgaaggcaccgagggaagtgaaaggaaaccggatatacaaggagaaagggacagattgtgtttaaatttagaacatgggctcatgccctcaaagttgactgatagctggagcatgctttctcttcagtcattcctccatttgctacttttttttttacaataaaagctaattctgtgaagctttccatggccacttttggatgcaggccccttctgaagga

SEQ ID NO: 94689 - DNA, 601 bp, Human
cagtcaaaggactgacatcatcagtttactatctaatttcccctatagcaaagatgtgtagacacaacacccaagggaggcgggggaaatggcagccagtgacaagcgatgacaataagtaatgagctaatgcacagataagatgggcctagaaacacatcagtaacggcagagaaaaataaaggaggctgagatactttctattcagtagtgcatggttggagtcaaaaatgaagaacatacaaatggcaggattttgtcatattattttccacagaaaaaataaaagaaaatatcaaargatgggaattggcacatgaaaggttgaactgtcacagtgcatgtatataattatcactgccaagcagtaaaccaagaatgggattagttgaaggcaccgagggaagtgaaaggaaaccggatatacaaggagaaagggacagattgtgtttaaatttagaacatgggctcatgccctcaaagttgactgatagctggagcatgctttctcttcagtcattcctccatttgctacttttttttttacaataaaagctaattctgtgaagctttccatggccacttttggatgcaggcccct

SEQ ID NO: 94690 - DNA, 601 bp, Human
gggcaacagccctgtgtggatgtgcatgcttatagtcctagatacttgggaggccgaggtgggagaatcgcttgagcctgggaggtggaggttgcagtgagccaagatcgtgccactgtactctagcctgggtgacagagaccctgtctcaaaaaaaaaaaaaaaaagtgagtttaacaaaaaatatgtgagcatttgaaatgctaacctccagtcaaaggactgacatcatcagtttactatctaatttcccctatagcaaagatgtgtagacacaacacccaagggaggcgggggaaayggcagccagtgacaagcgatgacaataagtaatgagctaatgcacagataagatgggcctagaaacacatcagtaacggcagagaaaaataaaggaggctgagatactttctattcagtagtgcatggttggagtcaaaaatgaagaacatacaaatggcaggattttgtcatattattttccacagaaaaaataaaagaaaatatcaaaagatgggaattggcacatgaaaggttgaactgtcacagtgcatgtatataattatcactgccaagcagtaaaccaagaatgggattagtt

SEQ ID NO: 94691 - DNA, 601 bp, Human
gcctctataaccttaaacagtgcatggaagacacaagggatttttttttgttagtcttgtatttacactttaagaaataataagtgagattaacttgtcatatgccataacacagatgtacctgtaggacattatgctaaaagaaagaagccagtcccagaagggcaaatatgacatgattccatttgtatgaggtatctaaagtatttaaacttatagaagcagacacagaatggtgggtgccgggggctagggtaagggagaaatgaggagttgctgttcaatgggtataaaattctasagacctgctgtacagcaatgtgcttatagttaacagcactgtactgcacacttaaaactttgtgaagagggcagatttcatattatgtgttttctatcacaaaacacatcaagaaaaaacatagtgagtgagattaaaatgaccttattccaagattcaaagcagtgattgcttttttgcaacacttcaggacttctccaatagaccaccgagtattgtatggtctcaaaaattcctcaaaactaaaaaaaataaaaaataaaaagttttacttgtttttcataaaaaacaaaaaatgtt

SEQ ID NO: 94692 - DNA, 601 bp, Human
gtaaaaaaccaaaaacaaaacaaagtatcaataacatattcaaacaaagtcctcatggatggacagttatttatttgggaacattatgagttgaccccaagaagatgtctgcaatgatgatatatattttcaagggctgttcttaacatgttctttgtacctgccatcctagaatcttttatgttactttcatcattatacgaaaaagagctggaacttatatcctcccagggaccccaaaacgtaagccttaactgtgagcctctataaccttaaacagtgcatggaagacacaagggatttttttttgttagtcttgtatttacactttaagaaataataagtgagattaacttgtcatatgccataacacagatgtacctgtaggacattatgctaaaagaaagaagccagtcccagaagggcaaatatgacatgattccatttgtatgaggtatctaaagtatttaaacttatagaagcagacacagaatggtgggtgccgggggctagggtaagggagaaatgaggagttgctgttcaatgggtataaaattctacagacctgctgtacagcaatgtgcttatagttaacagcact

SEQ ID NO: 94693 - DNA, 601 bp, Human
tcctgacaacggccatgtgagtgagtcaatccaaagccagaacaaagtccctgctgacatactgactgcagcctcaggggacactccaggccagaaccacaaaactaagctactcccaagtttttgatccacagaaactgtgtgagatggtaaatatttattattattttaggctgctaagttttggactaatttattgtgcagtagcaaacaaataatattttcctttagttttaagtttttttttttggagatggagtcttgctctgtcgcccaggctggagtgcattggtgtgatctyggcttactgcaacctccgcctcttgggttcaagtgattctcctgccttagcctcccaagtagctgagattacaggtatgcgccaccatgcccagtgaattttgtatttttagtagagatggggtttcaccatgttggtagggctggtttcgaactcctgacctcaggtgattcacctgcctcggcctcctaaagtgctgggattacagacatgagccaccatgcttggctttaattgttttaaaagaagaaaaaaaaactgaataatacaacatctttgaactttctccatcatcagcta

SEQ ID NO: 94694 - DNA, 601 bp, Human
tgccaagagagctggagcaaaagagatgagtttgagactctgattcatccatcaagacaaataaactcagtctatggaggttagcagggcaatttgtgaagcaaacaaaagttgagttttggaaaggggctctgaagaaaatgaagatgacataccaggaatttaacttcatgacaagaagagaaagtgactcactcttgacgcgtggagtactgaaaatgccaacaggcaaacacccccaaaaggcagctccagagactatccggccacggcgtcggccctcctcccaatccgcaaaaaygtgcagtctgagttccgagctagcgtcctgctgagctgaaggagcatctccagtggagaagacggcccgatggcaccgttccatttcagcagcagcaaaagaagctctgattggtataatgcacttcctccagtggcgccaagctcctgggctggcctggggcatccacccttgctctttggtcaaaaccactgtctttacctgcattcacttctctggtggcctcctggcctcatcctcaggaaatctctaacacatctttgagtcatttactccattcccgttatctctctctgctcc

SEQ ID NO: 94695 - DNA, 601 bp, Human
ctccccatgtggcctcggcccacgccagaaggcggtcaaggtcccaggtgccggctcgcccacaagctatggctaagacagaaaaacaaaggaaaaaaagtcctccccaaacacacacataagcaaaacccatcttcctgtgttctctgccaagagagctggagcaaaagagatgagtttgagactctgattcatccatcaagacaaataaactcagtctatggaggttagcagggcaatttgtgaagcaaacaaaagttgagttttggaaaggggctctgaagaaaatgaagatgacatmccaggaatttaacttcatgacaagaagagaaagtgactcactcttgacgcgtggagtactgaaaatgccaacaggcaaacacccccaaaaggcagctccagagactatccggccacggcgtcggccctcctcccaatccgcaaaaatgtgcagtctgagttccgagctagcgtcctgctgagctgaaggagcatctccagtggagaagacggcccgatggcaccgttccatttcagcagcagcaaaagaagctctgattggtataatgcacttcctccagtggcgccaagctcctgggct

SEQ ID NO: 94696 - DNA, 601 bp, Human
caattggctggctaccatggaaacagtgcgaagctaagagattaggaaggtgctgaggaaagccattaagcatccacagctccactgcctaggcagatggtcagcaggcagtttagttgtgggagtatttccaatttgcatgaatgaaacatggacaaataagataaggctggctccagggaagtaattcccccagttcccctgagccttggatctggaaaactgcagcccatcctggaattagggaacatcacaaaacgtactggggagaactccccatgtggcctcggcccacgccagraggcggtcaaggtcccaggtgccggctcgcccacaagctatggctaagacagaaaaacaaaggaaaaaaagtcctccccaaacacacacataagcaaaacccatcttcctgtgttctctgccaagagagctggagcaaaagagatgagtttgagactctgattcatccatcaagacaaataaactcagtctatggaggttagcagggcaatttgtgaagcaaacaaaagttgagttttggaaaggggctctgaagaaaatgaagatgacataccaggaatttaacttcatgacaagaaga

SEQ ID NO: 94697 - DNA, 601 bp, Human
tctgttctcaattggctggctaccatggaaacagtgcgaagctaagagattaggaaggtgctgaggaaagccattaagcatccacagctccactgcctaggcagatggtcagcaggcagtttagttgtgggagtatttccaatttgcatgaatgaaacatggacaaataagataaggctggctccagggaagtaattcccccagttcccctgagccttggatctggaaaactgcagcccatcctggaattagggaacatcacaaaacgtactggggagaactccccatgtggcctcggccyacgccagaaggcggtcaaggtcccaggtgccggctcgcccacaagctatggctaagacagaaaaacaaaggaaaaaaagtcctccccaaacacacacataagcaaaacccatcttcctgtgttctctgccaagagagctggagcaaaagagatgagtttgagactctgattcatccatcaagacaaataaactcagtctatggaggttagcagggcaatttgtgaagcaaacaaaagttgagttttggaaaggggctctgaagaaaatgaagatgacataccaggaatttaacttcatga

SEQ ID NO: 94698 - DNA, 601 bp, Human
tttctagaatattccccccatttcccacccctccgtagctttgcttggttaactcctagatatcctgtatgtctcagattagtttcctttttgtttgacaaacctcctttgacctttcctcacctctcttcactcctgaatccaacccctccaacttagaatgtgggcctggttcttacatgactctcccttatcatagcattttcacaatgcattgaaattgctgcataccccattagatcgtgggctctgtgctgctaaggaccagtcaattgattctctctagttctttcctgtgttscaacgcctggcgttgagcaggtaatcagcaaactgctgagtagttgagtgaaccaatgtcactaccaaaatacacagtttagtattttcctatgaaggtttaaataacaagagtttaggaaccattccaagaaactggcttttgttgttgcagatcattgaaaagattttcaggggactctggactatgctagacatagctagctatgactacttttattccacagtttgtagaagggcatggtttagcatttggaaaagattcaagtgcagagattttgattaactgtgacctatttac

SEQ ID NO: 94699 - DNA, 601 bp, Human
gtcaatgttaacacttggtaaacactcctgggtagagtccagcaatccttctattagagaaaatgttttctctctgggatttgaaatgttttagatttacatcttcctcttgagaaaaactttctaactaccagaaagaagataatggtcctgaatgaatacatttactaaactgtaaaatccagaatagataagatctggctctgggtagcttttcccagcctcatttcttgccacatccctcctgaaccctgagctccagccataatgaacttgctgtggctcctcaagcatgtcttgycctccctagcccctagcctttgcacatgccatttttttctagaatattccccccatttcccacccctccgtagctttgcttggttaactcctagatatcctgtatgtctcagattagtttcctttttgtttgacaaacctcctttgacctttcctcacctctcttcactcctgaatccaacccctccaacttagaatgtgggcctggttcttacatgactctcccttatcatagcattttcacaatgcattgaaattgctgcataccccattagatcgtgggctctgtgctgctaaggac

SEQ ID NO: 94700 - DNA, 601 bp, Human
cattcctcattacagcaaagggtttatggagatccagcctcctacaccagcactttgggaggctgaggtgggaggatcacttgagcccaggagtttgacaccagcctgggagcctgggcaatatagtgagacctcatctctaaaaaataaaatataaattagccaggcgtggtggtgtgcacctgtagtcccagctactcaagaggctgaggcaggaggattgcttgaccctgggaggtcaaggctacagtgagctatgattgcgccactgctctccagcctgagtgacggggcaaaaaakttttttttcctgtagtcccagctactcgagaggctgaggcaggaggattgcttaaacccaggagtttgaggctgtagtgcctgtgattgtgcctgtgaatagccactggattgcagcctggggcaacagcgagatttcgtctctgaaaaaaaaaaaaaattcttactgagtaggtcagaactaaattcatgaaagaggaaatgggctttcaggcaaggggatcagtatgttcaagatgtgggaaaactgtgtgtcgtttgcaggaaaaataaaaatacaatagtccacccttatcccttc

SEQ ID NO: 94701 - DNA, 601 bp, Human
gtctggctgcttgttctcgagtccaataacaagatgcagacagactgggaaaggagggagtttatttttgcaaccagttacaggaagaaggtcagagtaactcaccagatcaactcaaagttacaagttttcctttagcttatatacacaattcaagctctatgtctacttgtgggagtgtttcttaatctaattttaactatgggtctgtgggtaggaaagtttcttaagtgggtcttggtgcacgctttgatccctcaatcaggtttgaggttgaggaagtccaggtaaggttttaatrggtttgtttttgcattcgagctttcttactcaggcaccagttaccccagttcgttatccattgttttctacttctgctttaatgtttaacttatacattcctcattacagcaaagggtttatggagatccagcctcctacaccagcactttgggaggctgaggtgggaggatcacttgagcccaggagtttgacaccagcctgggagcctgggcaatatagtgagacctcatctctaaaaaataaaatataaattagccaggcgtggtggtgtgcacctgtagtcccagctactcaagag

SEQ ID NO: 94702 - DNA, 601 bp, Human
ctactgcttcgttgaattaattccttaaggggaaattcctatggaaaatggtttaaaaggtgagaaaggactacaataataactaactaaatcacatttcagcattgtatagcattaagcaggtgaaaacatggaatggattaatttgtcccagtccatcatgaactaagtgatgtgctgggtcacatgaggaatagaaagatgttagggttggactcctgtcccatagggatttacaatcaggaagtgaagacaactatacatgcaattataaaacaggcgaagtgcaactggtcctacratagaaatacaaatataaaaaataatctcctgggctgtaatcccagagttcccagacaaatgaggtctggctgcttgttctcgagtccaataacaagatgcagacagactgggaaaggagggagtttatttttgcaaccagttacaggaagaaggtcagagtaactcaccagatcaactcaaagttacaagttttcctttagcttatatacacaattcaagctctatgtctacttgtgggagtgtttcttaatctaattttaactatgggtctgtgggtaggaaagtttcttaagtgggt

SEQ ID NO: 94703 - DNA, 601 bp, Human
acgtaaatgcccatcaatgacagattgaataaagaaaatgtggtacatatacaccatggaatactatgcagccataaaaaagaatgagatcatgtcttttgcaggaacacggagggagttggaggccattatcctcagcaaactaacacaggaacagaaaaccaaataccacatgttctcacttacaagtgggagctaaatgatgagaactcatgaacgcaaagaggggaacaacagacactgggtctacttgagggtggagggtgggagaagggagaggagcagaaagggcaactattgkgtactaggcctaatacctgggtgataaaatatgctgtacaacaaacctccatgacacgagtttacctatgtaacaaacctgcacatgtacccccaaacctaaaataaactttttttaaaaaagaatatttaaaacaaaaaaaagaaaaatgtcatctaatcatcatcaactttaatatctatccctatatctagagcactaacttgtactactgcttcgttgaattaattccttaaggggaaattcctatggaaaatggtttaaaaggtgagaaaggactacaataataactaactaaat

SEQ ID NO: 94704 - DNA, 601 bp, Human
attgctattattaaatagtcaaaaaacaacagatgctggcaaggttgcggagaaaagggaacacttatactctgttggtgggggtgtaaattagctcaaccattgtggaaagcagtatggcgactcctcaaagagctaaaaacagaactaccatttgatgcagcaattctattgctggatatatacccagagggacataaatcattctaccataaagacacatgaacaggaatgttcattgcagcactattcaccatagcaaagacatgggatcaacgtaaatgcccatcaatgacagatygaataaagaaaatgtggtacatatacaccatggaatactatgcagccataaaaaagaatgagatcatgtcttttgcaggaacacggagggagttggaggccattatcctcagcaaactaacacaggaacagaaaaccaaataccacatgttctcacttacaagtgggagctaaatgatgagaactcatgaacgcaaagaggggaacaacagacactgggtctacttgagggtggagggtgggagaagggagaggagcagaaagggcaactattgggtactaggcctaatacctgggtgat

SEQ ID NO: 94705 - DNA, 601 bp, Human
acatgaatggacacttttctaaagaagacacacatgtggccaataagcatatgaaaaaaagctcaacatcactgatcattagagaaatgcagatcaaaaccacaatgagataccatcttacaccagtcagaattgctattattaaatagtcaaaaaacaacagatgctggcaaggttgcggagaaaagggaacacttatactctgttggtgggggtgtaaattagctcaaccattgtggaaagcagtatggcgactcctcaaagagctaaaaacagaactaccatttgatgcagcaattcyattgctggatatatacccagagggacataaatcattctaccataaagacacatgaacaggaatgttcattgcagcactattcaccatagcaaagacatgggatcaacgtaaatgcccatcaatgacagattgaataaagaaaatgtggtacatatacaccatggaatactatgcagccataaaaaagaatgagatcatgtcttttgcaggaacacggagggagttggaggccattatcctcagcaaactaacacaggaacagaaaaccaaataccacatgttctcacttacaagtgggag

SEQ ID NO: 94706 - DNA, 601 bp, Human
gcatctgacaaaggtctaatatccagcatctgtaagcaacttaaacaaatttacaagaaaaaaccaaccccattaaaaagtgggcaaaggacatgaatggacacttttctaaagaagacacacatgtggccaataagcatatgaaaaaaagctcaacatcactgatcattagagaaatgcagatcaaaaccacaatgagataccatcttacaccagtcagaattgctattattaaatagtcaaaaaacaacagatgctggcaaggttgcggagaaaagggaacacttatactctgttggtrggggtgtaaattagctcaaccattgtggaaagcagtatggcgactcctcaaagagctaaaaacagaactaccatttgatgcagcaattctattgctggatatatacccagagggacataaatcattctaccataaagacacatgaacaggaatgttcattgcagcactattcaccatagcaaagacatgggatcaacgtaaatgcccatcaatgacagattgaataaagaaaatgtggtacatatacaccatggaatactatgcagccataaaaaagaatgagatcatgtcttttgcagg

SEQ ID NO: 94707 - DNA, 601 bp, Human
tatgaaaaaattaactcaagatggattaaagatgtaaatgtaaaaccccaaactataaaagccctggaagacaacctaggcaataccattctggacataggaacaggtaaatatttcatgacaaagacaccaaaagcaattgcaacagaagcaaaaattgacaaatgggacctaattaaacttaagagcttctgcacagcaaaagaaactatcaacagggtatacagacaacctacagaataggagaaaatatttgcaaactatgcatctgacaaaggtctaatatccagcatctgtaagsaacttaaacaaatttacaagaaaaaaccaaccccattaaaaagtgggcaaaggacatgaatggacacttttctaaagaagacacacatgtggccaataagcatatgaaaaaaagctcaacatcactgatcattagagaaatgcagatcaaaaccacaatgagataccatcttacaccagtcagaattgctattattaaatagtcaaaaaacaacagatgctggcaaggttgcggagaaaagggaacacttatactctgttggtgggggtgtaaattagctcaaccattgtggaaagcagt

SEQ ID NO: 94708 - DNA, 601 bp, Human
tcctaataattagggaacataaaaaaatgtcagaggcatcacgttacttgacttcagactatactattagggctacagtaaccaaaacagcatggtactggtacaaaaacaaacatctagatcaatggaatagagagcccagaaataagcctgcacgcctacaaccatctgatcttcaacaaagctaacaaaaacaagcaatggggaaaagactccctattcaataaatggtgctgggataactggctagcaatatgcagaagattgaggctgaaccccttccttacaccatatgaaaaawttaactcaagatggattaaagatgtaaatgtaaaaccccaaactataaaagccctggaagacaacctaggcaataccattctggacataggaacaggtaaatatttcatgacaaagacaccaaaagcaattgcaacagaagcaaaaattgacaaatgggacctaattaaacttaagagcttctgcacagcaaaagaaactatcaacagggtatacagacaacctacagaataggagaaaatatttgcaaactatgcatctgacaaaggtctaatatccagcatctgtaagcaacttaaac

SEQ ID NO: 94709 - DNA, 601 bp, Human
ttccataaatatttcataaggttagcactagctagctttcctcaatggcttgtaatgtgctcagaagatgattaaagaacagatctttctggaacatactgatcatcatatgttaaatcaggctggacagaagttcaattcctaataattagggaacataaaaaaatgtcagaggcatcacgttacttgacttcagactatactattagggctacagtaaccaaaacagcatggtactggtacaaaaacaaacatctagatcaatggaatagagagcccagaaataagcctgcacgcctayaaccatctgatcttcaacaaagctaacaaaaacaagcaatggggaaaagactccctattcaataaatggtgctgggataactggctagcaatatgcagaagattgaggctgaaccccttccttacaccatatgaaaaaattaactcaagatggattaaagatgtaaatgtaaaaccccaaactataaaagccctggaagacaacctaggcaataccattctggacataggaacaggtaaatatttcatgacaaagacaccaaaagcaattgcaacagaagcaaaaattgacaaatgggac

SEQ ID NO: 94710 - DNA, 601 bp, Human
acaaacaccagctgcttgtcaacaagggggaagaggtagaaagtaatccaggtttacctagtccttgggaaagggttatggtctgagccagtacatcagctgaactgacacttgaagagaagaaagctcaaagtaaactcaaatagagaaaataagaacaagactcttgggatacatatgactttgacctgtctccaaatttccaccccatatccatgggagcttggcctctgtggagaacagggagtcatggtctgtggaacagagagagagaagattaatcccattcacaaaaaagtcstgggtaattttttttaatcagcaaggagcattttaacttacaaaaaaataaggaataataattccataaatatttcataaggttagcactagctagctttcctcaatggcttgtaatgtgctcagaagatgattaaagaacagatctttctggaacatactgatcatcatatgttaaatcaggctggacagaagttcaattcctaataattagggaacataaaaaaatgtcagaggcatcacgttacttgacttcagactatactattagggctacagtaaccaaaacagcatggtactg

SEQ ID NO: 94711 - DNA, 601 bp, Human
agtatcctaacggtcacgtgaacctggggcttattgtagaacttccaaaggcatttcttctagagcaaccatcagttctggccttggagattttattcttttgtttatgtaaatgaaaataatttcctcataaaacaggggatttcagatttggcgcctcttcagagcaaccatacataaaagtaggaaactcattctttagaggcacgaggaagaaaatgttctcagtactcccgaaattggccttggagctgctgtttatgcctccctcatccttgctttttgggtatgttctcagggmgtctctttaacaacatgtgtgacccttttaggaagctgggcacttcaaagataatgaatggatctctgaacttggctaaggcagcagacttcaagcactaagacaatgctttttcacaaacaccagctgcttgtcaacaagggggaagaggtagaaagtaatccaggtttacctagtccttgggaaagggttatggtctgagccagtacatcagctgaactgacacttgaagagaagaaagctcaaagtaaactcaaatagagaaaataagaacaagactcttgggatacatatgacttt

SEQ ID NO: 94712 - DNA, 601 bp, Human
gatggagtatagtagcacgatcatggctcactgcagcttcgtcctttagggctcaagagatcctcccaactcagccttccaagtagctgggactacaggcacataccaccatccctggctaagtttttaaaatttgttttgtagagacagggtctccctgtgttgcccaggctggtctcgaactcctgggctcaagtgatccccctgccttggcctcccaaagcgttgggattacatgtgtgagccagtgcacccatccgtagattgggttttaaaggtgaggacattatgcctttacaargactgggagaaactacatgcaaagtatcctaacggtcacgtgaacctggggcttattgtagaacttccaaaggcatttcttctagagcaaccatcagttctggccttggagattttattcttttgtttatgtaaatgaaaataatttcctcataaaacaggggatttcagatttggcgcctcttcagagcaaccatacataaaagtaggaaactcattctttagaggcacgaggaagaaaatgttctcagtactcccgaaattggccttggagctgctgtttatgcctccctcatccttg

SEQ ID NO: 94713 - DNA, 601 bp, Human
gaatttaccatttagcaaggcaagtcacccttgcttttatcaggctgggggacagaggagtccatctggctgggtgtgagctgtgagaaatgggaacaaggtgaagcaaagctatgccaatgcacgtgggacatgttacctcacagaaggagattgcaggggcatggaaatactcttttctgctcttattggcatttttcacatcagaaatctctgcattggcactttggctaattttaggcagtgattatttttctttaattaatggtgctttctttttttgagttttgttttttatttyacttgaattattagttccctaacagtgcagggagacacagaaaggagtttttcatgatttctatagtagatttttttttctttttttgagacaggctctcactctgttatccaggatggagtatagtagcacgatcatggctcactgcagcttcgtcctttagggctcaagagatcctcccaactcagccttccaagtagctgggactacaggcacataccaccatccctggctaagtttttaaaatttgttttgtagagacagggtctccctgtgttgcccaggctggtctcgaactcc

SEQ ID NO: 94714 - DNA, 601 bp, Human
tgaggctcagaagtgccaaatagcactgctctgaaatcagggaaatggggatgtctctctgatcacaggagaggaggacctgcctggtgagaactggaaggctttgcataaggaatttaccatttagcaaggcaagtcacccttgcttttatcaggctgggggacagaggagtccatctggctgggtgtgagctgtgagaaatgggaacaaggtgaagcaaagctatgccaatgcacgtgggacatgttacctcacagaaggagattgcaggggcatggaaatactcttttctgctcttaytggcatttttcacatcagaaatctctgcattggcactttggctaattttaggcagtgattatttttctttaattaatggtgctttctttttttgagttttgttttttatttcacttgaattattagttccctaacagtgcagggagacacagaaaggagtttttcatgatttctatagtagatttttttttctttttttgagacaggctctcactctgttatccaggatggagtatagtagcacgatcatggctcactgcagcttcgtcctttagggctcaagagatcctcccaactcag

SEQ ID NO: 94715 - DNA, 601 bp, Human
gagtgttctcagattttctctcagcttcctagcaggatttcgtgtttcttctcccatttttggtattttctctagtgtcgtccctaaggctgaacctggaatagaatgctcctcttacgctagtgtagggctagttcttctcgtgtgtgtgtcttgggtacttaggataagtattactgtgtgtttgagttcagctacaagacaatttttctgagtgctaagaggaattgagaaggtgctagatgtgggtgcagtaaacagtctgggccaggaacagccagactgttcaagtgaggctcaraagtgccaaatagcactgctctgaaatcagggaaatggggatgtctctctgatcacaggagaggaggacctgcctggtgagaactggaaggctttgcataaggaatttaccatttagcaaggcaagtcacccttgcttttatcaggctgggggacagaggagtccatctggctgggtgtgagctgtgagaaatgggaacaaggtgaagcaaagctatgccaatgcacgtgggacatgttacctcacagaaggagattgcaggggcatggaaatactcttttctgctcttattggcatttt

SEQ ID NO: 94716 - DNA, 601 bp, Human
tagccagccgcgcataactgagctccttctgctctttctcagtgttttcctcttctccagcttggcccctctggtcattttctgagccgttttgtgatgtctagagactgaaaagctgtctgttatctatcccatcctttgctcatgcattctttgctgagtgttctcagattttctctcagcttcctagcaggatttcgtgtttcttctcccatttttggtattttctctagtgtcgtccctaaggctgaacctggaatagaatgctcctcttacgctagtgtagggctagttcttctcstgtgtgtgtcttgggtacttaggataagtattactgtgtgtttgagttcagctacaagacaatttttctgagtgctaagaggaattgagaaggtgctagatgtgggtgcagtaaacagtctgggccaggaacagccagactgttcaagtgaggctcagaagtgccaaatagcactgctctgaaatcagggaaatggggatgtctctctgatcacaggagaggaggacctgcctggtgagaactggaaggctttgcataaggaatttaccatttagcaaggcaagtcacccttgcttttat

SEQ ID NO: 94717 - DNA, 601 bp, Human
gaacttgggagccgccctttgctcatttctggtccgattgcctctctgttaagacattcggtttggctttaagcgggcaaggaggaggttgaaaaaagggatctctgtgtgcgaatagcccccttcagacttccgtggagcagagcgcagggcgtgatggctgcttggcgggcgtctggcgtttgtacttgcgtatgtttttaccctccaggccccggactcccattgtcacagcccagccaccgtgactccctggcagacaaccccagacgttagccagccgcgcataactgagctcctyctgctctttctcagtgttttcctcttctccagcttggcccctctggtcattttctgagccgttttgtgatgtctagagactgaaaagctgtctgttatctatcccatcctttgctcatgcattctttgctgagtgttctcagattttctctcagcttcctagcaggatttcgtgtttcttctcccatttttggtattttctctagtgtcgtccctaaggctgaacctggaatagaatgctcctcttacgctagtgtagggctagttcttctcgtgtgtgtgtcttgggtacttaggataa

SEQ ID NO: 94718 - DNA, 601 bp, Human
gtcttatctaaaatccctcgaacttgggagccgccctttgctcatttctggtccgattgcctctctgttaagacattcggtttggctttaagcgggcaaggaggaggttgaaaaaagggatctctgtgtgcgaatagcccccttcagacttccgtggagcagagcgcagggcgtgatggctgcttggcgggcgtctggcgtttgtacttgcgtatgtttttaccctccaggccccggactcccattgtcacagcccagccaccgtgactccctggcagacaaccccagacgttagccagcmgcgcataactgagctccttctgctctttctcagtgttttcctcttctccagcttggcccctctggtcattttctgagccgttttgtgatgtctagagactgaaaagctgtctgttatctatcccatcctttgctcatgcattctttgctgagtgttctcagattttctctcagcttcctagcaggatttcgtgtttcttctcccatttttggtattttctctagtgtcgtccctaaggctgaacctggaatagaatgctcctcttacgctagtgtagggctagttcttctcgtgtgtgtg

SEQ ID NO: 94719 - DNA, 601 bp, Human
tggactgctttccattttcataaaatagggcagtcatctcccacctgcaccctgtccctcttctgccctcctcattcctgcccttgactgttctgtatggagatggggctctgtgtctggagtgcatgggtcttatctaaaatccctcgaacttgggagccgccctttgctcatttctggtccgattgcctctctgttaagacattcggtttggctttaagcgggcaaggaggaggttgaaaaaagggatctctgtgtgcgaatagcccccttcagacttccgtggagcagagcgcagggygtgatggctgcttggcgggcgtctggcgtttgtacttgcgtatgtttttaccctccaggccccggactcccattgtcacagcccagccaccgtgactccctggcagacaaccccagacgttagccagccgcgcataactgagctccttctgctctttctcagtgttttcctcttctccagcttggcccctctggtcattttctgagccgttttgtgatgtctagagactgaaaagctgtctgttatctatcccatcctttgctcatgcattctttgctgagtgttctcagattttctctc

SEQ ID NO: 94720 - DNA, 601 bp, Human
tcatcgcggttctccttctggactgctttccattttcataaaatagggcagtcatctcccacctgcaccctgtccctcttctgccctcctcattcctgcccttgactgttctgtatggagatggggctctgtgtctggagtgcatgggtcttatctaaaatccctcgaacttgggagccgccctttgctcatttctggtccgattgcctctctgttaagacattcggtttggctttaagcgggcaaggaggaggttgaaaaaagggatctctgtgtgcgaatagcccccttcagacttccrtggagcagagcgcagggcgtgatggctgcttggcgggcgtctggcgtttgtacttgcgtatgtttttaccctccaggccccggactcccattgtcacagcccagccaccgtgactccctggcagacaaccccagacgttagccagccgcgcataactgagctccttctgctctttctcagtgttttcctcttctccagcttggcccctctggtcattttctgagccgttttgtgatgtctagagactgaaaagctgtctgttatctatcccatcctttgctcatgcattctttgctgagt

SEQ ID NO: 94721 - DNA, 601 bp, Human
ccagcaccgccaccacttcaatcacgcgggggtggacagggtcatcgcggttctccttctggactgctttccattttcataaaatagggcagtcatctcccacctgcaccctgtccctcttctgccctcctcattcctgcccttgactgttctgtatggagatggggctctgtgtctggagtgcatgggtcttatctaaaatccctcgaacttgggagccgccctttgctcatttctggtccgattgcctctctgttaagacattcggtttggctttaagcgggcaaggaggaggttgaawaaagggatctctgtgtgcgaatagcccccttcagacttccgtggagcagagcgcagggcgtgatggctgcttggcgggcgtctggcgtttgtacttgcgtatgtttttaccctccaggccccggactcccattgtcacagcccagccaccgtgactccctggcagacaaccccagacgttagccagccgcgcataactgagctccttctgctctttctcagtgttttcctcttctccagcttggcccctctggtcattttctgagccgttttgtgatgtctagagactgaaaagctgtct

SEQ ID NO: 94722 - DNA, 601 bp, Human
ctgggtgtgtcgaaaaaaatgcccattcctgggctgcactcctagtttctcactggtctgggcgtggagtctggtacaggtatcttaaaaaaaactccctaggtagaagcactcaattaaaacattgtttttgagtaggagatactcagatgattaggaagacaggaaggtggaaagttagaaaggaggagagggggacagattagaagaaattatgttcgtaggtctttttggggagtgagagaccaagtactacttgggaggtgccagtattcacggggaattgagaaaatccagcggrctggttctgggtgaagggtacagacacctgataacaccagcaccgccaccacttcaatcacgcgggggtggacagggtcatcgcggttctccttctggactgctttccattttcataaaatagggcagtcatctcccacctgcaccctgtccctcttctgccctcctcattcctgcccttgactgttctgtatggagatggggctctgtgtctggagtgcatgggtcttatctaaaatccctcgaacttgggagccgccctttgctcatttctggtccgattgcctctctgttaagacat

SEQ ID NO: 94723 - DNA, 601 bp, Human
catctgggtgtgtcgaaaaaaatgcccattcctgggctgcactcctagtttctcactggtctgggcgtggagtctggtacaggtatcttaaaaaaaactccctaggtagaagcactcaattaaaacattgtttttgagtaggagatactcagatgattaggaagacaggaaggtggaaagttagaaaggaggagagggggacagattagaagaaattatgttcgtaggtctttttggggagtgagagaccaagtactacttgggaggtgccagtattcacggggaattgagaaaatccagyggactggttctgggtgaagggtacagacacctgataacaccagcaccgccaccacttcaatcacgcgggggtggacagggtcatcgcggttctccttctggactgctttccattttcataaaatagggcagtcatctcccacctgcaccctgtccctcttctgccctcctcattcctgcccttgactgttctgtatggagatggggctctgtgtctggagtgcatgggtcttatctaaaatccctcgaacttgggagccgccctttgctcatttctggtccgattgcctctctgttaaga

SEQ ID NO: 94724 - DNA, 601 bp, Human
ctggctgcacactggactcatctgggtgtgtcgaaaaaaatgcccattcctgggctgcactcctagtttctcactggtctgggcgtggagtctggtacaggtatcttaaaaaaaactccctaggtagaagcactcaattaaaacattgtttttgagtaggagatactcagatgattaggaagacaggaaggtggaaagttagaaaggaggagagggggacagattagaagaaattatgttcgtaggtctttttggggagtgagagaccaagtactacttgggaggtgccagtattcacggrgaattgagaaaatccagcggactggttctgggtgaagggtacagacacctgataacaccagcaccgccaccacttcaatcacgcgggggtggacagggtcatcgcggttctccttctggactgctttccattttcataaaatagggcagtcatctcccacctgcaccctgtccctcttctgccctcctcattcctgcccttgactgttctgtatggagatggggctctgtgtctggagtgcatgggtcttatctaaaatccctcgaacttgggagccgccctttgctcatttctggtccg

SEQ ID NO: 94725 - DNA, 601 bp, Human
caagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagcgaggctctctctcaaaaaaaaaaaaaaaaaaagaagaagaaatagatgtgcccctggggaagaggatgtaagagattcccaagtgatcttctacttcaggagagttggacttgctaaacctcctcctgaaaacattttgcgaagctgaaggccraggcctgaactccctgggaggatgctacaatggggccagttctgctgttccctgtacactcggacaaccaaggaggaccaggagacttaacaccttgggtctttagtagaagactaaagttcttcagctccctgagaaccagacaagtgttaagcaccactctgcccaaggaaaagatttacactttagaaatcccagcaaatccttcaggccaggctgacggcactggaaagtgcctgtggggtccgacagtgcagtatagggtgaccctcttagaccaggagctaccaagcagaggtt

SEQ ID NO: 94726 - DNA, 601 bp, Human
tcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagcgaggctctctctcaaaaaaaaaaaaaaaaaaagaagaagaaatagatgtgcccctggggaagaggatgtaagagattcccaagtgatcttctacttcaggagagytggacttgctaaacctcctcctgaaaacattttgcgaagctgaaggccgaggcctgaactccctgggaggatgctacaatggggccagttctgctgttccctgtacactcggacaaccaaggaggaccaggagacttaacaccttgggtctttagtagaagactaaagttcttcagctccctgagaaccagacaagtgttaagcaccactctgcccaaggaaaagatttacactttagaaatcccagcaaatccttcaggccaggctgacggcactggaaagtgcctgtggggtccgaca

SEQ ID NO: 94727 - DNA, 601 bp, Human
aaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagcgaggctctctctaaaaaaaaaaaaaaaaaaaagaagaagaaatagatgtgcccctggggaagaggatgtaagagattcccaagtgatcttctacttcaggagagttggacttgctaaacctcctcctgaaaacattttgcgaagctgaaggccgaggcctgaactccctgggaggatgctacaatggggccagttctgctgttccctgtacactcggacaaccaaggaggaccaggagacttaacaccttgggtctttagtagaagactaaagttcttcagctccctgagaaccagacaagtgttaagcacca

SEQ ID NO: 94728 - DNA, 601 bp, Human
cactctcaggcccctacatactaacccagtgcctggtatcctcagacatcaggaagggtttcttgaactacctgtaaggggaggctcacccatctttaaagcttagtctctatccataggccctgcgctgactaacaagaattgcaatctgcttagaaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaaraaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagcgaggctctctctcaaaaaaaaaaaaaaaaaaagaagaagaaatagatgtgcccctggggaagaggatgtaagagattcccaagtgatcttctacttcaggagagttggacttgctaaacctcctcctgaaaacattttgcgaagctgaaggccgagg

SEQ ID NO: 94729 - DNA, 601 bp, Human
tggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccataggccctgcgctgactaacaagaattgcaatctgcttagaaatagatgtgcttggctgggcacggggtggctcatgcccgtaatcccagcactttgggaagccaaggtgggcagatcaygaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagcgaggctctctctcaaaaaaaaaaaaaaaaaaagaagaagaaatagatgtgcccctggggaagaggatgtaagagattcccaagtgatcttct

SEQ ID NO: 94730 - DNA, 601 bp, Human
cctgcctcagcctcctgagtggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccataggccctgcgctgactaacaagaattgcaatctgcttagaaatagatgtgcttggctgggcacggggtggctcatgcccgtaatcccagcactttgggargccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagcgaggctctctctcaaaaaaaaaaaaaaaaaaagaagaagaaatagatgtgcccctggggaagaggatgtaaga

SEQ ID NO: 94731 - DNA, 601 bp, Human
tttttgggatgagatcttgttacattgcccaggttggtcttggactcccaggagtccaagctcaagccatcctcctgcctcagcctcctgagtggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccataggccctgcgctgactaacaagaattacaatctgcttagaaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagagc

SEQ ID NO: 94732 - DNA, 601 bp, Human
ttttttgggatgagatcttgttacattgcccaggttggtcttggactcccaggagtccaagctcaagccatcctcctgcctcagcctcctgagtggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccataggccctgcgctgactaacaagaatcgcaatctgcttagaaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacagag

SEQ ID NO: 94733 - DNA, 601 bp, Human
tttttttgggatgagatcttgttacattgcccaggttggtcttggactcccaggagtccaagctcaagccatcctcctgcctcagcctcctgagtggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccataggccctgcgctgactaacaagaattgcaatctgcttagaaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcacaccacggcactccagcctggcgacaga

SEQ ID NO: 94734 - DNA, 601 bp, Human
gagtttccctaggaaatttctccttctttttttgggatgagatcttgttacattgcccaggttggtcttggactcccaggagtccaagctcaagccatcctcctgcctcagcctcctgagtggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccrtaggccctgcgctgactaacaagaattgcaatctgcttagaaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttgaacctgggaggcggaggttgcagtgcaccaagatcaca

SEQ ID NO: 94735 - DNA, 601 bp, Human
tcacacctgattctgggattcctagaagcctagatagtgagtttccctaggaaatttctccttctttttttgggatgagatcttgttacattgcccaggttggtcttggactcccaggagtccaagctcaagccatcctcctgcctcagcctcctgagtggctgagactacaggtgagcaaccaccaagcctggctaggacacttcatcttggagtccctgcccactctcaggcccctacatactaacccagtgcctggtatcctcagacatcaggaagggtttcttgaactacctgtaaggggaggctcacccatctttaaagcttagtctctatccataggccctgcgctgactaacaagaattgcaatctgcttagaaatagatgtgcttggctgggcacggggtggctcatgcccgtaatcccagcactttgggaagccaaggtgggcagatcatgaggtcaggagatcgagaccatcctggctaacatggtgaaaaccgatctctactaaaaatacaagaaattagtcaggctaattttggtagcacgtgcctgtagtcccagctacttggaaggctgaggcagaagaattgtttg

SEQ ID NO: 94736 - DNA, 601 bp, Human
agggcaaaagtgtgtaagaactgcttcctcttctctaaatataatctgttggggtggtgttggggaggcttagcgcattaagagtaagaacaaaatgctgggaggtaatagactatagtgactttggagcgtggacttggaatcaggaattctgctctaccactcctgagttatgcaacattgcacaagttatttcacttcccctgctttattcatctgtgaaatggaatgatagtatcccagtcattagaccatcaaaaggatcaaacaagatacagccattagcacagtacctggcatsgggtaaacattcagtaagtatgagctgttgcttttcatttcagaaattagactttcatcaaggaaggtgaaagacagggacctgcctgaggagaggcaggaaaacgctggcctgccttgaatagtgagcatgtgggccagctcgggaagaggattcgtgtgtggtgcagggcacagcagaaatcagatgaggtggggcctcaccctccaatgtgtctctgaaagtgggagtgtcatgattcgagtggcatttcccaagatgattttggaggtctccgcatcaggatgggacacggcgggg

SEQ ID NO: 94737 - DNA, 601 bp, Human
tagtcatttccactttagtgtgaatgaagaaccaatagtttataataatgggaccctgccaaacactgtttagggcaaaagtgtgtaagaactgcttcctcttctctaaatataatctgttggggtggtgttggggaggcttagcgcattaagagtaagaacaaaatgctgggaggtaatagactatagtgactttggagcgtggacttggaatcaggaattctgctctaccactcctgagttatgcaacattgcacaagttatttcacttcccctgctttattcatctgtgaaatggaakgatagtatcccagtcattagaccatcaaaaggatcaaacaagatacagccattagcacagtacctggcatggggtaaacattcagtaagtatgagctgttgcttttcatttcagaaattagactttcatcaaggaaggtgaaagacagggacctgcctgaggagaggcaggaaaacgctggcctgccttgaatagtgagcatgtgggccagctcgggaagaggattcgtgtgtggtgcagggcacagcagaaatcagatgaggtggggcctcaccctccaatgtgtctctgaaagtggga

SEQ ID NO: 94738 - DNA, 601 bp, Human
tggctaagacatttgagtatggggacttctccgagttatgatagatttgcaaacaacactcaccttgactcttgatgctgggtcctgaaaatagtgtgtgcattaataccaaataaggggaaaatcagggtttaagaaggacctcagataccacatatggagatagagagttcagacaacttggcaaaaatccctagattgagatgagattctgataacacattaaagggaacaggagcacacaaaagtacaaaacgggaaaagaatagtaggaaggcactatggccaagatggggaaggkgatgaaacaagtggaagcttcctgatattaaataaggggaagcagtaactgtatggctaattaaagagcagagccatctgccaaggcaagtcatttagggaacttccagaggcgggatgatgtagcagctgaaccctggtatgggaatctagcacacggtctcaggggtactggctgaggacagcaggggaggagaagaaagtacaacagcttaagcagcataggccagatttaatctcaggcttttagtttaaggcaaattcatctagttatggaagctactgttagtcatttccactt

SEQ ID NO: 94739 - DNA, 601 bp, Human
tcagcctcccaaggagctaggactacaggcaagtgcaaccatgcccggctaattaaaaaagaattttttttttttttttgtagagacagggtcttgctttgttgcccaggctggtctcgaacccttggcttcaagtgatcctccctcctcggcctctcaaagtgctggggttacaggcatgagccactgttcatggcctcttgctgagtacatgctaacatggctaagacatttgagtatggggacttctccgagttatgatagatttgcaaacaacactcaccttgactcttgatgctgsgtcctgaaaatagtgtgtgcattaataccaaataaggggaaaatcagggtttaagaaggacctcagataccacatatggagatagagagttcagacaacttggcaaaaatccctagattgagatgagattctgataacacattaaagggaacaggagcacacaaaagtacaaaacgggaaaagaatagtaggaaggcactatggccaagatggggaaggggatgaaacaagtggaagcttcctgatattaaataaggggaagcagtaactgtatggctaattaaagagcagagccatctg

SEQ ID NO: 94740 - DNA, 601 bp, Human
gacagagtcttgctctgtcactcaggcaggagtgcaatggtgctacgatcatagctcactgcagactccaaactcctagtctcatgggtccttctgcctcagcctcccaaggagctaggactacaggcaagtgcaaccatgcccggctaattaaaaaagaattttttttttttttttgtagagacagggtcttgctttgttgcccaggctggtctcgaacccttggcttcaagtgatcctccctcctcggcctctcaaagtgctggggttacaggcatgagccactgttcatggcctcttrctgagtacatgctaacatggctaagacatttgagtatggggacttctccgagttatgatagatttgcaaacaacactcaccttgactcttgatgctgggtcctgaaaatagtgtgtgcattaataccaaataaggggaaaatcagggtttaagaaggacctcagataccacatatggagatagagagttcagacaacttggcaaaaatccctagattgagatgagattctgataacacattaaagggaacaggagcacacaaaagtacaaaacgggaaaagaatagtaggaaggcactat

SEQ ID NO: 94741 - DNA, 601 bp, Human
ttagtagagatggggtttcaccatgttggccaggctggtctcgaactcctgacctcaggtgatccacctgcctcagcctcccaaagagctaggattaaaggcataagccactgcacctggcttttcaaaagtttttatagacagagtcttgctctgtcactcaggcaggagtgcaatggtgctacgatcatagctcactgcagactccaaactcctagtctcatgggtccttctgcctcagcctcccaaggagctaggactacaggcaagtgcaaccatgcccggctaattaaaaaagaattttttttttttttttgtagagacagggtcttgctttgttgcccaggctggtctcgaacccttggcttcaagtgatcctccctcctcggcctctcaaagtgctggggttacaggcatgagccactgttcatggcctcttgctgagtacatgctaacatggctaagacatttgagtatggggacttctccgagttatgatagatttgcaaacaacactcaccttgactcttgatgctgggtcctgaaaatagtgtgtgcattaataccaaataaggggaaaatcagggtttaagaaggacct

SEQ ID NO: 94742 - DNA, 601 bp, Human
attctcctgcctcatcctcctgagtagctgggattacaggcagccatcaccatgcccggctgatttttgtatttttagtagagatggggtttcaccatgttggccaggctggtctcgaactcctgacctcaggtgatccacctgcctcagcctcccaaagagctaggattaaaggcataagccactgcacctggcttttcaaaagtttttatagacagagtcttgctctgtcactcaggcaggagtgcaatggtgctacgatcatagctcactgcagactccaaactcctagtctcatggrtccttctgcctcagcctcccaaggagctaggactacaggcaagtgcaaccatgcccggctaattaaaaaagaattttttttttttttttgtagagacagggtcttgctttgttgcccaggctggtctcgaacccttggcttcaagtgatcctccctcctcggcctctcaaagtgctggggttacaggcatgagccactgttcatggcctcttgctgagtacatgctaacatggctaagacatttgagtatggggacttctccgagttatgatagatttgcaaacaacactcaccttgact

SEQ ID NO: 94743 - DNA, 601 bp, Human
ttatttaagtttttttttttttttttgagacagagtttcgctctttcgctcaggcaggagtgaagttgtgcaatctcggctcactgcaacctctgccctgtgggttcaagcgattctcctgcctcatcctcctgagtagctgggattacaggcagccatcaccatgcccggctgatttttgtatttttagtagagatggggtttcaccatgttggccaggctggtctcgaactcctgacctcaggtgatccacctgcctcagcctcccaaagagctaggattaaaggcataagccactgcrcctggcttttcaaaagtttttatagacagagtcttgctctgtcactcaggcaggagtgcaatggtgctacgatcatagctcactgcagactccaaactcctagtctcatgggtccttctgcctcagcctcccaaggagctaggactacaggcaagtgcaaccatgcccggctaattaaaaaagaattttttttttttttttgtagagacagggtcttgctttgttgcccaggctggtctcgaacccttggcttcaagtgatcctccctcctcggcctctcaaagtgctggggttacaggc

SEQ ID NO: 94744 - DNA, 601 bp, Human
tttatttaagtttttttttttttttttgagacagagtttcgctctttcgctcaggcaggagtgaagttgtgcaatctcggctcactgcaacctctgccctgtgggttcaagcgattctcctgcctcatcctcctgagtagctgggattacaggcagccatcaccatgcccggctgatttttgtatttttagtagagatggggtttcaccatgttggccaggctggtctcgaactcctgacctcaggtgatccacctgcctcagcctcccaaagagctaggattaaaggcataagccactgyacctggcttttcaaaagtttttatagacagagtcttgctctgtcactcaggcaggagtgcaatggtgctacgatcatagctcactgcagactccaaactcctagtctcatgggtccttctgcctcagcctcccaaggagctaggactacaggcaagtgcaaccatgcccggctaattaaaaaagaattttttttttttttttgtagagacagggtcttgctttgttgcccaggctggtctcgaacccttggcttcaagtgatcctccctcctcggcctctcaaagtgctggggttacagg

SEQ ID NO: 94745 - DNA, 601 bp, Human
ctcttctatgtcatttctacccaaactcactgtctgctcccagcagtcctgctcacccaccattacatgttcattaccccttccagcacctttgcttatgctgatgcccttacctacttggaatatcttccctcctcttatttcttatcacactttatttgacattctaagactgaagtttcatttctctttgacattttttgcggcctgacagcttcaggctcccccttatttcttctctaaaatcctgttggtttcggtaagttccacagagtgtagtgcatcactgttttctaatgcyttccttagctggcctaattgaggatgccagcatcctgtcggaatcagaacagaaccaggaactacggaatcaaaagatcttcatgttcattggaaggagacagagctcaggctgtgtgaagtgggtatagggcagcagtaacttcagaacaacataacatgattagccaaacagaagtgaaaagatagccactgtcttgaaaatgcaccagtgtacacatggccaaaagcgtacacctcaccaaagtggtgttataactatcttatttatcagctggcagattattaatcatgattttct

SEQ ID NO: 94746 - DNA, 601 bp, Human
gagacaaaagcattcttggggacagaacacttggctctgaatccttgtctacaatttatagccaaaagaccttggacaagccacttaaccacttttacaagatgaagaaactaggaagtgtctaagaatatcctctttgggtttggaagtaagtgaacctatcatgaatgtgtcctagagctgggacatagatgtcaaagatgctttgacatctatgaagttctgaagtctcactgtctgggtctggagctctcattctctgcaaatcagttcaatgcatttcctcacctacctaaacacratgtatgtgactcataacatggttcacttcctcagggattaaaaaaatagagcttataaaggtatcaccctttacccagttagccaatttttttttcatctgaaagagctgtgtagaagatattaggagaagtcatgtttgaaagctaaatatacttgaattaagcctgggaaatggtcaaaagtcaaattacccccaataatcatttctgtcctccaatatcatattgtactatatattttttgcttcgttgctttctcatttgcccatcatctcttccatttttaccaattcactctt

SEQ ID NO: 94747 - DNA, 601 bp, Human
aatatttgattataatctagaaataggtatgttctgaaaaagtactactgatacagaaaaggtagttttatagatggatggatttaaatttggagtattatgagttggttcagaagaatttaagaaaggcagttctcacaaaacacacaaatatcatgaggaaaagactttgacatgaaattaattttgaatttgaccagcaattcattccagctgattttatataaagtcttggtagtgaggacagagttaaaatgtgttatcctataaaaagcacagcaggaacaatattgaagaagtwtgtgaacaatttcctagtcccttacagagcacaaagcactccccagccatgacctgagatgtcctcatgatgttactatttaaaaaaaagagacaaaagcattcttggggacagaacacttggctctgaatccttgtctacaatttatagccaaaagaccttggacaagccacttaaccacttttacaagatgaagaaactaggaagtgtctaagaatatcctctttgggtttggaagtaagtgaacctatcatgaatgtgtcctagagctgggacatagatgtcaaagatgctttgaca

SEQ ID NO: 94748 - DNA, 601 bp, Human
tgcccccctccgcccccctttttttttttgagacggagtcttgctctgtcgcccagtgtggagtgcagtggtgccatctcggctcactgcaagctccacatcctgggctcacgccattctcctgcctcagcctcccaagtagctgggactacaggcatccaccaccactcccggctaactttttgtatttttagtagagacggggtgaccgtgttacccaggatggtctcgatctcctgacctcgtgatccacctgcctcggcctcccaaagtactgggattacaggagtgagcaacagcrcccggcctcctttgccacttttaattaagttctagacaaaggactcacagactaccagattattttaagaatatttgattataatctagaaataggtatgttctgaaaaagtactactgatacagaaaaggtagttttatagatggatggatttaaatttggagtattatgagttggttcagaagaatttaagaaaggcagttctcacaaaacacacaaatatcatgaggaaaagactttgacatgaaattaattttgaatttgaccagcaattcattccagctgattttatataaagtc

SEQ ID NO: 94749 - DNA, 601 bp, Human
agcttcccaaatagctaggactgcaggtgtgtgccaccacgcctggctaaattttgtatttttttagatatggggtcttgccatgttggccaggctggtcttgaactcctgagctcaggcaacctgcctgcctcggcctctcaaagtgctgggattataggtgtaagccaccatgcctggcttctcctttgcccccctccgcccccctttttttttttgagacggagtcttgctctgtcgcccagtgtggagtgcagtggtgccatctcggctcactgcaagctccacatcctgggctcaygccattctcctgcctcagcctcccaagtagctgggactacaggcatccaccaccactcccggctaactttttgtatttttagtagagacggggtgaccgtgttacccaggatggtctcgatctcctgacctcgtgatccacctgcctcggcctcccaaagtactgggattacaggagtgagcaacagcgcccggcctcctttgccacttttaattaagttctagacaaaggactcacagactaccagattattttaagaatatttgattataatctagaaataggtatgttctgaaaaag

SEQ ID NO: 94750 - DNA, 601 bp, Human
gcgaacatggctcactgcagcctcaatctcctgggcccaaacaatcctcccacctcagcttcccaaatagctaggactgcaggtgtgtgccaccacgcctggctaaattttgtatttttttagatatggggtcttgccatgttggccaggctggtcttgaactcctgagctcaggcaacctgcctgcctcggcctctcaaagtgctgggattataggtgtaagccaccatgcctggcttctcctttgcccccctccgcccccctttttttttttgagacggagtcttgctctgtcgcccaktgtggagtgcagtggtgccatctcggctcactgcaagctccacatcctgggctcacgccattctcctgcctcagcctcccaagtagctgggactacaggcatccaccaccactcccggctaactttttgtatttttagtagagacggggtgaccgtgttacccaggatggtctcgatctcctgacctcgtgatccacctgcctcggcctcccaaagtactgggattacaggagtgagcaacagcgcccggcctcctttgccacttttaattaagttctagacaaaggactcacagactac

SEQ ID NO: 94751 - DNA, 601 bp, Human
agtggtgcgaacatggctcactgcagcctcaatctcctgggcccaaacaatcctcccacctcagcttcccaaatagctaggactgcaggtgtgtgccaccacgcctggctaaattttgtatttttttagatatggggtcttgccatgttggccaggctggtcttgaactcctgagctcaggcaacctgcctgcctcggcctctcaaagtgctgggattataggtgtaagccaccatgcctggcttctcctttgcccccctccgcccccctttttttttttgagacggagtcttgctctgtygcccagtgtggagtgcagtggtgccatctcggctcactgcaagctccacatcctgggctcacgccattctcctgcctcagcctcccaagtagctgggactacaggcatccaccaccactcccggctaactttttgtatttttagtagagacggggtgaccgtgttacccaggatggtctcgatctcctgacctcgtgatccacctgcctcggcctcccaaagtactgggattacaggagtgagcaacagcgcccggcctcctttgccacttttaattaagttctagacaaaggactcaca

SEQ ID NO: 94752 - DNA, 601 bp, Human
ttagagactgggtcttctctgtcactcaggctggagcacagtggtgcgaacatggctcactgcagcctcaatctcctgggcccaaacaatcctcccacctcagcttcccaaatagctaggactgcaggtgtgtgccaccacgcctggctaaattttgtatttttttagatatggggtcttgccatgttggccaggctggtcttgaactcctgagctcaggcaacctgcctgcctcggcctctcaaagtgctgggattataggtgtaagccaccatgcctggcttctcctttgcccccctcygcccccctttttttttttgagacggagtcttgctctgtcgcccagtgtggagtgcagtggtgccatctcggctcactgcaagctccacatcctgggctcacgccattctcctgcctcagcctcccaagtagctgggactacaggcatccaccaccactcccggctaactttttgtatttttagtagagacggggtgaccgtgttacccaggatggtctcgatctcctgacctcgtgatccacctgcctcggcctcccaaagtactgggattacaggagtgagcaacagcgcccggcctcc

SEQ ID NO: 94753 - DNA, 601 bp, Human
cctcctttgctacattttttctttttagagactgggtcttctctgtcactcaggctggagcacagtggtgcgaacatggctcactgcagcctcaatctcctgggcccaaacaatcctcccacctcagcttcccaaatagctaggactgcaggtgtgtgccaccacgcctggctaaattttgtatttttttagatatggggtcttgccatgttggccaggctggtcttgaactcctgagctcaggcaacctgcctgcctcggcctctcaaagtgctgggattataggtgtaagccaccatgmctggcttctcctttgcccccctccgcccccctttttttttttgagacggagtcttgctctgtcgcccagtgtggagtgcagtggtgccatctcggctcactgcaagctccacatcctgggctcacgccattctcctgcctcagcctcccaagtagctgggactacaggcatccaccaccactcccggctaactttttgtatttttagtagagacggggtgaccgtgttacccaggatggtctcgatctcctgacctcgtgatccacctgcctcggcctcccaaagtactgggattacagg

SEQ ID NO: 94754 - DNA, 601 bp, Human
atgtaagatgtgactttgctcctccttcgccttccaccatgattgtgaggcctccccagcctcatggagctgtgagtccattaaccatctttttcttataagttactcagtctcgggtatgtatttattagcagcataagaacagtctaatacagaggaggtgaaggagaaggagaagaaagaaaaaatgaagaaagatagccagatcctgaaggaagttatagcaaggaagaagaaagttctaaccttggaagaaaacaaaaattcactactatgaaatacatccttggaacaaaattayatttgtactccataagtttatgcaaataaaaaataaacattaaaaataaagtaaattaaaattcaatttaatgaatcatatcaccttaaaagtacttagaagtctcctgcagaatctccacctaagtctgcatactcctcctttgctacattttttctttttagagactgggtcttctctgtcactcaggctggagcacagtggtgcgaacatggctcactgcagcctcaatctcctgggcccaaacaatcctcccacctcagcttcccaaatagctaggactgcaggtgtgtgccacca

SEQ ID NO: 94755 - DNA, 601 bp, Human
ccacccaaggtggactacctacatttttctatccagatgactgtacccaaaccaggctaccccactttccttttaccttacacactcaattaattctcattcaatctctttagatccttctcaaccctctaaattcattttcttgccttccctattttttataactctcgctcagtaactttagagtgtctcttccttttgatcattccttagagggtctcttctttttgaacattccttgaagggaaagaagggagagaggatgatatggtttgactgtgtccccacccaaatctcaaaytgtagctcccataattcccatgtgtcatgggttggggggtacgcggtggaaggtaattgaatcatggggacaggtttttcctgtgctgttctcgtaatagcgactaagtctcatgagatctgatggtttcataaagggcagttcccctgcacatgctgtcctgcctgctgccatgtaagatgtgactttgctcctccttcgccttccaccatgattgtgaggcctccccagcctcatggagctgtgagtccattaaccatctttttcttataagttactcagtctcgggtatgtatttat

SEQ ID NO: 94756 - DNA, 601 bp, Human
atccttgcccttgttccattaagagctccagactgctcaaacatctgtctagcaaacatcctgttcatagaataaatgactgtgcgctgcctccctctgccttgtacccaccctcggcaactccagaaagcaaccaagtcatctgcagtgctgcctgatgtaaagagatgtccacccaaggtggactacctacatttttctatccagatgactgtacccaaaccaggctaccccactttccttttaccttacacactcaattaattctcattcaatctctttagatccttctcaaccctcyaaattcattttcttgccttccctattttttataactctcgctcagtaactttagagtgtctcttccttttgatcattccttagagggtctcttctttttgaacattccttgaagggaaagaagggagagaggatgatatggtttgactgtgtccccacccaaatctcaaattgtagctcccataattcccatgtgtcatgggttggggggtacgcggtggaaggtaattgaatcatggggacaggtttttcctgtgctgttctcgtaatagcgactaagtctcatgagatctgatggttt

SEQ ID NO: 94757 - DNA, 601 bp, Human
agaagttttagagaaaggtaaatgaagatacatggtgagaaagaataagcaagcgacttaatggtgacccacagggacaccaagaggacaagtcttgtatagaagagaagagatgctgaaaatgttttcggtggatacaatgccagccccaacaatgctgcactctcctccccgactctcaagaactatcatcccacacattccattgatcagcaatttcactgccaacaatcatcttgaattgcaggtctgtcctgcaattcaatccctgacagttctgttctacctcaggagagcactstactcaatgactctgtaccaaataacttctaactctttccactctacctttcttccaagaagggcaaggcagatcgagaatttatttctgtttttaagaataaagaaatttttaggtcactctgagctaattttctcatacagaaagctcaaaatcagtcctcaaggccaggtcaagggtaataacaacattatcatctaactcatactcagtgtttggattccgtttaaaacaggtcacagaattcttaaatgtatagggacaaacatcaggataggtccaattatttatttatccttg

SEQ ID NO: 94758 - DNA, 601 bp, Human
agatgcagtctcttgcaaaggaaagtcacatcaataaattattagtgtaatattcaagggaccaaacagacctcttagagtacatggaggcgggttggcctccacgtgacttcctgtgttggaagaatctgtagggattcaacattctttccagtactttcttcagagctgatacccagtaggatacctatttactaagctctgattggttctttaccacttacctggtctggaaattcccccagaatatgcagagggaatggaaaaactccttttttttttttttagatggagttttgcrcttgttgcccagggtgcaatggtgtgatctcggctcactgcaacctctgcctcgtgggttcaagcgatcctcctgcctcagcctcccaagtagctggaattacaggtgctcgccaccatgcctggctaatttttgtatttttagtagagatggggtttcaccatgttggccaggctggtcttgaacccctgacctcaggtgatctgcccacctcagtctcccaaagtgctgggattacaggtgtgagccactgcacgcgaccaaaatctcttgataaaagcaaattacagaagttttaga

SEQ ID NO: 94759 - DNA, 601 bp, Human
aaggctacagaacggccttttggttttgagatgcagtctcttgcaaaggaaagtcacatcaataaattattagtgtaatattcaagggaccaaacagacctcttagagtacatggaggcgggttggcctccacgtgacttcctgtgttggaagaatctgtagggattcaacattctttccagtactttcttcagagctgatacccagtaggatacctatttactaagctctgattggttctttaccacttacctggtctggaaattcccccagaatatgcagagggaatggaaaaactccttttttttttttttagatggagttttgcacttgttgcccagggtgcaatggtgtgatctcggctcactgcaacctctgcctcgtgggttcaagcgatcctcctgcctcagcctcccaagtagctggaattacaggtgctcgccaccatgcctggctaatttttgtatttttagtagagatggggtttcaccatgttggccaggctggtcttgaacccctgacctcaggtgatctgcccacctcagtctcccaaagtgctgggattacaggtgtgagccactgcacgcgaccaaaatctctt

SEQ ID NO: 94760 - DNA, 601 bp, Human
ccaatcatcttactattccaagaagcagaacactctaggacaagtaagaattctttttttatttttatttttgtagagacagagtcttgctatgttgactaggctggtctcaaactcgtgggctcaagtaatcctcttacttcagcctcccaaagtactgggattatgggtgttagcaacagtgcccagccatgaattctttaaaaatacctgaacccaggaatactttgaatgacagccatcgtcaggggattcaatattaggacaaatcatatcatgggttcctatttctctctcccartgcttggaataccttaggtaaacaggctgagtcaacatttggattattctaagaatgtaaatgattttgtcaatcctgccaccaggctatttctagaattctacaagacttccataccacaaaaatctataatatccactgactcctgctggggtgatgtagtggaagggcagaggaggggctgttaggaccagtttgctgcacaacatttacaaaaacctttgactatttcaaatatccttgaacaaatgctgggtttactaacacaatgaaaagtttaacaaacaatacgtaaactgg

SEQ ID NO: 94761 - DNA, 601 bp, Human
tgtggaaatctgtaagacccactgtatatgtgtgcgtctatttctggactctctgttcttttccactggtctatgtgtctatctttgcaccaataactatggcataatttagaaattaattgtactaaagttgaagcactaaatagagggcagatctaatatatctgttcccccccaatcatcttactattccaagaagcagaacactctaggacaagtaagaattctttttttatttttatttttgtagagacagagtcttgctatgttgactaggctggtctcaaactcgtgggctcamgtaatcctcttacttcagcctcccaaagtactgggattatgggtgttagcaacagtgcccagccatgaattctttaaaaatacctgaacccaggaatactttgaatgacagccatcgtcaggggattcaatattaggacaaatcatatcatgggttcctatttctctctcccaatgcttggaataccttaggtaaacaggctgagtcaacatttggattattctaagaatgtaaatgattttgtcaatcctgccaccaggctatttctagaattctacaagacttccataccacaaaaat

SEQ ID NO: 94762 - DNA, 601 bp, Human
tttcctaatgaatcataataatgcctttgtggaaatctgtaagacccactgtatatgtgtgcgtctatttctggactctctgttcttttccactggtctatgtgtctatctttgcaccaataactatggcataatttagaaattaattgtactaaagttgaagcactaaatagagggcagatctaatatatctgttcccccccaatcatcttactattccaagaagcagaacactctaggacaagtaagaattctttttttatttttatttttgtagagacagagtcttgctatgttgacyaggctggtctcaaactcgtgggctcaagtaatcctcttacttcagcctcccaaagtactgggattatgggtgttagcaacagtgcccagccatgaattctttaaaaatacctgaacccaggaatactttgaatgacagccatcgtcaggggattcaatattaggacaaatcatatcatgggttcctatttctctctcccaatgcttggaataccttaggtaaacaggctgagtcaacatttggattattctaagaatgtaaatgattttgtcaatcctgccaccaggctatttctagaat

SEQ ID NO: 94763 - DNA, 601 bp, Human
gaattaatttttgtgtgtgctatgaggcagaggtcaagtttcatttttcctcccctaaaaggacatccaattgcttcagcaccatttgttgaaaagaccatctttttcctaatgaatcataataatgcctttgtggaaatctgtaagacccactgtatatgtgtgcgtctatttctggactctctgttcttttccactggtctatgtgtctatctttgcaccaataactatggcataatttagaaattaattgtactaaagttgaagcactaaatagagggcagatctaatatatctgttyccccccaatcatcttactattccaagaagcagaacactctaggacaagtaagaattctttttttatttttatttttgtagagacagagtcttgctatgttgactaggctggtctcaaactcgtgggctcaagtaatcctcttacttcagcctcccaaagtactgggattatgggtgttagcaacagtgcccagccatgaattctttaaaaatacctgaacccaggaatactttgaatgacagccatcgtcaggggattcaatattaggacaaatcatatcatgggttcctatttctctct

SEQ ID NO: 94764 - DNA, 601 bp, Human
tatggttttacttttcacatttaagtttttgctccatcttgaattaatttttgtgtgtgctatgaggcagaggtcaagtttcatttttcctcccctaaaaggacatccaattgcttcagcaccatttgttgaaaagaccatctttttcctaatgaatcataataatgcctttgtggaaatctgtaagacccactgtatatgtgtgcgtctatttctggactctctgttcttttccactggtctatgtgtctatctttgcaccaataactatggcataatttagaaattaattgtactaaarttgaagcactaaatagagggcagatctaatatatctgttcccccccaatcatcttactattccaagaagcagaacactctaggacaagtaagaattctttttttatttttatttttgtagagacagagtcttgctatgttgactaggctggtctcaaactcgtgggctcaagtaatcctcttacttcagcctcccaaagtactgggattatgggtgttagcaacagtgcccagccatgaattctttaaaaatacctgaacccaggaatactttgaatgacagccatcgtcaggggattca

SEQ ID NO: 94765 - DNA, 601 bp, Human
ttcaatcctttacacattttccagagctgatgcaagtaaccccctgggtgatttctggtttggctctgaaacacaaaactgtggaagccaacagataccgagagagcgggtgcttgctgactgcgcctgtcccctgacggcctggcttcccggcatctgcaatagagatgtgaacaccaactttttagttactggtaattagtgtgtcacttctgctaattctgaatgccagggttcaatcaccaggggccttcagaaagacttgggaccgtccgcagaggagggtcatggagctggcagyctgggatcctcatgtggggcagtgtgagactccagaacctaacctggctcttattccatgcttagcatggtttcttgaatgaataaattaatgatcccttctgaattttaaatctctgctgacttgggtctcctatcctagcaaagtacaaactgcagggtcatcttgcatcagagtcctgggaaagggacaacctcccctttaggactggaaagttttctggcataatcagcattcaaaggacataaagtctccccttctgcaacaggctatttccagcacaatattaatttcttgaaa

SEQ ID NO: 94766 - DNA, 601 bp, Human
tgtcactggccttttataaagaaatttgctgattcctgctctaatcaactgagggagactgatgcctaaataagacattatgggaaagtctcaggacttcaatcctttacacattttccagagctgatgcaagtaaccccctgggtgatttctggtttggctctgaaacacaaaactgtggaagccaacagataccgagagagcgggtgcttgctgactgcgcctgtcccctgacggcctggcttcccggcatctgcaatagagatgtgaacaccaactttttagttactggtaattagtrtgtcacttctgctaattctgaatgccagggttcaatcaccaggggccttcagaaagacttgggaccgtccgcagaggagggtcatggagctggcagcctgggatcctcatgtggggcagtgtgagactccagaacctaacctggctcttattccatgcttagcatggtttcttgaatgaataaattaatgatcccttctgaattttaaatctctgctgacttgggtctcctatcctagcaaagtacaaactgcagggtcatcttgcatcagagtcctgggaaagggacaacctccccttt

SEQ ID NO: 94767 - DNA, 601 bp, Human
ttgcatggcttatgagctaagaatggtgtttggatttttgtttttttaaattaagaaaaattttatttttttgagacagaaccttactctgttgctcaggctggagtgcagtggcatgatcttggctcacggcaacctccgcctcccgggttcaagctcaagcaattcccatgactcagtctcccaagtagctaggactacaagtgcatgcccagctaatttttgtgttttcagtagaaacagcattttgccacgttggccaggctggtctcgaacccctgagctcaagcgatccccccamcttggcctcccaaagtgttgggattacaggcgtgagccactatgcccggcctgcagtttcaaatggttgaaaaaaaattaaaagatggatatttcatgacgtgtgaaaattgtaaaggaaatgtccataaaataaagttctgttggaacacagccacacttatttgtttcctgtggtctctggctgctagagcagttgtggctgagactgtatggctaaaatagtcactgtcactggccttttataaagaaatttgctgattcctgctctaatcaactgagggagactgatgcctaaata

SEQ ID NO: 94768 - DNA, 601 bp, Human
cactgcagcctcaaactcctggtctccagcgatcctcccaccccagcctcccgagtagctgggactataggcgtgcaccaccatgtcagttaatttttattttttatttttgtagagacggggtcttgctatgttgcccaggctggtcccgaattcctggcttcaagtaattctcctgcctcagcctccccaactgctgggattacaggtgtgagccaccatgcctggccaggaggcacctttgaacagaagaggcccgggtgtcgaggaaggtggtacaggggtccttcttccagtgtgstcaggagaggcagctggtaagaaggaagaagagtgactgatctattgggtgtgaccagggtccccaaggagagggccctttcccagcgttctcagtgtccaggtccctggcaggaggcattggcaagtggggggcaccctcaagccacggcctaaatagagtcagcaggtatggggccactgagagaggccagagtgatgcttctccattcccccaattagggaacacaccccccaccttctgtatcatggcaccctctggagaagttccctactcagagtcaacacaaaccatgtgtat

SEQ ID NO: 94769 - DNA, 601 bp, Human
tggctaaggaattcacattctttttttttttttttttttgagacaggctagagtgcagtggggcaatcacagctcactgcagcctcaatctcctggctcaaggggttcttccaccttagtctcctgagtagctggggccacaggcatgcctcaccatgcccagctaattaaaaaaattatttgtaagaaggaagtctcactgtgttggtcaggctggtctcaaactccaggactcaagtgatcctcctgcctcagcctcccaaagtgctgggattacaggcatgtgctactgcacccagcytcacactttttttttctttttttccatttgggaagtcatttcaaagctgatttattaaaagaatatcatgctttttccacttggggctggggccagcatttagcaaaattcagaaaggagacatttttttctttgctattcctcctcttgttcctttttaatgctctgttctggagtggtctcctctgtccctaacttatggttctacagccttggtacttaggagaatagatcccacctcactccttctatcctacttccaagtgcccttaaaatgtactcatccatctcccagcactt

SEQ ID NO: 94770 - DNA, 601 bp, Human
ataaggtagagaacagagttgaggctaacagcagtggttttcagtccagggcaattccccagctccacacccttaggggacatttggcaatgtctgaagatgcttttaattctcacgacaggggggatgggggaatgctactgttatatagtgggtagaggctggggatactgctaaacatcttccaaagcacaggcagcccgcacaacaaataattatctggccccaaatgtcaatagtgctgaggctgagaaaccctgacttgcagagaactcagccaccctggctaaggaattcacaytctttttttttttttttttttgagacaggctagagtgcagtggggcaatcacagctcactgcagcctcaatctcctggctcaaggggttcttccaccttagtctcctgagtagctggggccacaggcatgcctcaccatgcccagctaattaaaaaaattatttgtaagaaggaagtctcactgtgttggtcaggctggtctcaaactccaggactcaagtgatcctcctgcctcagcctcccaaagtgctgggattacaggcatgtgctactgcacccagcctcacactttttttttct

SEQ ID NO: 94771 - DNA, 601 bp, Human
gcttagcaggtgacccgacctgggcttgagcccttcgtgggattttcacaatgcagcagggagaagggaagccctttctttcctctggggtctttaagctgtaataaaaatgtgagtggagttgatatctcccactgcataggaagctttctgaagcagaagaaaatgagactagtatattgagagcaaagagtcaagagttagagttctgatggcgtgtgtacctggatgcaggggcccttgaggctggatcccgccccgctttttgttttgcctaggctggtttcaaatgggctggtaraacttgcaacagaaagagctccgactgcgggagccacagtcctcctggagttctagaagttgcttctccggtcacacagagagcaaacaaaatagtcaagggagactatcatccaccttagagcttgctggagaagtaaggcagcttaaaatggatgtctggttatgcccttttacttaaactaagttccttttttggtagcatgagtttgataattttttaatttttatttttcgtaggatagttgtgaggctcagcaattcaaaatgtataaaaaggacaaaaacgaccaggcgcggt

SEQ ID NO: 94772 - DNA, 601 bp, Human
tgcagtaaggatggaggggaacccatccacggactgcatttctgctcttactcttgctccgccttcctcttaaaaacataactgatcggggtgaaattttattgctcctttaagagaagcttcactgtaaaggatggtatagtagtgttgcctctgccatcacccccacctcaggcattttctggtacctgttcccagattttacacaaaccaggcggattcacgccggtgccaatgtcagtggccgcatccctccggccgcatgggggagccagagcttagcaggtgacccgacctgggyttgagcccttcgtgggattttcacaatgcagcagggagaagggaagccctttctttcctctggggtctttaagctgtaataaaaatgtgagtggagttgatatctcccactgcataggaagctttctgaagcagaagaaaatgagactagtatattgagagcaaagagtcaagagttagagttctgatggcgtgtgtacctggatgcaggggcccttgaggctggatcccgccccgctttttgttttgcctaggctggtttcaaatgggctggtagaacttgcaacagaaagagctccga

SEQ ID NO: 94773 - DNA, 601 bp, Human
atggaccaaactatcgtatatctggaatatacaaaagttttaggaaatgacaccttcataagtggtaagtgtgatgccttaacataggttctgttctattttttattttttataagaacatggtggttgtgatcgctacattagttccaggagtcactgatgggtcatggtctgcagtgtaagaaacattgctttgggtcatgcatgtggcaaattacattatgaaggtagaggaaaaccggcagagcatcacagttgggttttgcttgttctggaaagtctgcagaaaaaattgtttctytcctacttcctcttcacttctttacttcagcacccatctcgttgactgacatagtgggttttttggtttttttttttcagagacaggatcttgctctgttgcccaggctggagtgcagtggtgccatcatagctcactgcagccccaccttttgagctcaagcgatcctcccacctcagcctcccgagtggctagggactacaggtgcgagccaccacaccagcctcaactgccttggtgtttctgactagccctgaggacaagccctcagggaggccttgtctattgggatctgccctg

SEQ ID NO: 94774 - DNA, 601 bp, Human
gtctttatttgagcctcagtttctcttgttttacaagtgaggattctaataatctatccaaaaaggtgttctactcttaaattggatttgaaacacacatgatagtaaatatgtttgtattcttaacagtctggttacaaggacagcgatgagaaaacaaataccctgtttaattatttaggtcagtgacttcccaagtttccttagttttgacatggaccaaactatcgtatatctggaatatacaaaagttttaggaaatgacaccttcataagtggtaagtgtgatgccttaacatargttctgttctattttttattttttataagaacatggtggttgtgatcgctacattagttccaggagtcactgatgggtcatggtctgcagtgtaagaaacattgctttgggtcatgcatgtggcaaattacattatgaaggtagaggaaaaccggcagagcatcacagttgggttttgcttgttctggaaagtctgcagaaaaaattgtttctctcctacttcctcttcacttctttacttcagcacccatctcgttgactgacatagtgggttttttggtttttttttttcagagacag

SEQ ID NO: 94775 - DNA, 601 bp, Human
ggcaggaggaggaggtggggggagattctcaactctttctttatacgtctttggataatttctgcttattactattaccttagaggtcactatttttgattaaaaaatattcttagaggtcaaggaagccctaatctgaagaaatattcaggcaagaaaagaattaaacagagagcctctccgtctcagaaacaaatattgggaaggtgttttgctttcgctgtgagcatcatctttgatttaaaagggttaagtcaaatatggctatttcagttcacgttcccatttcaaaatattgccyttcgaatctttctaggctaggagtttgctgaaaggtatggggcttgttaaagccagctttccttactaccagtaaggaaagtaaagaccactcgccaggctgtgccaaccgtaagaattgccaccgtagtctcaagtgtcatggagaaaaggcttgtaccattaattctgctgttgctaagaaaccttgagcaagaaggacatgctgtctttatttgagcctcagtttctcttgttttacaagtgaggattctaataatctatccaaaaaggtgttctactcttaaattggatttgaaac

SEQ ID NO: 94776 - DNA, 601 bp, Human
aaatttggaaacaacagaaaaaatacagaactgatttaataaattacagtattcatacttggaatattacgtagctgttgagaagcagacttggacggatgtccatgaagtatttgttgagaaaagcgagtttcagaataatttactggcacactatattctcatttcaccgtagggatatatgtttgaatatgcttggatatgaaaaagagtgtggaaagatacaaaccagggcagttcacattggttacctcaggcaggaggaggaggtggggggagattctcaactctttctttatasgtctttggataatttctgcttattactattaccttagaggtcactatttttgattaaaaaatattcttagaggtcaaggaagccctaatctgaagaaatattcaggcaagaaaagaattaaacagagagcctctccgtctcagaaacaaatattgggaaggtgttttgctttcgctgtgagcatcatctttgatttaaaagggttaagtcaaatatggctatttcagttcacgttcccatttcaaaatattgcctttcgaatctttctaggctaggagtttgctgaaaggtatggggctt

SEQ ID NO: 94777 - DNA, 601 bp, Human
tgcagagaaatggcacttctccatttctggtgggagtgtgaattactacaatctatttagaaagtaatctgacaatgtctgttaacactgaaacaaatattttgacttaggtaactgttggggaatctatcttatagcaatacaatcactagtatgtatgatatgtgtactttgatgcttaaagtaggttttttaagttaacaaaaatttggaaacaacagaaaaaatacagaactgatttaataaattacagtattcatacttggaatattacgtagctgttgagaagcagacttggacrgatgtccatgaagtatttgttgagaaaagcgagtttcagaataatttactggcacactatattctcatttcaccgtagggatatatgtttgaatatgcttggatatgaaaaagagtgtggaaagatacaaaccagggcagttcacattggttacctcaggcaggaggaggaggtggggggagattctcaactctttctttatacgtctttggataatttctgcttattactattaccttagaggtcactatttttgattaaaaaatattcttagaggtcaaggaagccctaatctgaaga

SEQ ID NO: 94778 - DNA, 601 bp, Human
aggttaatattcagtgctagtaaagatgcagagaaatggcacttctccatttctggtgggagtgtgaattactacaatctatttagaaagtaatctgacaatgtctgttaacactgaaacaaatattttgacttaggtaactgttggggaatctatcttatagcaatacaatcactagtatgtatgatatgtgtactttgatgcttaaagtaggttttttaagttaacaaaaatttggaaacaacagaaaaaatacagaactgatttaataaattacagtattcatacttggaatattacrtagctgttgagaagcagacttggacggatgtccatgaagtatttgttgagaaaagcgagtttcagaataatttactggcacactatattctcatttcaccgtagggatatatgtttgaatatgcttggatatgaaaaagagtgtggaaagatacaaaccagggcagttcacattggttacctcaggcaggaggaggaggtggggggagattctcaactctttctttatacgtctttggataatttctgcttattactattaccttagaggtcactatttttgattaaaaaatattcttag

SEQ ID NO: 94779 - DNA, 601 bp, Human
gctcactgcaacctctgcctccgcctccgggattccagtgattctcctgcctcagcttcccgagtagctgggattacaggcatgtgccaccacgcctggctaatttttatagttttagtagagacggggttttgccatattggccagggtggtctcgaactcctgaccttaagtgatccacttgccttggcctcccaaagtgctgggattacaggcatgagccactgtgcctggccaataaatatgtgttttctagttaaaattggaattaaaactaaaaaagagaggttaatattcagtsctagtaaagatgcagagaaatggcacttctccatttctggtgggagtgtgaattactacaatctatttagaaagtaatctgacaatgtctgttaacactgaaacaaatattttgacttaggtaactgttggggaatctatcttatagcaatacaatcactagtatgtatgatatgtgtactttgatgcttaaagtaggttttttaagttaacaaaaatttggaaacaacagaaaaaatacagaactgatttaataaattacagtattcatacttggaatattacgtagctgttgagaagc

SEQ ID NO: 94780 - DNA, 601 bp, Human
ccttattcgtgtaaggggattctaagtgttgttaagtatgtgttttcttttttttttgagacagagtctcgctctgtcacccagggtggagtgcagtggtgcgatctcagctcactgcaacctctgcctccgcctccgggattccagtgattctcctgcctcagcttcccgagtagctgggattacaggcatgtgccaccacgcctggctaatttttatagttttagtagagacggggttttgccatattggccagggtggtctcgaactcctgaccttaagtgatccacttgccttggcytcccaaagtgctgggattacaggcatgagccactgtgcctggccaataaatatgtgttttctagttaaaattggaattaaaactaaaaaagagaggttaatattcagtgctagtaaagatgcagagaaatggcacttctccatttctggtgggagtgtgaattactacaatctatttagaaagtaatctgacaatgtctgttaacactgaaacaaatattttgacttaggtaactgttggggaatctatcttatagcaatacaatcactagtatgtatgatatgtgtactttgatgctta

SEQ ID NO: 94781 - DNA, 601 bp, Human
cactgaaatactgaatctcagcaactaagcctcaaatcccatagctcttagtaacagcattttatgctaattaacctgatccactatggaaagggaaatgtatcttgttaaatataatatttaacagaaatcacaatatagatatactttatttttcccttcttttcacaagtgttggcatggcgtattttaattaatgttacgtaattataaaaggttatacatcatgtagaaaacatagaaaaaagtgccaagaattttcatatgacaaatttttatatgtcaaactctcccttattcrtgtaaggggattctaagtgttgttaagtatgtgttttcttttttttttgagacagagtctcgctctgtcacccagggtggagtgcagtggtgcgatctcagctcactgcaacctctgcctccgcctccgggattccagtgattctcctgcctcagcttcccgagtagctgggattacaggcatgtgccaccacgcctggctaatttttatagttttagtagagacggggttttgccatattggccagggtggtctcgaactcctgaccttaagtgatccacttgccttggcctcccaaag

SEQ ID NO: 94782 - DNA, 601 bp, Human
gttgcagtgagctgagatcgcgccactgcactgcagcctgggcaacagagtgagactccatctcaaaaaaaaaaaaaaaaaaaaacagctgtcaaatacatgtgctgtcattgttcttttatgacaaaacttgctgactgtttctgtgtatgtcatgtcaagattcagaagaaactcagtttctttggtgcaaggccaatactgaatagtatcctttttgccctcattttaaaaggcaaaatgttttattatataaactctggaaaatatacaaaagaatgaaattcacttgtagctcctygatacatatacatttagcagctgagttacagagtacaaatattttaagccttgtgataatggtgagttttaaaaaaaaaaggatatacgaattgtttgttcattccatcccagatctcctttaagagccaacctgacatttattgatattacctttgtaattagaaaggatttacaacctcaaatagctagtttccttttcattttcttctataataaagcaaatcttaataaagaccagataatagtgtgtatatatagacaccgtatgtataaatataataaatatataaataaatat

SEQ ID NO: 94783 - DNA, 601 bp, Human
agaccaaagccaataccattactttattctgagggctaagaattaatcaaatgatttactgaacacctaagataaaaaacacctatcaaaggagttcgagaccagactgaccaacatgacaaaaccctgtctctagtaaaaacacaaaaattagccgattgtgttggcgagcacctgtagtcccagctactctggaggctaaggtgggagaattgcttgaacctggaggcggaggttgcagtgagctgagatcgcgccactgcactgcagcctgggcaacagagtgagactccatctcaaaaaaaaaaaaaaaaaaaaacagctgtcaaatacatgtgctgtcattgttcttttatgacaaaacttgctgactgtttctgtgtatgtcatgtcaagattcagaagaaactcagtttctttggtgcaaggccaatactgaatagtatcctttttgccctcattttaaaaggcaaaatgttttattatataaactctggaaaatatacaaaagaatgaaattcacttgtagctcctcgatacatatacatttagcagctgagttacagagtacaaatattttaagccttgtgataatggtgag

SEQ ID NO: 94784 - DNA, 601 bp, Human
taatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcacctgtttaaaaaaaaaaaaagataaaaattagttacatatggggatgtggttgacttttgaattggcakgtagttgagtgtttccaaataaatgaagatgttaaaatatggggataaaggatatatgagtaattgtataaatgatatgctggagtgctctgtggaactcaagttacatgattttagctatgaaaggcaattttgctgtattggttgatgcatcaaaggtacatcttattatagaactggaagagcacatttcacaatgagattcagagaggttaaagacctttcctttgtagtccggatctccttcaaaaggtaaagtggaggaataattagtagcagagctgagactcaaacgcatgg

SEQ ID NO: 94785 - DNA, 601 bp, Human; identical to SEQ ID NO: 33021

SEQ ID NO: 94786 - DNA, 601 bp, Human; identical to SEQ ID NO: 33020

SEQ ID NO: 94787 - DNA, 601 bp, Human; identical to SEQ ID NO: 33019

SEQ ID NO: 94788 - DNA, 601 bp, Human; identical to SEQ ID NO: 33018

SEQ ID NO: 94789 - DNA, 601 bp, Human; identical to SEQ ID NO: 19528

SEQ ID NO: 94790 - DNA, 601 bp, Human; identical to SEQ ID NO: 19529

SEQ ID NO: 94791 - DNA, 601 bp, Human; identical to SEQ ID NO: 19530

SEQ ID NO: 94792 - DNA, 601 bp, Human; identical to SEQ ID NO: 19531

SEQ ID NO: 94793 - DNA, 601 bp, Human; identical to SEQ ID NO: 19532

SEQ ID NO: 94794 - DNA, 601 bp, Human; identical to SEQ ID NO: 19533

SEQ ID NO: 94795 - DNA, 601 bp, Human; identical to SEQ ID NO: 19534

SEQ ID NO: 94796 - DNA, 601 bp, Human; identical to SEQ ID NO: 19535

SEQ ID NO: 94797 - DNA, 601 bp, Human; identical to SEQ ID NO: 19536

SEQ ID NO: 94798 - DNA, 601 bp, Human; identical to SEQ ID NO: 19537

SEQ ID NO: 94799 - DNA, 601 bp, Human; identical to SEQ ID NO: 19538

SEQ ID NO: 94800 - DNA, 601 bp, Human; identical to SEQ ID NO: 19539

SEQ ID NO: 94801 - DNA, 601 bp, Human; identical to SEQ ID NO: 19540

SEQ ID NO: 94802 - DNA, 601 bp, Human; identical to SEQ ID NO: 19541

SEQ ID NO: 94803 - DNA, 601 bp, Human; identical to SEQ ID NO: 19542

SEQ ID NO: 94804 - DNA, 601 bp, Human; identical to SEQ ID NO: 19543

SEQ ID NO: 94805 - DNA, 601 bp, Human; identical to SEQ ID NO: 19544

SEQ ID NO: 94806 - DNA, 601 bp, Human; identical to SEQ ID NO: 19545

SEQ ID NO: 94807 - DNA, 601 bp, Human; identical to SEQ ID NO: 19546

SEQ ID NO: 94808 - DNA, 601 bp, Human; identical to SEQ ID NO: 19547

SEQ ID NO: 94809 - DNA, 601 bp, Human; identical to SEQ ID NO: 19548

SEQ ID NO: 94810 - DNA, 601 bp, Human; identical to SEQ ID NO: 19549

SEQ ID NO: 94811 - DNA, 601 bp, Human; identical to SEQ ID NO: 19550

SEQ ID NO: 94812 - DNA, 601 bp, Human; identical to SEQ ID NO: 19551

SEQ ID NO: 94813 - DNA, 601 bp, Human; identical to SEQ ID NO: 19552

SEQ ID NO: 94814 - DNA, 601 bp, Human; identical to SEQ ID NO: 19553

SEQ ID NO: 94815 - DNA, 601 bp, Human; identical to SEQ ID NO: 19554

SEQ ID NO: 94816 - DNA, 601 bp, Human
agagagatgggtgtatttataaaagtgtaacaagtgatgatgcaactgctctgtatcttgactgtggtgatgggtacatgaacttaaacatgtgctaaaattgcatagaaccaaacagacacatacaaatgaggacatatggctcggcacagcggctcatgcctgtaatcccagcactttgggaggctgaggccggtggatcacctgaagtcaggagttcgagaccagcctgaccaacgtggtgaaaccctgtctctactaaaaatacaaaaattagccaggcgtggtggcatgtgcctgyagtcccagctacacgggaggctgagacaggagaatcgctcgaacccaggaggcagaggttgcagtaagctgagatggcgccactgcactccagccagggcgacagagcaagactctgtccaaaaagaaacaaaaaaacaaacaaacaaatgaggacatataaaattgatgaaatcagtaagatctggattaccaacaccaatattctattccactattgtactatagttttgtaagatgttacccttgaggaaaactggatgaaagagacacaggatctctattatttcttcccacagct

SEQ ID NO: 94817 - DNA, 601 bp, Human
ggacagatccagattttgtgggaccctatagattacacagttttggaatcttctttttttaaaaaagtataaagtcaaaattaggtatgggaaaatcgaagagatggagaacagactactcgttgccagagttcagggatagaagagaggagagagagatgggtgtatttataaaagtgtaacaagtgatgatgcaactgctctgtatcttgactgtggtgatgggtacatgaacttaaacatgtgctaaaattgcatagaaccaaacagacacatacaaatgaggacatatggctcggcrcagcggctcatgcctgtaatcccagcactttgggaggctgaggccggtggatcacctgaagtcaggagttcgagaccagcctgaccaacgtggtgaaaccctgtctctactaaaaatacaaaaattagccaggcgtggtggcatgtgcctgcagtcccagctacacgggaggctgagacaggagaatcgctcgaacccaggaggcagaggttgcagtaagctgagatggcgccactgcactccagccagggcgacagagcaagactctgtccaaaaagaaacaaaaaaacaaacaaacaa

SEQ ID NO: 94818 - DNA, 601 bp, Human
atgcatacaaggtactacgtgagaagcaaagtcacggtcactgccgggagggaggtggcacattagtcatttctcctggcctggcctctccagttgccccaaatgcattagggctactcccctatagctagttgaaaacagaactaacccctgaaaacacaaccaaggtcggcttttccttgaagaaaacataaattggcaggaaaattttgtgcaagcaaaagatttcacatacctattgcgaagtagacattacttgtggattatctactgttcagttacttatttatgcaaaaaaaaatgccagtacattagtgaattaaagtaagcacctgctctggttttactgaaagtagagcaaggagggaagatcccactgagagtatacattctttgggtcaaaatgattaagaatttcaatactataaaatttgggagatcccgtagtatagtcttaatttgaattctggggtctccaaccttggagattaaaaaaaaagtatttcgaggtaatttgactctctgctctgactcaaggagaatacctttcttgccattaaaaaggaagtcacagatgtttcttttcaagaaatcaatgggc

SEQ ID NO: 94819 - DNA, 601 bp, Human
tctgaaactattccatgctcgtaaccattatgcaagtatcctgacaaccacattcagaaactgcaggtttatagacaccggatgcaaattcagcaagtggtacatcagcagaaaaaaagttatcctgtttataactaggttaaaccaacagaaaaagtgtgggtcctgcagaaagaaggggcagtgttgtaaataattatcagggtcacactgtcagtcacatttgggtctcaacttgtgcaatatcccctagcctgatatggcaagttttgataacagtaccgttttcttctgaccatgrttacaaaaatcttttcagttaaaccactctcaagttattcacttcagccctcactttgataagcgaagattctcactgaattagcaaaaatatagaggcaaccctgattttatttcattaaatgaaaaaaagttattgatgcatacaaggtactacgtgagaagcaaagtcacggtcactgccgggagggaggtggcacattagtcatttctcctggcctggcctctccagttgccccaaatgcattagggctactcccctatagctagttgaaaacagaactaacccctgaaaacacaa

SEQ ID NO: 94820 - DNA, 601 bp, Human
aggggaatggttctgcctggggacagcttcatccatcccaggctgtcaggcagatgcaaacagcatattgagacaggaaaacataaaagagaccagtgatgagtgttcctaaggtatgttcttgagaaaaaaatgtctaggaagttgtgggttatgcaggtttcttggtcacagaacttcttaagccttcatatataatgaaacgctcaaaaagaagagaccttttctaggaaatctttctgtgggtacatgctggcagagctaaacttttaacctgcttcagcttagggcacactggatgaggactcccgcccctaagtccatgggccatgccccttctgttggctagcagcggcaagcagcccctttccacctaaggaaataaagccactcgggttgtcacagtgtatctttggaactatgagtgaagcaaaggtaatataaaaagtcccccctccaccctacattcctcccacccaccgtaccttctctgggggcaggataatccgacaggccatgtcccaagtcagggagaacatgacaggcatgaagtgggacacaaagggcttgtggcggccaccttcctccttgctgaggatgt

SEQ ID NO: 94821 - DNA, 601 bp, Human
tcccagaagatccccgcagccccttgggggctcccaccggacgccatcttcccggcgggattctgatggtggtaagtgtggggaagggttcaggcggcgggggctgggaagaagataggcctggcctgagctgacttagtctccctctcaccctctctttgaagccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcrgatgaggatgaggacgactatcacaacccaggctacctgtgagtggccaggtgggaggtgggaggtgagggctgaggctgtgcgtccccccttgctcaccggcccttttcacttcctttcagggtggtgcttcctgacagcaccccggccactagcactgctgccccatcagctcctgcactcagcacccctggcatccgagacagtgccttctccagtgagtcaggcatttgtttttatttttaaatttttttagggataggctggagtgcagtggtgccattgtagctcgctgcagcc

SEQ ID NO: 94822 - DNA, 601 bp, Human
cttcctgaaagcagatgagtaaatggcagatatgaatagacatgggttggatgagggaagaccaggaacaagccccttggaatgagcttagagaaactcccctggcacaggccggtgagctgtttgcttagacttagttgctgcatgtgtccctaccatctggctttgcagagctaaattgggagttgtcagcctggatttggccttgggcaggagcctggcatgggtggggtaaaagtggcagtaaaagtcacgggagggccttagcataagcccttctgtaccctgacctctgcaccgyactctgtcctttaccttgttagggtgtgcctggatggacaggggtgtttcaactgagagcactttgaagaggaagggcaggttgccattaaaggtgtccttgacctttgagcccaagctgtcctggttctcagcaatccactggcttagggtcttctgtgagatgcggttgtcaaggatcttggcatcccctcgggggtgagtccccatccacaactggaaagacaggaaacttgggaggggaagggggaagaaacctgccaccctgagttggcctgtcccaatccgttatgctgtgctc

SEQ ID NO: 94823 - DNA, 601 bp, Human
ggagggcagctgcagggctagggaaaatctcagaatgcctaggtggaaggcatcctaagagtcctctatgccagtctgcctccaaccatctggagaagatgaccagttgggaagcagcactcaactaagaagggccctgctccacaaagactaggcaagcaatgctaagttgccaacaggtcatctaagtggggccccttttagtgttccacttgggcaagggggttgagaactgtccccagagtctggtgtctgctgggaagcccaggccagagcattgcacccaaccaggaatataacygtgtccaccttgctgggagatccgcttcaccaacaggttgagctgttccaccaccaccttcttctcactcttcatcaggtgggagaaacagctctgcagagaggaggccacagcctgggagtcatggctcatggtctgcttcaggtgtgttgctgcctcatctccaatcaggaactgaaactcaggcacctctacaggaaggcaaggcccagggcccatatcaggaatggtaagatggaacccacacaagtggggagttggaggacacctttccatcccagccctaaccaaagagccggc

SEQ ID NO: 94824 - DNA, 601 bp, Human
cacacacacacacacacacacacacacaccagaaaaaaatatgcttgggtcaaataaataatgccctaaggctcaaaggtaatgggaaacctgtagaggtaaaataaaaagagagctctgggccacctagagaaggggttgtggctgccaggctaagaagctgagacctcatcgcctgcaccacataagctcattgctgggagtctgttctgttttgggtttcttactgcttgtgttgactccccacctttagggtgacagtgaccacacccatcacagtcatttcctgaactcttcttarcacaaggttgggcacacagaaggtaaaggaaagatcaaatgactgagtgctggaggcatcagtcctttccaggagagggaggatgctcgtgtccccttcctgcctctttagccccgagatacaagtccatccatggagggcagctgcagggctagggaaaatctcagaatgcctaggtggaaggcatcctaagagtcctctatgccagtctgcctccaaccatctggagaagatgaccagttgggaagcagcactcaactaagaagggccctgctccacaaagactaggcaagcaatgct

SEQ ID NO: 94825 - DNA, 601 bp, Human
atggttgccctggcaaagggtagaagagcagaggatggctctgtcattgattatgaactgattgaccaagatgcccaggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggtccagcgcattcagaacaagcccttgtattttsctgatcagctgtacgactccatgaagggcaaggggacgcgagataaggtcctgatcagaatcatggtctcccgcagtgaagtggacatgttgaaaattaggtctgaattcaagagaaagtacggcaagtccctgtactattacatccagcaagacactaagggcgactaccagaaagcgctgctgtacctgtgtggtggagacgactgaagcccgacacagcctgagcgtccagaaatggtgctcaccatgcttccagctaacaggtctactaaacatacaaaagtttagccgggcgtgg

SEQ ID NO: 94826 - DNA, 601 bp, Human
ggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggtccagcgcattcagaacaagcccttgtattttgctgatcagctgtacgactccatgaagggcaaggggacgcgagataaggtcctgatcagaatcatggtctcccgcagtgaagtggacatgttgaaaattaggtytgaattcaagagaaagtacggcaagtccctgtactattacatccagcaagacactaagggcgactaccagaaagcgctgctgtacctgtgtggtggagacgactgaagcccgacacagcctgagcgtccagaaatggtgctcaccatgcttccagctaacaggtctactaaacatacaaaagtttagccgggcgtggtggcgctcgcctgtagtcccagctagtccggaggctgaggcaggagaatggcttgaacccggaaggcagagccgagatcatgccactgcactccagcctgggc

SEQ ID NO: 94827 - DNA, 601 bp, Human
tcagaacaagcccttgtattttgctgatcagctgtacgactccatgaagggcaaggggacgcgagataaggtcctgatcagaatcatggtctcccgcagtgaagtggacatgttgaaaattaggtctgaattcaagagaaagtacggcaagtccctgtactattacatccagcaagacactaagggcgactaccagaaagcgctgctgtacctgtgtggtggagacgactgaagcccgacacagcctgagcgtccagaaatggtgctcaccatgcttccagctaacaggtctactaaacayacaaaagtttagccgggcgtggtggcgctcgcctgtagtcccagctagtccggaggctgaggcaggagaatggcttgaacccggaaggcagagccgagatcatgccactgcactccagcctgggcaacagagctagactctgtctctaaataaataaataaatgtaaggggcgcggtggctcacgcctgtaatcccagcactttgggaggccgaggtgggcggatcacctgaggtcaggagttcaagaccagcctggccaacatggtgaaaccccgtctctaccaaaaacacaaaaaatt

SEQ ID NO: 94828 - DNA, 601 bp, Human
agaatggcgtgaacccgggaggcggggcttgcagtgagccgagatcgcgacgctgcactccagcctgggtgacagagcgagactctgtctcaaaaaaaccccaaaaaacaaaaccaaaaaacccccccaaaacacaaaactatacaatcaccacctggtgccttgactaatgagtgatgacctgctctttgaaaaacagaacacaattaccttattcaatgataagctggctgttgtgaatgcgcctcttaggtcagtaagacctcaggttggggtgaacttggatgaggcatcatcctamactttagtttccacctctgtaagataggagtacccactgacctagcagtgaggttccagaagctataaaagatgagattcaaagtgcctggcacataattgatactcaacaaatgggattctcttccctgggggcaaaatatgcttcgcatagtggggggggcaggtatagacaaaatctaccccccatctggtttatagacccccttcaggccatttagagtttcattgcacacaggtctcagagatttcctccccaggcttgccttcctgccctcccccacccaagtccccctggctc

SEQ ID NO: 94829 - DNA, 601 bp, Human
gctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggtgggtttgaagctgggcctttcttccatccttccctaacctcccagggctgaagactcttttattctgtattctctgaccgtggtaacacttggtgcaccctcaccatggccctgggtgtgggatcatggatcccagggttccaagaggaatcagtgaygacccagtctgtcccccagtgctagttactaggcctgcacctgaaaactaagcccctttagcctgaagggtggggaagtgacctgggccaggcccagtggggtctgggccctgacatgcccatctctgctgtatctttacaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccag

SEQ ID NO: 94830 - DNA, 601 bp, Human
ctcccagacagacctgaagctggtggcccacccccgcgccaagagcaaggtgtggaagtatttcggcttcgacaccaacgccgagggatgcatcctgcagtggaagaaaatctactgccgcatctgcatggcccagatcgcctactccggaaacacctccaacctgtcctaccacctggagaagaaccaccccgaggaattctgcgagttcgtcaagagcaacacggagcagatgcgtgaagccttcgccaccgccttctccaagctgaagcccgagtcgtcccagcagcccgggcaggaygcgctggccgtcaaggccggccacggctacgacagcaagaagcagcaggagctgacggccgccgtgctgggcctcatctgcgaggggctgtacccagcctccatcgtggacgagcccaccttcaaggtgctgctgaagacggccgacccccggtatgagctgcccagccggaagtacatctctaccaaggccatccctgagaagtacggggccgtccgggaggtgatcctgaaggagctggccgaggccacctggtgtggcatctccaccgacatgtggaggagtgagaatcagaaccgc

SEQ ID NO: 94831 - DNA, 601 bp, Human
agggcaaatcaaaggacgctggtggccatcatgtcatacctcttcgtgtcaagtggggaaatcacagttctgctcaaggtgccaggggccaggctaggttaacttccttgctgacatccagccttggctccttgagtcagagtaccccgtcaccctccctacctgtgatgacacagatgcctcctaggggtaagcacagggttccatggacatcacttccccagaataagggcaccagcggagaactgttcttaaagtacctggctgctgatagtgagggcagatggcttccagctcagtrtcactacagcagggggtaccacaggctgcagatccagggtgggtcacagcaggagcatctctcacacgggcctgggctgcaggggtccagggggatggtcctggaactgagagctccatctctgcctcctcacggcgagttctgaggctgggcatgacaaggacctgaaaaccggcaagaacacaggtgagtctacagacaggctagctctagggattcatcctcccatcaggccggggtctcttcctccacccctgcagcccaagacctgaagagggcctggtgctgccaggtctcagg

SEQ ID NO: 94832 - DNA, 601 bp, Human
tccccacaagaaactcctcagcttttcttcctaggctttagatggccaactgtatgggtaaccacagtacaaagccctggaccagagtagagtcctgaggggagagggctgccaccagcctggttgttgaattgggaaggggtcaggagtatagggcaaatcaaaggacgctggtggccatcatgtcatacctcttcgtgtcaagtggggaaatcacagttctgctcaaggtgccaggggccaggctaggttaacttccttgctgacatccagccttggctccttgagtcagagtaccccrtcaccctccctacctgtgatgacacagatgcctcctaggggtaagcacagggttccatggacatcacttccccagaataagggcaccagcggagaactgttcttaaagtacctggctgctgatagtgagggcagatggcttccagctcagtatcactacagcagggggtaccacaggctgcagatccagggtgggtcacagcaggagcatctctcacacgggcctgggctgcaggggtccagggggatggtcctggaactgagagctccatctctgcctcctcacggcgagttctgaggc

SEQ ID NO: 94833 - DNA, 601 bp, Human
tcactccagttgcccaggctagagtgcagtggcatgatcttagctcactgcaacccttgcctaccaggttcaagcaattcttgtgcttcagccttccaagtaggtggaattacaggtatgtgccaccacacctggctaatttttgtacttttagtagagacagggttttaccatgttagccatgcttgtctcgaactcctggcctcaagcaatccacccacctcggcctcccaaagtgctgggattacaggcgagagtgatcacacccagcctttcttaattttttagtagagatagggtyttgccatgttatactggctggtcctgaactcctggcctcatacaatcctcctgccttggcctctcaaagtgctcagattataggtatgagccaccacacccgggccaagggtgcttttgaatgcctctatttccccacaagaaactcctcagcttttcttcctaggctttagatggccaactgtatgggtaaccacagtacaaagccctggaccagagtagagtcctgaggggagagggctgccaccagcctggttgttgaattgggaaggggtcaggagtatagggcaaatcaaaggac

SEQ ID NO: 94834 - DNA, 601 bp, Human
agtcactgaagtctttttctttagcttgtgttcaaccagtgttttgacagagattttatcaagagaaaaaccaacacaaaacacttctcccagtctttgtggattgactctgtgttggggtactttttaaacgctgtttacaactctttctgagttgactgccttcactgagcctagagattagacagagttcttgagaaagcttatggtcttaacaggtcttttctgagcacacacccagtcctgcgcatgcatgtgacttcctggattccccaaaatatataggtgcttttttttttttcaaatttatgtatttttttctgagacagagcctcactccagttgcccaggctagagtgcagtggcatgatcttagctcactgcaacccttgcctaccaggttcaagcaattcttgtgcttcagccttccaagtaggtggaattacaggtatgtgccaccacacctggctaatttttgtacttttagtagagacagggttttaccatgttagccatgcttgtctcgaactcctggcctcaagcaatccacccacctcggcctcccaaagtgctgggattacaggcgagagtgatcacaccc

SEQ ID NO: 94835 - DNA, 601 bp, Human
agttgagatggggtttcaccttgttagccaggatggtcttgatctcctgacctcgtgatccacctgcctcagcctcccaaagtgctgggatgacaggcatgagccaccgtggtgctgggttacaggcgtgagccaccgtggtgctgggttacaggcgtgagccaccgtggtgctgggttacaggcgtgagccaccgtggtgctgggttacaggtgtgagccaccgtggtgctgggttacaggtgtgagccaccatgcccagcctagttctctatggtttctttcacctctctgagcatatytgaggcagttgatttgaagtttttgtctacttaagtccaatgtctgtgctttctccaggacactttttgtcagtttacttttttcctttgaatgggacatatttttttgcttcgttatatgcttcatgatttttgctttgttaaaaactgcacaactgaatattaaaatgtggtatcccccctccaggctttgctgtttttgattgttgaagactagagtcacatgttcatttagtgacttttccaaactatttttgcaaagactattctttgtcgagtacagtcactgaagtctttttc

SEQ ID NO: 94836 - DNA, 601 bp, Human
tgcaagctccgcctcctgggttcatgccattctcttgcctcagtcttcagagtagctgggactacaggtgcctgccaccatgcccagctaattttttgtatttttagttgagatggggtttcaccttgttagccaggatggtcttgatctcctgacctcgtgatccacctgcctcagcctcccaaagtgctgggatgacaggcatgagccaccgtggtgctgggttacaggcgtgagccaccgtggtgctgggttacaggcgtgagccaccgtggtgctgggttacaggcgtgagccaccrtggtgctgggttacaggtgtgagccaccgtggtgctgggttacaggtgtgagccaccatgcccagcctagttctctatggtttctttcacctctctgagcatatttgaggcagttgatttgaagtttttgtctacttaagtccaatgtctgtgctttctccaggacactttttgtcagtttacttttttcctttgaatgggacatatttttttgcttcgttatatgcttcatgatttttgctttgttaaaaactgcacaactgaatattaaaatgtggtatcccccctccaggctttgct

SEQ ID NO: 94837 - DNA, 601 bp, Human
cactgccttctgacctccatgggttctgatgaaaaactggctagaaatcttacccagaaccccttgttcagggataggtctcctctcttgctgctttcaagattccttgtatttcaacaatttgattagaaagagacctggtgtggatctctttaaatagactctactcagtttgttgaactgcttgtgtgtgtagacatgtctttcatcacattggggatactctcagccattatttcttcaaatattttttccatccccttctctattcttttccttcttgaacatccctactatgcaygttggtctacttgatggtgtctcatggtccattaagttcacttttcttttttcttttttttttgagacagagtctcactccattacccaggctggagtacagtggcacgatttcggctcaatgcaacctccgcctcctgggttcaagcgattctcctgcctcagcctccagagtagctgggactacaggcatgcatcaccacgcctagctgatttttgtagttttagtagagacagggtttcaccacgttggccaagattctctcgatctcctgacctcaagtgatctgcttgcctcggc

SEQ ID NO: 94838 - DNA, 601 bp, Human
catgcccagctaatttttgtatttttagtagagacagggtttcaccatgttggccaggctggtctcgaactcctgacctcaggtgatctgcctgccttggcctcccaaagtgctgggattacaggtgtgagccactgcgtcaagcccatttttaagatattttcttactgattaccatgatgattgcaatgaacgttctaacatcctaaaacaactgataccagtttagtctcagtaacacaaaatctctgcttctctacagatgttaccccccttatgttgttgtcatcacagattacayctttatacatagtggggtaaaaaacatagacttataatgcagaccttttatgcatttgttctttagatcacttaggaaatatgtaatggcaaaaaccacaattaattttgcaccaacttaatacaaagtgtacttagaaaccaaaatatagggatactaacttttatacttacctatgtagttacttttactggaggtctttatttttgtatggctttgagtccctgtctagtgttctttcatttcaaccttcaggactccctttaaaagcattccttgtggggcagtctatttgtaaca

SEQ ID NO: 94839 - DNA, 601 bp, Human
tgcccacctcagcccccaaagtgctgggattacaggcgtgagccaccgcgcctggcctcttgtgtccatttttaagatttttttttttttttttttgagagggagtctcgctctgtctcccaggctggagtgcagtggcgcgatcttggctcattgcaagctccgtctcccgggttcacgccattctcctgcctcagcctcccaagtagctgggactacaggtgcccaccaccttgcctggctaatttttttgtatttttagtagagacggggtttcactgtgttagccgggatggtctcratctcctgaccttgtgatctgcccgcctcggcctcccaaagtgctgggattacaggcatgagccaccatgcctggcccatttttaagatttttttttgaagtggagttttgctctgtcacccaggctggaatgcagtggcacaatctcatgcctctgcctgagttcaacctctgcctcctgggttcaagcaattctcctgcttcagcctcctgagtagctgggattacaggtgcccaccaccatgcccagctaatttttgtatttttagtagagacagggtttcaccatgttggccaggc

SEQ ID NO: 94840 - DNA, 601 bp, Human
aatcttttacctttttgttcctcagttcctctactgctgtattcttaggtattaccttttttgtagtgtaccattttaattcttgccttacttcttgtgtccatttttttttttttgagacagtctcgctgtcacccaggctggagtgcagtggcatggtctcagcttactgcaacctctgcctcccaggttcaagggattctcctgcctcagcctcccaagtagctgggactacaggcgggtgccatcgtgcccggctaattttttgtatttttagtagagatggggtttcactgtgttrgccaggatggtctcaatctcctgacctcatgatctgcccacctcagcccccaaagtgctgggattacaggcgtgagccaccgcgcctggcctcttgtgtccatttttaagatttttttttttttttttttgagagggagtctcgctctgtctcccaggctggagtgcagtggcgcgatcttggctcattgcaagctccgtctcccgggttcacgccattctcctgcctcagcctcccaagtagctgggactacaggtgcccaccaccttgcctggctaatttttttgtatttttagtaga

SEQ ID NO: 94841 - DNA, 601 bp, Human
tccagtttccccgctgttgctggtcagagaagatactttgtgtaattccaatctttttaaatttattgagacttgttttgtggtctaacatatggtttgtgttacatgtacacttgagaagaatgtatatcttcttttctgaatggagtattttatatacttctgtcttagcccatttgggctactgtaacaagatacattagactgggtaatttataaacaacagaaatttattgctcacagttctggaggctgggaagttcaagatcaaggtgccagtggattcactgcctgatgagarctggttcctcctaggtattcccttctatgtgtattcacatggtagaagggcaagaaaagaagctaacaagctccctcaggcctcttataaggagataatcccattcacagggctctgctctcatggcccagtcacctcccaaaggccccacctcttaataacgacacactgcagattagatttcaagatatgactggagaggggaggggttgggggggacatttagaccacagtgatggtcgtccattaggtctagttgggttgtaacgctgttcaaatcccctagttccttagtgatct

SEQ ID NO: 94842 - DNA, 601 bp, Human
ttacaacactaggttttcttatgttgaaccacccttatatcctgggttaaatcccacttggtcatatgctattggattcagttttctatttctttgttgggagttttatatctctagccataaaggatattggtttgtaattttcttttcttgtcttcaagccatatctttatctggctttggaatcagtgtaaagttgaccttgtagaattagaaagtgttctctcctcctttgcaagagtttgcgaaggtttggtattaattcattaaattcacctttaaatccattgtgggccaggcrcggttgctcagtctgtaatcctagcactctgggaggccgaggcgggtggattgcctgagctcaggagtttgagaccagcctggggaacacggtctctactaaaaatacaaaaaattagctgggcatagtggcacgtgcctgtagtcccagctactcaggaggctgagacaggagaattgcttgaacccaggaggcagaggtcacagtgaactcagattgtgccactgcactccagcctgaggaacagagcgagactccgtctcaaaaaaaaaaaaaaaaaaaaaaaaaagccattgtggt

SEQ ID NO: 94843 - DNA, 601 bp, Human
catttcccaactggatgtcttttatttctttttcttgactaactgctctggttagaacttgcaatacaaggctgcagagtggcatgtttgtcttgttactgaccttaggggaagagttttgttcttcactactgtgtatgatgtcagcttgagggttttcacaaatgccctttatcatgttcaggaggtcctcttctattacaagttttatgaatgctttttttttttaactgtgaaagtgttagattttgccaaatgttttatttgcataaattgagatgatcatagtttttctccttcrttctattaatgtgatgaattacaacactaggttttcttatgttgaaccacccttatatcctgggttaaatcccacttggtcatatgctattggattcagttttctatttctttgttgggagttttatatctctagccataaaggatattggtttgtaattttcttttcttgtcttcaagccatatctttatctggctttggaatcagtgtaaagttgaccttgtagaattagaaagtgttctctcctcctttgcaagagtttgcgaaggtttggtattaattcattaaattcacctttaa

SEQ ID NO: 94844 - DNA, 601 bp, Human
taatagcttttttgtggattctctgggatttcatatatacggattcacatcttatggaaaaagaattttacttcatttcccaactggatgtcttttatttctttttcttgactaactgctctggttagaacttgcaatacaaggctgcagagtggcatgtttgtcttgttactgaccttaggggaagagttttgttcttcactactgtgtatgatgtcagcttgagggttttcacaaatgccctttatcatgttcaggaggtcctcttctattacaagttttatgaatgctttttttttttaactgtgaaagtgttagattttgccaaatgttttatttgcataaattgagatgatcatagtttttctccttcgttctattaatgtgatgaattacaacactaggttttcttatgttgaaccacccttatatcctgggttaaatcccacttggtcatatgctattggattcagttttctatttctttgttgggagttttatatctctagccataaaggatattggtttgtaattttcttttcttgtcttcaagccatatctttatctggctttggaatcagtgtaaagttgaccttgtaga

SEQ ID NO: 94845 - DNA, 601 bp, Human
agttgctgcaactttgctgggtttgtttattacctctaatagcttttttgtggattctctgggatttcatatatacggattcacatcttatggaaaaagaattttacttcatttcccaactggatgtcttttatttctttttcttgactaactgctctggttagaacttgcaatacaaggctgcagagtggcatgtttgtcttgttactgaccttaggggaagagttttgttcttcactactgtgtatgatgtcagcttgagggttttcacaaatgccctttatcatgttcaggaggtccycttctattacaagttttatgaatgctttttttttttaactgtgaaagtgttagattttgccaaatgttttatttgcataaattgagatgatcatagtttttctccttcgttctattaatgtgatgaattacaacactaggttttcttatgttgaaccacccttatatcctgggttaaatcccacttggtcatatgctattggattcagttttctatttctttgttgggagttttatatctctagccataaaggatattggtttgtaattttcttttcttgtcttcaagccatatctttat

SEQ ID NO: 94846 - DNA, 601 bp, Human
ctctttgtaacttcatatgaatttgaggatcgtcttttgtttctgcaaaaaatggccattgtaattttgataggaatggcattgaatctgtagaacactctaggtagtttggatgattaatattgtcttccaattcatgaacacatgatgccttctatttatttgtgatttctttaattcctttccacaatattttgcagttttcagtggacaagtcttaaatctccttggtcaaatttagtcctaggttttaattttccctattgatgctattgtatatggaattccttccttaatttcyttttcacactgttcatggctggtatacagaaacaactgattttgtgtgttgatcagttgctgcaactttgctgggtttgtttattacctctaatagcttttttgtggattctctgggatttcatatatacggattcacatcttatggaaaaagaattttacttcatttcccaactggatgtcttttatttctttttcttgactaactgctctggttagaacttgcaatacaaggctgcagagtggcatgtttgtcttgttactgaccttaggggaagagttttgttcttcactactgtgt

SEQ ID NO: 94847 - DNA, 601 bp, Human
tctaggaatccactgccaaatccaagattgggaagatttacccctacactttcttctaagaattttagagttgttagctcttatatttagcttgttgatctatttggagttaatttttgtatatggcataaggtaggggttcaccttcactcattttttgggacagggtcttgctttgctattcaagctggagtgcagtggtgatcacagctgactgtagccttgagctgttgggctcaagtgatcctcctgcctcagcacccctggagtaggcaccaacacaactggctattttttttttgtatttttttgtagagacagagtcttgctatgttgcccatgctggtctcaaactcctggcctcaagcgatcctctcaccttggactcccaaagtgctgggattacaggcatgagccaccacatccggccccaacttcattcttttacatttggatatctacttgtctcagcaccatttgcagaagggctatcttttctcattgattgaaaggacttggtacccttgttgaaaatccacctgccacatatgtatgcgtttatttctggactctcaatctgattccactagtctgtatgtct

SEQ ID NO: 94848 - DNA, 601 bp, Human
tggtgccatatctaggaatccactgccaaatccaagattgggaagatttacccctacactttcttctaagaattttagagttgttagctcttatatttagcttgttgatctatttggagttaatttttgtatatggcataaggtaggggttcaccttcactcattttttgggacagggtcttgctttgctattcaagctggagtgcagtggtgatcacagctgactgtagccttgagctgttgggctcaagtgatcctcctgcctcagcacccctggagtaggcaccaacacaactggctattttttttttgtatttttttgtagagacagagtcttgctatgttgcccatgctggtctcaaactcctggcctcaagcgatcctctcaccttggactcccaaagtgctgggattacaggcatgagccaccacatccggccccaacttcattcttttacatttggatatctacttgtctcagcaccatttgcagaagggctatcttttctcattgattgaaaggacttggtacccttgttgaaaatccacctgccacatatgtatgcgtttatttctggactctcaatctgattccactagt

SEQ ID NO: 94849 - DNA, 601 bp, Human
catgctttggtgccatatctaggaatccactgccaaatccaagattgggaagatttacccctacactttcttctaagaattttagagttgttagctcttatatttagcttgttgatctatttggagttaatttttgtatatggcataaggtaggggttcaccttcactcattttttgggacagggtcttgctttgctattcaagctggagtgcagtggtgatcacagctgactgtagccttgagctgttgggctcaagtgatcctcctgcctcagcacccctggagtaggcaccaacacamctggctattttttttttgtatttttttgtagagacagagtcttgctatgttgcccatgctggtctcaaactcctggcctcaagcgatcctctcaccttggactcccaaagtgctgggattacaggcatgagccaccacatccggccccaacttcattcttttacatttggatatctacttgtctcagcaccatttgcagaagggctatcttttctcattgattgaaaggacttggtacccttgttgaaaatccacctgccacatatgtatgcgtttatttctggactctcaatctgattc

SEQ ID NO: 94850 - DNA, 601 bp, Human
acagcggcatttagtacatctataatgttatgcaaccaccacctctattttcaaaacattcccatcactccaaagtaaaacctcttacccattaagcagtttatccccatcttcctctccctccaggccctggcaaccactaatctgtattctgtgtctacgaatttacctattctggatattttgtacaaatggaattatatagtatgtgaccttttgtgtctggcttctttcactcggcacatctcagaggtttatccgcgtgtagcaggtacagtgcttccttttcatggctaaattrtattcatttgtatgtagacaccacaattaatcattcatccattgacagacatctgggctgtttgtaccttttggctatcatgaatactactgctgtgaacatgatatgcatgtacttgtttgagtatgtgtcttcaattatcttgagtatatatctaggagtagtactatgttcaaacttttgaggaaccaccaaattatttttcagagtagttatgccattttacattccagccagcgatgtatgaggataccagtttctccacatcctcttttatcttttgtttttttgattatagac

SEQ ID NO: 94851 - DNA, 601 bp, Human
acgacctccctcagagcctcggctgggctgtgtgttggacaaaccccagaggcatctcacactcagatggggtgctccttacttcttcatctcctacagcaagttgttttcatttgatttaaacatttactgaggtgaaattaacataacataaaatcattctaaaacgaacagcggcatttagtacatctataatgttatgcaaccaccacctctattttcaaaacattcccatcactccaaagtaaaacctcttacccattaagcagtttatccccatcttcctctccctccaggcccwggcaaccactaatctgtattctgtgtctacgaatttacctattctggatattttgtacaaatggaattatatagtatgtgaccttttgtgtctggcttctttcactcggcacatctcagaggtttatccgcgtgtagcaggtacagtgcttccttttcatggctaaattatattcatttgtatgtagacaccacaattaatcattcatccattgacagacatctgggctgtttgtaccttttggctatcatgaatactactgctgtgaacatgatatgcatgtacttgtttgagtatgtg

SEQ ID NO: 94852 - DNA, 601 bp, Human
gagttcctctacagaaaggaaatataaaataaaaaattttattttcctttaagaaaaatttttttttggagacagagtttggctcttatagcccaggctcgagtgcaacggtgccatctcagctcaccacaacctctgcctcctgggttcaagtgattctcctacctcagcctcccgagtagctgggattacagggatgtgccaccatgccctgctaaattttgttgtatttttagtagagacagggtttctctgtgttggtcaggctggtctcgaactcctgacctcaggtgatctaccygcctcggcctcccagactgctgggattacaggtgtgagccaccatgcccggccaaagaacatctttttaaaaagtcagtaaaatttgggcttaaaggtgaagaaaaagatttgaaagcaaatacagttgcttgcactgtactctgacacccaattggaaaaaaggacaaggactctgagcccttccagaacaaaacacaccttctgtgaagaggaaacacatctttatgattaaagacttttacgatgagtgacctccaggtttgtggaacagcttggataattacccaagtcataaacc

SEQ ID NO: 94853 - DNA, 601 bp, Human
agctggatttggtgacctctggctgagatgagatgtcactggtgtggatgaagagatggcgaccatgaggaacgggttgtctagcccgagccactgtttagatagatcaaagtcttttattgagacaggaactaaaggtgaattctgtacgtgagaagggtgagagatcactttttggactgattaaattcaatgtaattcttctctgtaatataagaattgtggggaaaaaatgagttcctctacagaaaggaaatataaaataaaaaattttattttcctttaagaaaaatttttttttggagacagagtttggctcttatagcccaggctcgagtgcaacggtgccatctcagctcaccacaacctctgcctcctgggttcaagtgattctcctacctcagcctcccgagtagctgggattacagggatgtgccaccatgccctgctaaattttgttgtatttttagtagagacagggtttctctgtgttggtcaggctggtctcgaactcctgacctcaggtgatctacccgcctcggcctcccagactgctgggattacaggtgtgagccaccatgcccggccaaagaacatcttt

SEQ ID NO: 94854 - DNA, 601 bp, Human
ctcaaaaggcttctctcctgtgtgagtcctgtggtgtttgatgaggtttgagcttcgcctgaaggccttcccacactcactgcacacatacggtttctccccagaatggattctttgatgttggatgaggtttgagctccgcctaaaagccttcccacattcattgcattcatagggcttctcactcatgtgagacttttggtgctttttaaggctcgagttctggctgaaggcttttccacattcattacacatataaggcctctcactgctgtggtgactctgatgcctagaaaagtcygagtgccctcggaaggctttcccacattcgctgcactggtaagctttctcactcatatgagatcgatgacggtttttaagaactgagttctggctgaaggttttcccacaatcatcacacataaaggaagcctccccagtgtggactatttgacgctgaataaggtcaggatttccttggaaggttttcccacactcattacatatgagtggactttcagctgtgggaaccccctcatgaccagttaggtccacactgtgctggaaactctggccacccatgtcatatggatgtggcctc

SEQ ID NO: 94855 - DNA, 601 bp, Human
gagaagggagcctgtaaaggatgtttcaaaggagggtcccaggctatgtggccactggatgtaggcagtgagctgagtccaggctttcggtctgggaagtggcagaggctgagacaatggccaaagaggagttggagaggaaactatgctcggtttcactcctgccagcccaacagcctattccctggtgtgaatcaactggtgtttgatcaactttgatcgctggctgaaggctttcccacaagcagcacagtcatagggcttcaccccagtgtgaatcctctggtgctggatgaggacmgaacgctgactgaaggctttcccacactcactgcatttgtaggggcgctcgcccgtgtggattatctgatgctgaatgaggtgtgagctctggctgaagcccttaccacattcaacacaggtgtagggtttttccccagtatgaactttctggtggtgaatgagatttgagcttcggttgaaggctttaccacactggttacattcatggggcttcagcccattatgaatcctctgatgctgaatgagggttgagctctggctgaaggtttttccacattcagtacattcatagggcttc

SEQ ID NO: 94856 - DNA, 601 bp, Human
gcccacacagtgcacagagttgctccactgcacaccactgcttcctcccagcacccctgccacagtgcgcggagcccggcagacatgctgggtaaaatctggcgggcccatgtacccactggacaggctggaggggaggagggggcagaggctgggccaggggagcacagtctggaatggggctggggcctggtcagggcaaggtcaaagtccactgacacaaagccacattccttttcccagaggtgactcggacacagaagacaaggccctgcttgctctcctgggaagggctaatcaratagaggcgcttgcttcctggattccatccggcaggcacgtgaaagggtcagaggtagcaaattatcagtaacggtcgtcttcctttcacttgttgacaacccgaaacttttcttaaaacaatgccctctgactggccagggaagaccgatcgcattctagccccgcggaggaggacccgggagcccgcgggcttcaccgcgggtcccggacaggcaggtcgcacccgatgcccacctacagggacgctcgcccggaggccaggggaacccctggaccggagccgggcaagctggttgct

SEQ ID NO: 94857 - DNA, 601 bp, Human
agcacccagctgtagccacacaagagggccggtgggggcaggctgtctctctaccctggcccttagcccactagtgctggccaactgggtggctctcttccctgcgagggtctcaggcaaaggcagagattccttctgacgagcaggtgctcagcccctgaaggcttgggagcctcgctggcagtggtggggagcaggtgccccttctctttagctgggacaggaaatgcaagatgggaaaggcattaggccatcctcagctggggctgggctgggtgagcctacagtgccctcccctacwgctgtgccctggcaaggtggccccaggcctgcaggctttcagtcaacagtcgcaacccacaggagggctggggggccgcgggtgggcgaggccatctgtgcttaccatcggtgtgcacgcctacgatgaggtagtcacccatggcccgtgcctggcgcagctggttggagtggccgtaatgcaccatgtcatagctgtggagacagagagagtgggtggtccctgtgccaagggtggggaccaggtgtccctgtgggttaggggcagagctttgctcctctgaggactccttaggaagcg

SEQ ID NO: 94858 - DNA, 601 bp, Human
gaacagagggaacgaggtgagcccatgcggagcctcaccttgaagtgacttaggagctctgctgtgaccgcgtacggggctccaatcaccacttctgacacgtactgtggggacagtgggggcagaaagacttgctcggtccctgctactggtaagccagggccacagggtggtgagagacggctcagacatggggcggggctgccagtgagtagcagggatgggctgggcaggctggggacccctggggctcctccatgagacaagaaggaacagcatctggagacctgaccacccctcytcatgcctcaacaaacaggtatgggcaggtgccacagaactcggggtgctgggtgcagctctgccagtgacccaagcccccctgccctggctcagggaggcccttagtaggggggatgttgtgggaatgtctccccatccttgggctggctcctggcccccactcacccggcaggccagcacgctcagagtccgttcatgcagattcatgatggggtagttcttccccttgtagtgattgacctcctgcggccagagtgcggctagctcagcccggagactttttggggggacagggtgt

SEQ ID NO: 94859 - DNA, 601 bp, Human
cccccccggacagtagttccgacagtcacattcaagacgggaacctcaaacactccgatgaaatccactagctgcatgtgcttttagttgccattggaagttccataacaggtcacgtgactgttacataattacatgactggacttttttttttttttttttttttgagagacggagtttagctctttcgcccaggctggaatgcagtggcatgatctcggctcactgcaacctccgccttccagtttcaagtgattctcctgcctcagcctctcgagtagctgggattgcaggtgcccrccaccatgcccgactaatttttgtatttttagtagagacagggtttcaccgtgttggccaggttgttcttgaactactgacctcatgatccgcccacctcggcctcccaaagtgctaggattataggcatgagccaccgcgcccagcatgactggacttttacatgtgacttgtggagggaggagactaaaccccagggctccgggtatttgagtcagtagtgaactccctttttgcattcttgctgctgagcctctgctgttctttgcttggagtgcctcattccaaccttctgtaaat

SEQ ID NO: 94860 - DNA, 601 bp, Human
gggaggtcagtacccggccacagcgaggctgttctgagccccgccgatggctcccaaaaccaggggcagctccgtccccccagagagccttagaaagtaaaacacacaacaggtccaaccaccaggagtcaagagggcctgtggtggggaggggctgtccttcctccagccctgatgcacctggagtggctgggagggcaagaggttgcaccgtcccggcaaggttgggaagtggctcggggtttggcaagggccactctgccccagatccatgctctcttgggtcatgacatttcaggtycctggggacctaggcagatcaaccactacaccccattggttgagggtgttcagcagaaggtccccagagatgtcctataagcctcccctgtgactaggatggcttctgaggtccacagaaaaatgcaagggaatcacaaaggggaaaggccaccagcagctctgaggctgaggctggctgcggatgggatggttcagagggggagctccccttctgtcctggagagtcaagcacaggaggatcaaacccgcggcctaacccgcttggtgggtgctcatcatgggagtcaactggcagaca

SEQ ID NO: 94861 - DNA, 601 bp, Human; identical to SEQ ID NO: 18136

SEQ ID NO: 94862 - DNA, 601 bp, Human
cggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagcycctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcatta

SEQ ID NO: 94863 - DNA, 601 bp, Human
ccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttsttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaatt

SEQ ID NO: 94864 - DNA, 601 bp, Human
gtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgat

SEQ ID NO: 94865 - DNA, 601 bp, Human
ctctccggcccggtgccccggccgctgggcaaggagggaggccggaacgggacctgccacactggggatgccccacccaggcctgggggacctcggcctctcatgacccccatggccgagttgaacagtcgcagttttggtggcggagctgggtcacctactaatggggtgactcttcccccaaagggagcagggactctccgagcatccgcgcagagcggcccgcttgcagtaggggacaggtggccacattgacggctaccgcggtcttccccaggaacatttggcctgcgagacacargacgtccttggatggggggaaagctgtgtcacggctgtggtagctaacacagcgtcctttccagcagtagaacgaataaagtattggagtgatgatgcgttgtcatcctctcccataaaaattgcagagggttgaatactggggagggtggcagaacaaattaggaaacagtcacactacactggttttgccataatctttatttaattccgaagactcgcaaatttcagttctgagactttgcccattacaaacaaatgattgtccttactgtgcttcacagcataatgcgacacggaa

SEQ ID NO: 94866 - DNA, 601 bp, Human; identical to SEQ ID NO: 18132

SEQ ID NO: 94867 - DNA, 601 bp, Human; identical to SEQ ID NO: 18133

SEQ ID NO: 94868 - DNA, 601 bp, Human; identical to SEQ ID NO: 18134

SEQ ID NO: 94869 - DNA, 601 bp, Human; identical to SEQ ID NO: 18135

SEQ ID NO: 94870 - DNA, 601 bp, Human
cctaaaaggaaaattttgttctaaattacaatcactaaaagacttcattgtgtcagaaagcaaagcacaattttttatcaattaaatactaagttgtgggatggggaatggaatcagaaattatcagagaggggataattttgggggaataatctttattaaaagttaaagtatttaatgttattgtattataagaaagtatttagtatgttttctgtatttatgataaaaaattaaattctcaaaaaatttgaaagaattacaactaaagatccttttagtacatctttttctgtggtgttttttttttttttctttcctctgtttttttttttttgagacagtcttgctgttgcccaggctggggtgcaatgacacaatctcggctcactgcaacctccacctcctgggttcaagcgattctcctgcctcagcctccccagtagatgggatcacaggcgcccaccaccatgcccagctatttttttttttttttttttgtatttttagtagagatggggtttcaccacgttggccaggctggtcttgaactcctgacctcaagtgatccacccatctcagcctcccaaagtgctgggat

SEQ ID NO: 94871 - DNA, 601 bp, Human
cacacttctgcaggtccataaagataaggaggcaaaaggtgaagtcaagggctgccaagggtggggatgagtgttggtaaaatcccagactttggactgggactgtgaaaggtcaaatcctggaagtgaggtaaactgaaaataaaccaaccctcacaggaattgaagcccagattcaaatgatctttaacactaattggattaagatgatctgagattgctaatgctagtggcctaacttcctttcagaaataagagtaaatcctttctggaggaagacaacatcatctagagcctcaartaatctctagaatttttcatacgcattatctagttttctatttaaaaaaaccatgcatacaaaacaaaacgtgactgaaaagcaacagaaacaagtgacattagaaacagactcaagaaattcagatattagagtttttagagtttaaaatagccataattaatatgttcaaggaattaattgacaagattgagattgataatcttggcaaagaattggaagtccagtttaaatggacattctaaaactgtattaagaactcaattgatggggttttaccatcagaggagacatagctga

SEQ ID NO: 94872 - DNA, 601 bp, Human
tgtgagctggaagataaatcagaactgggagagagagtaaaatatttagactgaagcacagagaaacaaaagtttagaaaaggcacaaaagaatctaagagaaatatgggaaaaggtgaagaagtttaatatatttgtaattggacttccagaaggaaaggaatgagaaaaaacgaggcagaaataacattagacagataatgggagaaagtttttcaaaactgatgaaagatagcaagctgtagattcaataagcactataatccctaggcaagataaatatacagaagaccatacttaygctgggatatgaagatataaagttttgaagtagctgaggaaaaaagatatataaccttcaaaagagtgaccctaagactttcagctaagttatcagtggaaacaaaggaagtcagaatgcgatggaatgaaacctttaaagtactcaaagaaagtaacttccacatacagttctatatccagtgaaaaaattattaagaaatgaaagtgaaatatactaggagttggtgaggatatagaggtcaccaaaagctatgcagagtagtgtagacttgatacactaggcagctaacccattctc

SEQ ID NO: 94873 - DNA, 601 bp, Human
tcacagaagctagaagataccttagacactcaccctgcaaccccatcccgaaaacgggagactgatgccccaacaggcaggaaacctcccttgcaaacaagatggcagcagcctcggctctcccagaagggccaggccctgcctcagacccattgcacaggtgaggaaaatgaggccagagaggcgcaaacacaggccaaagccagcccacccagggcgctgcatcctgcaggtctctgggcacacttccctgaaagcagggagaaggggcccagccatgagccccagggcctcagcaacrcaagaagaccttcagcaagttcacccgggtgctgttcctcccccagcgcaaccccagggaggaaggccctgctgtggcaggaacgccagcacccccaggattcttacgctgaaatcccagatgaaggggacggcgttaggaggtggggtgtcttaaggtagccattaagtccttttttctcttttttttcttagagacggagtcttgctctactgtccaggctggaatgcagtgatgccatcacagctcactgcagcctcaacctcccgactcaagggatcctcccacctcagcctccag

SEQ ID NO: 94874 - DNA, 601 bp, Human
gctcagagccagctccgtccaggctagacccctgcagtcctcgggctggcatctcatccccatggtccacgttcaggcccacactcctgtcctacccccgaggcttgggtctgggggagagtcgggcgtccaggcaccaagagctaactgtgccaggcagagtgcaaggaaacacccacccagctagggaccccggccagtcactcccccagggctgccggtcagtcacatcctggtgatcccagcagggtctgtgccaggcagtgacactcccagcttcactaccatccatcttctaacmagagacctctgaatgttgaccggaaaggcataaaaactggaaatgggggatgccatgcccatcctgggtggacagactttgggggcccctcccggccagccccaacccctttgacctcagctgaccccatccatgcccactcacaggcacagagtctgaggctctggggcccatctcctcgccaggttgacagccgcctccatccgcagcggcaggaccggtctcttggctgagcctccaaaatgggcctcctgttccctctgacctttgtcccctcagccaaagccccctgggtccaaa

SEQ ID NO: 94875 - DNA, 601 bp, Human; identical to SEQ ID NO: 25411

SEQ ID NO: 94876 - DNA, 601 bp, Human; identical to SEQ ID NO: 25412

SEQ ID NO: 94877 - DNA, 601 bp, Human; identical to SEQ ID NO: 25413

SEQ ID NO: 94878 - DNA, 601 bp, Human; identical to SEQ ID NO: 25414

SEQ ID NO: 94879 - DNA, 601 bp, Human; identical to SEQ ID NO: 25415

SEQ ID NO: 94880 - DNA, 601 bp, Human
gaactaggcaccaggaatatgctgatgggaaggtcaaggctttgggtaggtggggctgaggggtgataaggtgccccgccccccaccttccaatggggaagcaggggagagtctgagggaagttgggcagttagctacagccaagcaaggatgaaagagcacagagcctttctcccagagacactggccctctgaggtcccagaccaggccagcctggaaaaggtggcaatagaggaaaggaggccttgacacagatgcccacagcttttccaggagggtatcatgctcaaggaaaggccytagctcatgccgtatcgatactggctactagggagagagctctgaaatcaagtatgttgatatgatttttctctcccatttagccactagctgctccagggcagggatcatgctcatcttcatattccatatgtctagcatgtagtaggtgtttaacacatatttgctgaattgaattaggggtgtgttggggagagggggataggatgaggaattcacctagacaggagtagagctggcaagtaatgtaaactaggtgatcaaccaggatagggaagaaaagattgagtggaactaaat

SEQ ID NO: 94881 - DNA, 601 bp, Human
gggtccacagatagaggcaggtgcctcctgagggtgcacatttcctaggtgtgctcctggcacccacccaccactgcacccatttgtggcggactttgcttgttttttccacctggggtccactgtgaaatgggacacaattatcctccttcactttctctcaaacccctgagcaagcacagaaactgtttgaggttgggtttttttttttggtttggtttttcatttttgttttttggtactacaactacaactagtaaccacagcaaaaacagttctagcatagcagtttagggggacyatggggtcaaaactatttaaaaataatacaaagatcttatctgctttgtcacgcttgttcttttgtgattgtgtagggaagttttccagaggttacatggcatgatgatgtcatcacttggacagctatggaaggtgtgcttgtgtgttcttgcgttttcaaaatttatcagttttaatttctaagatggtcaatattgatagatatagtccacataaacaaactttatttggggtccttaataatttttaagagtataaagcgattgtgagaccaaaagtttgataactgctagcctaa

SEQ ID NO: 94882 - DNA, 601 bp, Human
actacaactacaactagtaaccacagcaaaaacagttctagcatagcagtttagggggaccatggggtcaaaactatttaaaaataatacaaagatcttatctgctttgtcacgcttgttcttttgtgattgtgtagggaagttttccagaggttacatggcatgatgatgtcatcacttggacagctatggaaggtgtgcttgtgtgttcttgcgttttcaaaatttatcagttttaatttctaagatggtcaatattgatagatatagtccacataaacaaactttatttggggtcctyaataatttttaagagtataaagcgattgtgagaccaaaagtttgataactgctagcctaacaaactagccaaacttagtgttgagaattagtgtttaaaatgtgttaaaaacctatcatcagcctttattgaaatataaattgtgttgaacctgatcttttctcgcccttttcctgactttttacattgcttgtcaacaatattctacctctttattttattcttggaacaggtgctactgaatgaactatttcaaccctttcctcaattcccttctctttttaaaaaaattttacctga

SEQ ID NO: 94883 - DNA, 601 bp, Human
ctctagtaagaataatgatatcttgaggcaagctgcagtctaatataatataatgaatgcatattagaaatcgactttattatttcctatctctaatgaattgatacataataggccatatgtgatgtgtctagtgcagcgtatctctatggtccacatgtactttctatgacaagaataaacaaaactgggagaaatgaccggattttaaattatcatttcacaaagtcatgtttcataaaatatattgaactgaagtctttccttgaagttgtgatgccagtttcctgttggagcagargttggtctcagtgactatgtggcctgaggcagggcctgagactgggaggtccagcagctcaggaaggggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacac

SEQ ID NO: 94884 - DNA, 601 bp, Human
ggaaggggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacacagcttttcacaggtggaatcactgtctcaaagtatttccctcagttgtcatagggcctgaartctctctaattcactgggcggagacactgtgttcaagtggccgaaatgacaatgttagtattttactgatgacattaacagtgattaacatctcagagaggagctgttagtgggtgttgtccttgatcataagcagatacccagaaagcatgggacagaggagccgtgtgagctgtggtggcctggcaggaacctggatgctggaagggagctctggaagatgttgggctgggctttggggatggggttgactattatttgccagtttccaccttcccagaaccagtcctatctaccttt

SEQ ID NO: 94885 - DNA, 601 bp, Human
ggaaatgtgtgagactaatgggagccaagcaggcactttggtgagagacagagatgctgactcatgcgccagtgagatgtgtgcatgtctgagatcacatgtgtcatttgcttacctgtgaaatgtgtgtgggcatgtgactgtgtgtttgtccctgtgacacatctattactcagtaagcaggacagtgctgtttgtggtaggtgttccacacattaaatggatgagcacacagcttttcacaggtggaatcactgtctcaaagtatttccctcagttgtcatagggcctgaaatctctstaattcactgggcggagacactgtgttcaagtggccgaaatgacaatgttagtattttactgatgacattaacagtgattaacatctcagagaggagctgttagtgggtgttgtccttgatcataagcagatacccagaaagcatgggacagaggagccgtgtgagctgtggtggcctggcaggaacctggatgctggaagggagctctggaagatgttgggctgggctttggggatggggttgactattatttgccagtttccaccttcccagaaccagtcctatctacctttcaggag

SEQ ID NO: 94886 - DNA, 601 bp, Human
atgggatcctgctatatgctgaagtcctgaatgagacaatacaggaaggaggcacccgggaggatggacttcgaattgtggaaaagatgcagggacgaagatatcacggtaatgaagaggggtcaatgggggtctgagggctgatgtcaggaatagagtgggctgaagaagaaacagatgtcaggatcaccacagctttagtgggggttagtgaatatggcagagttgcccacacctcaagatcggggaagggtagactctgagggagccgtaggcatgagtgagtgggagaggagcccasggtagacctcaaagaaaggacactcttttctgtcttaggtgtaactgggctggttgtcatggacaagaacaatgaccgagagactgactttgtcctctgggccatgggagacctggattctggggactttcaggtgatggaggaggaggcagggaagagagtgtggccctgcaaaatccagctttcaagggttcagtcggggcagaaccaaaactactagatgagggatttgttttctctgctggcactgcatcctggctgggtggtaggctggggagaaaagcagcgaaacagctgggg

SEQ ID NO: 94887 - DNA, 601 bp, Human
cagggaagcccctgcaaccctgctgttggcttgggggtggcaggattcggcttgccagtcaactgaggtgtgcagtccttacagaaagctgatgctggagaaggagctggctagcatgttgtggcgtattcgctgggaagaactgcagtttggcaactcagagcgttatcacaaaggtgcaggcagtcgcctcacactgtcgctggtgagcccttgtctcagctgttcctctgcctccctctgagttcctgtcccttcttaccctggatctctcccagcacattggcttgtaatgatagcmcctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccgactctctgtgcccagctgagctcctgggtgcttccactgctctctagcatttccttgtacccag

SEQ ID NO: 94888 - DNA, 601 bp, Human
ccctctgagttcctgtcccttcttaccctggatctctcccagcacattggcttgtaatgatagcccctgcactaccaccatcatctaatgttcctttcatccttccgcctccatgttgcccttggccccagcggggatccagttacggctcgctcatgacagcccatgggaaataccagatctttgccaacaccggtcacttcaaggtgaacagtcatttgcttgttctggtccccaccatttcatcctgtctcatccccatctgccacctctgcccctgaacctctgtccctcatacccsactctctgtgcccagctgagctcctgggtgcttccactgctctctagcatttccttgtacccagaacttctgatattcactttcctttcccctttcactcccaccatcagggaaatgttgtcgccatcaaacatgtgaataagaagcgcattgagctgacccggcaggttctgtttgaactcaaacatgtatgtaacagaggatggactctaacatgtatgtaatggaggagtggggaaaactatgaaatagtaaaattggctagatgggcaaggggttgatttataaatgattttaaaa

SEQ ID NO: 94889 - DNA, 601 bp, Human
aaatattagtaaagccaatgtcatgctcaactagaggtgtgatgataaacataagacacgactcttgagagaacagtgatttggtggaaaagtgatttacaacaaagccagaagcctaatcctgtgattgttgaaggcatcctttgcacagtttccacacaagtaaattcacaacttcagagattcccaaaagttttgttgataccaaaataaataaaaaggaagaattcatagagattagagttatgaattaagtccagagctaaacatttagacagaaatgttttttgttagcatattraaccttgtatcctctttctgtctcacctgaactgacttgggtggctcctagggtttcatttttggggagcatcattaagactttttttttttttttctgagacagggtcttattctgtcacccaggctagagtgtagtggctaggtcactgctcactgcagcttcgacctcctgggctcaagtgattctcccatcttagcctcctgagtagctgggaccacagcgtgtgctgcagtgcccggctcatttttatatttttggtagaggtggggtttcgccatgttgctgaggctggtcttg

SEQ ID NO: 94890 - DNA, 601 bp, Human
aaagtgctgggattacaggcatgagccactgagcccggcctttaagactgtctttcagctcctcggaggcaaaggtttttccctctctggacccacagagccagcagttttaggcttctgcactggcttagcagattttgtccattttccaggtttatgatgttctgcactttctctctgatccagcattccctctagtagatcttgttcctcctctaccccgacttgcccacctccctctagtagatcttattcctcctctaccccgacctgcccacctccctctagtagatcttgttcytcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacttgcccacctacgcctggttatgcattaaagtttacaactggtcttccttggtatatccag

SEQ ID NO: 94891 - DNA, 601 bp, Human
cctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacctgcccacctccctctagtagatcttgttcctcctctaccccgacttgcccacctacgcctggttatgcattaaagtttacaactggtcttccttggtatatccagctactcttgatacctgggtctcaagtcatgtcttcctaattagyagccaggtatctgaggccaccatgggtgttatatcattttggtcttcacccaagttctgttctcttcactaatcaagaagattgactgccctctccagggtagtcatttgtagctccacttatccctctttttaagcattttccctgtccctggtggctgggtgcctgtgtcctgcttatgataccaggaacagatgactcttctgttcttcctgcttccttgggtggaaactgcaaaggatgccttccaaaatcagcttattatttttgtggacccaagatctgtagacagctagccag

SEQ ID NO: 94892 - DNA, 601 bp, Human
cctaccccagtgagactttgtcccccttcctgtattttcttttgggattctgctctgttgggctctgcctcatcaggcacctgagaactcgcctccccaccctcagaaccctgctggccacagggagcacccctgcttatagattatttgctgtcattctgtctccacatcagctatgctgccttcttactggctgcccatcccttcttcttaagaccctgctctaccacacccttgcttcagcaagtgtatgtaaaacagtcccaacttgagacagctcccatgcacagggattcccctcaaaaccccccgccacttgtgtgccttaccttgcattagactgtaatgtcttcccagccactttcctccctcccacctgaaaagcctagctttcttgttacagctcatctctgctgcagccacatacactttccctctctcttccactcctgctctcttggagtttggctcatacggcacccttgcttcctagttcagtggcagagcagttaaaacggggagagactgtacaggctgaggcctttgacagtgttaccatctacttcagtgacattgttggcttcacagcattgtcagcaga

SEQ ID NO: 94893 - DNA, 601 bp, Human
ctagagttcccacatcttttgatggcttgtgggttaagaattcttagaaaattgggcacaagtctcagggcctctgcttttctatcccttttaggtagtgacacttcttaatgacctgtatacctgctttgatgccataattgacaactttgatgtctacaaggtgagagctgttcaatagaagaccctttaatagagacccgctttgaaactcagtctccctgaaccccacacaccttacccaccccatgatcagttttccctccagggtactcagcatcctggtgctggagtgtacttygtagacagatgtagctccagcactataattgtacactccagtcgaatttcttgtgaatcctttgacttccctaatcagaaccatcatgagatttagctcctgtcttcctggagtataaatacagcctatccaacatttctctccagtcctctccagacatggaagaatcatataggatgtgggtccagactgatttagtggggtgagggaaaatatattttaaaaagtaaaactttttgttgaagttattgagttggatttattgtccttgggagtaaaaatcatctggatttgaatatt

SEQ ID NO: 94894 - DNA, 601 bp, Human
acttcttaatgacctgtatacctgctttgatgccataattgacaactttgatgtctacaaggtgagagctgttcaatagaagaccctttaatagagacccgctttgaaactcagtctccctgaaccccacacaccttacccaccccatgatcagttttccctccagggtactcagcatcctggtgctggagtgtactttgtagacagatgtagctccagcactataattgtacactccagtcgaatttcttgtgaatcctttgacttccctaatcagaaccatcatgagatttagctcctrtcttcctggagtataaatacagcctatccaacatttctctccagtcctctccagacatggaagaatcatataggatgtgggtccagactgatttagtggggtgagggaaaatatattttaaaaagtaaaactttttgttgaagttattgagttggatttattgtccttgggagtaaaaatcatctggatttgaatattggcttgttgctaactgtgtggccttaggtaagtcacagaatctccctgagcctcagttgttttatctgtaagatgggaataatagattcgttgtatggaaag

SEQ ID NO: 94895 - DNA, 601 bp, Human
gtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactggtaaggctgactctcactccagccctagtctccacctttcccagactctcccaacctgtttcttctcaaagggccagtctgtgctggggttgttggcctgaagatgccccgttattgtctttttggagacacagtgaacactgcttctcgaatggagtctaatggtcaaggtaagacattagccctcaaccccactgttggcctcaatttatcttgcccttttcttcttttcataatccctccaatttcttaatctgagagaccacagttccttagtgtcgcatcctcgggcatattttggttctaatagatatgcattgggaggttgggcatattttggtcctaatagatatgcattgggagcttcccagggatggttggtcgggcacggtgctatacagtatcaccaattatttgattgccttt

SEQ ID NO: 94896 - DNA, 601 bp, Human; identical to SEQ ID NO: 94880

SEQ ID NO: 94897 - DNA, 601 bp, Human; identical to SEQ ID NO: 94881

SEQ ID NO: 94898 - DNA, 601 bp, Human; identical to SEQ ID NO: 94882

SEQ ID NO: 94899 - DNA, 601 bp, Human; identical to SEQ ID NO: 94883

SEQ ID NO: 94900 - DNA, 601 bp, Human; identical to SEQ ID NO: 94884

SEQ ID NO: 94901 - DNA, 601 bp, Human; identical to SEQ ID NO: 94885

SEQ ID NO: 94902 - DNA, 601 bp, Human; identical to SEQ ID NO: 94886

SEQ ID NO: 94903 - DNA, 601 bp, Human; identical to SEQ ID NO: 94887

SEQ ID NO: 94904 - DNA, 601 bp, Human; identical to SEQ ID NO: 94888

SEQ ID NO: 94905 - DNA, 601 bp, Human; identical to SEQ ID NO: 94889

SEQ ID NO: 94906 - DNA, 601 bp, Human; identical to SEQ ID NO: 94890

SEQ ID NO: 94907 - DNA, 601 bp, Human; identical to SEQ ID NO: 94891

SEQ ID NO: 94908 - DNA, 601 bp, Human; identical to SEQ ID NO: 94892

SEQ ID NO: 94909 - DNA, 601 bp, Human; identical to SEQ ID NO: 94893

SEQ ID NO: 94910 - DNA, 601 bp, Human; identical to SEQ ID NO: 94894

SEQ ID NO: 94911 - DNA, 601 bp, Human; identical to SEQ ID NO: 94895

SEQ ID NO: 94912 - DNA, 601 bp, Human
gccacagagatttggtggatgtcttctccagccctgccctagtgccctgagactgcagcatcagccctttttctgcttcttgcaactttttgcatcacaggctgaaatacaagatttgactgactaaagcgtaaggaggtactggattaggtgaggacaattcaggaagacaacagccctggctggaaaccaaacccaaagctaaggaggtggtggtagtgactatgatccctgctgaggaagatcagctttggggcgagagtcgggacgaaagtcgttcggtgtaagtgggaagtagggwcagccttactcacagcgcactcccaggcagatggcggtcactcctaacagcaggcaggtgaggagcaggccgagcaggaggtatcgcaggcaggttgtgcggccttagggggacagtgggatggatgagggcagtcagcccccgtaaagaatgtagagaggaagggacaggtccgtgggggagacccctggggaaggcatccctaagaggagggcggtgcagagctgagggggcaagcatggtggtttctgtcgggtagcggggtgtttcgcaggtaggggagagggtgttccagaatca

SEQ ID NO: 94913 - DNA, 601 bp, Human
aggactgtcctaatctggaaacctgaaagctgtcatctcacagatgtagggaagagaacttctacatgactctgactccagtgtccaccatgaccaagttttatgtaccttgttacattttgagctttgagcataagtcctaaaaagtagtaaggtagagctgggatatgctctggacatatcccaccctcccttctctccccttcccctgtataaaacctaaatcctaactcaccctgcctgcctaaggccacatctgggcatggttcaggacagatgtctggagttcaactaaaacagrctttagaaccagcagagggaaaaataactcgagatcttaaagatgggaaggccaggctgggcacggtggctcatgcctgcaatcccagcactttgggaggccaaggcgggtggatcacaaggtcaggacatcgagaccatcctgactaacacggtgaaaccccgtctctactaaaaatacaaaaaattagccgggcatggcggtgtgcgcctgtagtcccagctgctggggaggctgaggcaggagaatggtgtgaacccctgaggcggagcttgcagtgagctgagattgcaccactgc

SEQ ID NO: 94914 - DNA, 601 bp, Human; identical to SEQ ID NO: 24112

SEQ ID NO: 94915 - DNA, 601 bp, Human; identical to SEQ ID NO: 24113

SEQ ID NO: 94916 - DNA, 601 bp, Human; identical to SEQ ID NO: 24114

SEQ ID NO: 94917 - DNA, 601 bp, Human; identical to SEQ ID NO: 24115

SEQ ID NO: 94918 - DNA, 601 bp, Human; identical to SEQ ID NO: 24116

SEQ ID NO: 94919 - DNA, 601 bp, Human; identical to SEQ ID NO: 24117

SEQ ID NO: 94920 - DNA, 601 bp, Human; identical to SEQ ID NO: 24118

SEQ ID NO: 94921 - DNA, 601 bp, Human; identical to SEQ ID NO: 24119

SEQ ID NO: 94922 - DNA, 601 bp, Human; identical to SEQ ID NO: 24120

SEQ ID NO: 94923 - DNA, 601 bp, Human; identical to SEQ ID NO: 24121

SEQ ID NO: 94924 - DNA, 601 bp, Human; identical to SEQ ID NO: 24122

SEQ ID NO: 94925 - DNA, 601 bp, Human; identical to SEQ ID NO: 24123

SEQ ID NO: 94926 - DNA, 601 bp, Human; identical to SEQ ID NO: 24124

SEQ ID NO: 94927 - DNA, 601 bp, Human; identical to SEQ ID NO: 24125

SEQ ID NO: 94928 - DNA, 601 bp, Human; identical to SEQ ID NO: 24126

SEQ ID NO: 94929 - DNA, 601 bp, Human; identical to SEQ ID NO: 24127

SEQ ID NO: 94930 - DNA, 601 bp, Human; identical to SEQ ID NO: 24128

SEQ ID NO: 94931 - DNA, 601 bp, Human; identical to SEQ ID NO: 24129

SEQ ID NO: 94932 - DNA, 601 bp, Human; identical to SEQ ID NO: 24130

SEQ ID NO: 94933 - DNA, 601 bp, Human; identical to SEQ ID NO: 24131

SEQ ID NO: 94934 - DNA, 507 bp, Human
caatggcacaatcttggctcactacaacctccgcctcccgggttcaaacgattctcctgcctcagcctcctgagtagctgggattacaggtgcccaccaccacgcccagctaacgttttttttgtatttttggtagagacagggtttcaccacatcggttaggctggtcttgaactcctgacctcaggtgatccaccctccttggcytcccaaagtgctgggattacaggcgtgagccactgtgcccagccaagaaggaatcgttcttgtctggaggttctctgtatagtataagatcaggatgtgtactacctttacataatagtatctgagggctcggctgagtttgtcataattcatgttaggcttgttcttgcgaatcccccagagacgagccacctcttctgcctgcaaaagcttaaactgcccatcattagaggtccaacagatcatgtgcttgttctgaggcttctgcaggagctgaagaaggaactgccacagggtgat

SEQ ID NO: 94935 - DNA, 601 bp, Human; identical to SEQ ID NO: 31755

SEQ ID NO: 94936 - DNA, 601 bp, Human; identical to SEQ ID NO: 31756

SEQ ID NO: 94937 - DNA, 601 bp, Human; identical to SEQ ID NO: 31757

SEQ ID NO: 94938 - DNA, 601 bp, Human; identical to SEQ ID NO: 31758

SEQ ID NO: 94939 - DNA, 601 bp, Human; identical to SEQ ID NO: 31759

SEQ ID NO: 94940 - DNA, 601 bp, Human; identical to SEQ ID NO: 31760

SEQ ID NO: 94941 - DNA, 601 bp, Human
ttagaacagcatttggctcatttaaagtatgtaaaaatgtttgttaattactctgttaattaaataaaaagtacatcatgcctagattataaacatttccagtaagttgtaaattaatgaagatttgtaacacataaattagttatgtcataaatatataaatgaagttaaagccttgctaaattataaggtgaaatgagggcaaaatcagcctgagttagtaaaaattttaaagttattgttatttttattttttgtttttaggaaaagacgaaacctaattggggaaacaagactagcwttcaaatggaaaatacaaggtcacatgcaattggagtgcacaatttcacacacatggagcaaaccagagttggtgagatgctgaaataattcaaacaaataaatgaacacacagtcacaaaatgttccatgaaagaagttaacacttaatgggatctcaagaaataatcttaaaaggctaagagaaaaagacacttcagaaagggaaaggtatggagaggtggagaggagctgaggcagtgaaaacatcctgaagacagaataagtggtggtgggggaggggcggggcaaggggcagggg

SEQ ID NO: 94942 - DNA, 601 bp, Human
aacgtatttatttcttgctaatatagcactttattaattcagagtaaaaacaaggaaagtaacttccaaactagtttaaaatgcaaatctattttaaaagagatgtgtccattaattttaacttctgtaaccattaaagctaagatataatagtacaaataagtaaaacaaggcaaatccaagaagaatctaattagaaacatgataattctttgtatttattttaacttcctagctaaataggaaggcactatagcactctgtttagcaggaaagactccagagccagactgcttgggtrcaaattctggcttaccacttaccaaagctgtgggaccttgggcaagccataacctctgtgtgcctcattttcctcatctataaaatgaggataataatagtacctacttcatagagttgttatgaagattgaattagttgagatttgtaaaattcttagaacagcatttggctcatttaaagtatgtaaaaatgtttgttaattactctgttaattaaataaaaagtacatcatgcctagattataaacatttccagtaagttgtaaattaatgaagatttgtaacacataaattagtta

SEQ ID NO: 94943 - DNA, 601 bp, Human
ttttaagataccatgagtgtcttgaagagaaaaagagagtaaagggagtcagttatgcagatgcctctgggtagatggagtcttgactttgttttgcacctgagaagataagcttgtaattgacatggtcagtgtggaaggcctgaactagtttttcagattaactttggaatgccatttgttgagaggagaggtccattcacattgttggggggcttagaattttatttttggtttacttaactacctacttttttcccaaagaaataatcatgttcaaaactcaatgaaatgttatctmaatgagattgtaatgttgctcagtctttcagaagtcataaaaatagtcatactttttaaactagtaaatgcaattctaggacccaagactaagaaaactgtccaaaatatgggaagacatttttatttatacttttttttttttttttttgagacagcctgttgcccaggctggtgtgcagaggcgtgatctcagctcactgcaacctctgcctcccaggttcaggcgattctcctgcctcagcctcttgagtagctggaattacaggtgcacgccaccacatccggctattttttgtat

SEQ ID NO: 94944 - DNA, 601 bp, Human
agtctacaacaagataacatgattgccccaaggcagaagtaaaagaaatattgtaggaaccataaatgaatttaaaagctgatcttttaaaaaatatataacttatcaaagtgagagatcagtcctttatgatatttaaggagttcctgtgaatgcaccattatgctggatactctgaaaaaatgcaaatcaagtatgaagcgatataaattctgcccttaaggaacttgcaatctagttggagatttatgtttaacacaaagaagcagtttttacaaatacttcttttgaggattctggraagatggcagagtagaaagcaccaggaatctgtctcctcacctagacaagaattgtactggcagaatctgatgtaactattttggaactctggagtctattgcaggcttgcaacttccaggggacagacttagatggtaaattgcagttaattttggtctatttgagctcttagtacagtagcagctacccatcttccacctctcaacccttagcagacagctgtgcacgttattagagcaatctgcacacaacttacaggaatcaggtgggcaaaaagaaacacaccatccagatatct

SEQ ID NO: 94945 - DNA, 601 bp, Human
actgtgccactccaccttggaactggaactacttctggagtgtgtcttgcttcggggacttgtagccatggcttcctttcatctgaaccacgccaggctggtggctcaacatccctaagctaaactttaagcagctgttacacccttccctgtggagtcaagcagaggtggaactactccacctactcctaccccactgcccttgggctagagctgaagcagtatcctatttcctgggaacacactaccttggccacccagagcagtcatgcacccctgtgcctaagctgaagtggtatayggcattccagggaaacagggcctgaaccacccagagcagtcacactccccgggcctcagctgaaggagcacatcactccctgcagaatcagtgccctggccaaaccgagcagctatgcatcccagggctgagctgatgtagtatcctatgtctcagggaaacagagcagtggctgagctgagacaccctgttctacaggccaaataactgtagtaccccgcttccctggagctggactagtcctctagagcctgagctgctgagacactctgaggagtggagtcatcactgtgctgttcc

SEQ ID NO: 94946 - DNA, 601 bp, Human; identical to SEQ ID NO: 19785

SEQ ID NO: 94947 - DNA, 601 bp, Human; identical to SEQ ID NO: 19786

SEQ ID NO: 94948 - DNA, 601 bp, Human; identical to SEQ ID NO: 19787

SEQ ID NO: 94949 - DNA, 601 bp, Human; identical to SEQ ID NO: 19788

SEQ ID NO: 94950 - DNA, 601 bp, Human; identical to SEQ ID NO: 19789

SEQ ID NO: 94951 - DNA, 601 bp, Human; identical to SEQ ID NO: 19790

SEQ ID NO: 94952 - DNA, 601 bp, Human; identical to SEQ ID NO: 19791

SEQ ID NO: 94953 - DNA, 601 bp, Human; identical to SEQ ID NO: 19792

SEQ ID NO: 94954 - DNA, 601 bp, Human; identical to SEQ ID NO: 19793

SEQ ID NO: 94955 - DNA, 601 bp, Human
gggtggcagttgggagcaccgtctctgacacctaggccccgggggtggctctgccaccaagtcgtaggcgagcgtaatgaaagcaaagatagcaaattgtaaggagggctttgacttttgtcatcttctgaatgacgcacagctgatgtcatcctaattaagcgcattcactcctagtctctggaaatgcaaatcaaatatgcgagatgcggcactgcatttttaatgttgaccataatgtaatgatgaagcaaatttttatttaattttcgagtctgcacctattttggccaagtaaagmcagtaaaatagggagagcctcctgaggatctgaatttattgccctggcacataatttttagctgtaagttgacttggttcccctactttgtcttgaattaactattagggactctggagtatcgaactaggctgtcagaaacggtggatacatgtggctagtccaaattgaaatacgctgtaagcttaaagtacacaaaagatttcaaagatggagtatggaaaaagaatgtagaagatgtcagttattttatatattgataacacgttgaaatactatttggatatgttgggttaagta

SEQ ID NO: 94956 - DNA, 601 bp, Human
aattttcgagtctgcacctattttggccaagtaaagacagtaaaatagggagagcctcctgaggatctgaatttattgccctggcacataatttttagctgtaagttgacttggttcccctactttgtcttgaattaactattagggactctggagtatcgaactaggctgtcagaaacggtggatacatgtggctagtccaaattgaaatacgctgtaagcttaaagtacacaaaagatttcaaagatggagtatggaaaaagaatgtagaagatgtcagttattttatatattgataayacgttgaaatactatttggatatgttgggttaagtaaaatacattattaaaattagtttcacttgtttcttttctcctttttaaaaatatggctactaggaagtttcaatttatatagcttgcattctatttctgatggagagccctctccaggaagtctcagccctttagagggaagggggacacttcccctttgggtaaagctatttcatagtgccgaaaacatgatgatcccccctctagtatacaggtgtggattcagtagatgcttgataattcagttcttatttggtactatta

SEQ ID NO: 94957 - DNA, 601 bp, Human
agtaaacttaacatttctagtcttaacggttttaactatctgtgaacatctttttctctgtttgcaattagtaattgtcttctttcctgccttctgtaatccactgaagctgatttaggatcttcctttagctctgaccttccttcagacttccctgcatttctagctactagctgggtaccttggcctgaccagtgtgtccagagccagccagtttctggtttatttcttcttttttttttttttcccccgagatggagtcttgctctgttgctcaggctggagtgcagcagcacaatcrgctcactgcaacctctgcctcatgggttcaagcaattctcctgccacagcctcctgagtagctgggattatgggtgcgcatcaccacgcttggctagtttttgtatttttttgtttttgtttctttgagacagagttttgctctgtcgcccaggctagcgtgcagtggtgcgatctccgctcactgcaagctccatctcccgggttcacgccattctcctgcctcagcctcctaagtagctgggactacaggcgcccgcaccctgtctggctaattttttgtatttttagtagagacggt

SEQ ID NO: 94958 - DNA, 601 bp, Human
atttaacaggcaaaattaaatgtagggctaaatatttagtagctggctataagcctaacgatgtttacacttgccttcacaagtaagtgtggattttattgtttgtatttaatcttaatgataatgtgcaaactttcacttttcttctagggcactgtaaattggtctgttgatgacattgtcaaaggcataaatagcagcaatgtggaaaatcagctccaagctactcaagctgccaggtaagtcttgtctgcgatagcatgggtagcctaagaaatttgtgtttttagatttttttttkggggggtggggcaggaagggacagacagatagtacaaggaaagattaggccagccagccataagccaaatagtattttttatttattaatttttttgagaggggaggccttgctattttgcccaggctggcctggaatgcctgggttcaagcagtcctctgacctcagcctcctgaagtgctgggatcacaggtgtgtgccattgcacctgcccataaagtttttaccaaagtaatgtttcaagtcactggcaggggaaggaagaaataaatagtaagtgggattgagacatgcatttag

SEQ ID NO: 94959 - DNA, 601 bp, Human
attaagtacggtgcagttgacccactgttggctctccttgcagttcctgatatgtcatctttagcagtaagttactaacatgagtaaagttactcacttcttcattctaatttcccccatcttctcaaaagacagaacctctcattgcctattttttttcccccagtgtggctacttacgtaatcttacctggacactttctaatctttgccgcaacaagaatcctgcacccccgatagatgctgttgagcagattcttcctaccttagttcggctcctgcatcatgatgatccagaagtrttagcagatacctgctgggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcaagaccagcctggccaacattgtgaaagcccat

SEQ ID NO: 94960 - DNA, 601 bp, Human
gttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcragaccagcctggccaacattgtgaaagcccatctctactaaaaatacaaggaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaaaagcataatcagttgatagtaatattgaaatattgcctatttcaggccatgatgggcctcttgttaaaacttttagggtatagaatttctaaagtgctggggaaaaa

SEQ ID NO: 94961 - DNA, 601 bp, Human
ggctatttcctaccttactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcaagaccagcctggccaacattgtgaaagcccatctctactaaaaatacaargaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaaaagcataatcagttgatagtaatattgaaatattgcctatttcaggccatgatgggcctcttgttaaaacttttagggtatagaatttctaaagtgctggggaaaaaataaccagcatcaacatattttttttttttcagactcctgccctaagagc

SEQ ID NO: 94962 - DNA, 601 bp, Human
aagatggaggaaaatagccactttctttaaagtgctacctttttggtctaatgcaatgtttactgaaaggtgcataacactaagagttaatcagtggataacctttgaatattcccttttaaaaattatttatctatctatttatttattttttacagataggatcttgctctgtggccaagctggagtgcagtggtgcagtcatagctcactgtaactttgaactcctgggttcaagcactcctacctcagcctcctgagcatctaggactgcaggcacatgccaccacatcccgctaattttttttttttttttttgagacagagtcttgccttgtcgcccaggctggagtgcagtggcgtgatctcagctcactgcaagctccgccttccaggttcatgccattgtcctgcctcagccttttgagtagctgggactacaggcgcctgccaccacgcctggctaattttttgtattttttagtagagacggggcttcaccgtgttagccaggatggtcttgatctcctgacctcgtgatccacctgacatggcctcccaaagtgttgggattacatgtgtgagccactgcacccagcct

SEQ ID NO: 94963 - DNA, 601 bp, Human
catcccgctaattttttttttttttttttgagacagagtcttgccttgtcgcccaggctggagtgcagtggcgtgatctcagctcactgcaagctccgccttccaggttcatgccattgtcctgcctcagccttttgagtagctgggactacaggcgcctgccaccacgcctggctaattttttgtattttttagtagagacggggcttcaccgtgttagccaggatggtcttgatctcctgacctcgtgatccacctgacatggcctcccaaagtgttgggattacatgtgtgagccacygcacccagccttattttttatggagatggggtcttgctatgttgcccaggttggtcatgaattcctggcctcaagcaatcctcccaccttggccttcctcagtgaattactgtgcttggcctgaatattttcttagtgaactttaaatggagaattagaatttggctggacatagatgctgtctctcatttgtaaattacctgttcacttctctgctttgacattttgtttggttcattttattttacaggtagccttggcttctgtttattatccttcaagattagtattaaatccaca

SEQ ID NO: 94964 - DNA, 601 bp, Human; identical to SEQ ID NO: 21447

SEQ ID NO: 94965 - DNA, 601 bp, Human
ggaggaagctgcgcccgggcggccccgcgtcccctcccgagggcgccgagtccgcgtgggatgcgccgcgctgcgccgcggggagggcaggtgcgccgggacgaggctgcgccctggggaccgagactgcgttttggggaggggacggtgtgccctggagatcggaggctgcgctggggacgaggctgcgcccggggaccagaggctgccccgggtacaaggttgcgccggggaacgggaggctgcgttggcaacaaggctgcgcctggggacggtaggctatgtccctggggagacgctscgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccgcgcgggatgctctgcgccgcgggcggcccgggccagggaagttcctgcgggtgccgggcgtctgcagcgatcgggagcaatctggggcagttgggggcccgaggtgacttttgacgtgttcacat

SEQ ID NO: 94966 - DNA, 601 bp, Human
ggggacgaggctgcgcccggggaccagaggctgccccgggtacaaggttgcgccggggaacgggaggctgcgttggcaacaaggctgcgcctggggacggtaggctatgtccctggggagacgctccgcccggcatgggacgctgcgccgggggacggcaggctgcgcccgggatgaggctgggcccgggcaggggaggctgccttgggaggggacgctgtgccacgggagtggagactgcgttggggacgagtctgcgccctggacggtcctgcgtgtccttccgagggcgcagtgtccrcgcgggatgctctgcgccgcgggcggcccgggccagggaagttcctgcgggtgccgggcgtctgcagcgatcgggagcaatctggggcagttgggggcccgaggtgacttttgacgtgttcacatcagaaggaaaattattgcgtggtggatgggtgcgagggaaggtgtcagattgggctgtggacgctgaaacgtgttggagtcccgatttacacgctggaaaacctaacctaaaacgtgttcctgtccaggtttctatgtcggagatctgcaccgtggtgtttagttcccagttaat

SEQ ID NO: 94967 - DNA, 601 bp, Human
aatttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgttttaggccctaggagatacagtacttaacaagataggtagagatcaaaaatgcttctggcataaagcagtacatttgtattgatagatttaaaaagataagcaagcacacagtacctacagaaaggtaaagcctcattccactccatccctkggcacttggttcaaaggctgcacccaattgtgtattgtcctagcaggagtcaaagtgtgtattgtatatgttttaatatatgacaaaccttgctatagtgcatattcttacacgtgggtacaagcaaagcctactaattagttattatcaaaatttcttagctgtaagttttacttaagaactgggttttattcccttgaatgctgtgattagctctgtgatcaaacaatataattcaaataggaggtagttaactttggaaagaaatagatgaagttacacatttaccagcctataaaa

SEQ ID NO: 94968 - DNA, 601 bp, Human
atttatgtattgtaaaacatttgaattcttttagatttttggaataagaatttttttaacttctatttgtccagtgaatgcataaaacaaacttaatccatttgacaaatacttgtctgtggcctgttatgtgctaggccttccctgttttaggccctaggagatacagtacttaacaagataggtagagatcaaaaatgcttctggcataaagcagtacatttgtattgatagatttaaaaagataagcaagcacacagtacctacagaaaggtaaagcctcattccactccatccctgrgcacttggttcaaaggctgcacccaattgtgtattgtcctagcaggagtcaaagtgtgtattgtatatgttttaatatatgacaaaccttgctatagtgcatattcttacacgtgggtacaagcaaagcctactaattagttattatcaaaatttcttagctgtaagttttacttaagaactgggttttattcccttgaatgctgtgattagctctgtgatcaaacaatataattcaaataggaggtagttaactttggaaagaaatagatgaagttacacatttaccagcctataaaaa

SEQ ID NO: 94969 - DNA, 601 bp, Human
atcaagcttagtttgaaaccaaaaagctcagagaggtccaattttattagaaaactcaatggtggccgggcgcggtggctcacgcctgtaatcccagcactttgggaggccgaggcgggtagatcacgaggtcaggagatcgagaccatccttgctaacacggtgaaaacccgtctctactaaaaaaatataaaaaatcagccgggcatggtggtgggcgcctgtagtcccagctacttgggaggctgaggcaggaaaatggcgtgaacccaggaggcggagcttgcaatgagctgagacygtgccattgcactccagcctgggcaacagagcgagacgccgtctaaaaaaaaaaaaagaaaagaaaaagaaaactcagtggttttctgtgtcaactttctaaaataggaatttctaaatctgtaatttggtgtgatggaaatggtgttaaaaaaaaacccatattattttgtatgttcataatatgtgaggtaggaaaagcaaatgggaaaattaaaaattgtccagtgaaatcattaagattccttccttattccttgagtgacttttctttccaagttgacagctttttatctggggt

SEQ ID NO: 94970 - DNA, 601 bp, Human
gagcttgcaatgagctgagaccgtgccattgcactccagcctgggcaacagagcgagacgccgtctaaaaaaaaaaaaagaaaagaaaaagaaaactcagtggttttctgtgtcaactttctaaaataggaatttctaaatctgtaatttggtgtgatggaaatggtgttaaaaaaaaacccatattattttgtatgttcataatatgtgaggtaggaaaagcaaatgggaaaattaaaaattgtccagtgaaatcattaagattccttccttattccttgagtgacttttctttccaagktgacagctttttatctggggtgtggacagggacagcgcagtagcccacagaggtcttcgtggcagggcttaccgcaccttccatttgcagagttttgcttcatccatagcttgacagctgttgggctagggccattaatatcaaattatcacaattttttttttttggtagtttgattagtactgcttgctgcacttttccacctgtatgcctataagatgtcctaggcgtacacaaagaaaagtgactttggttttaggtttaacgtctttgtgatggaacaggaagggggatgaaagt

SEQ ID NO: 94971 - DNA, 601 bp, Human
gagtggttaagtgatttacccaaggtcacacaggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagrttgtgacacaatgctttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaaggg

SEQ ID NO: 94972 - DNA, 601 bp, Human
aggaagtggcaatggcaggatgtacccttacctccttactgcagcttgctttttgcacctccactactgcagactggaggaggaatatcagcaaggagatcagttagacttttgtgaaagctgggtgactgtaccggcacctcagaccagggcggaagtggtgagatcagattcagcctactgaatttcagcatttgtaagatgccatcatttttaagttgcatcatcatttcttatgctgctaacaaagggaaaatgtagccaactagattgtgacacaatgctttcttgttacccagcrttcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacgagggttgggtcattg

SEQ ID NO: 94973 - DNA, 601 bp, Human
ttcttgttacccagcattcatttatactcattgaaagagcttagactaagcattgacttttaaaatcatataattcatgcactttcataaaaaaggaaaatacaagtaaaataaagtaattctgaaatttcttcacatctagaatctgattcttccaactcagcttttgacttggcgttggtgccaggtatgagatagggaagtctgggaagagccagtgttgggatttgaacatgtggagcttgtgactggaaggcagcccagctcagcagctccactcaagggccagatctggaggacragggttgggtcattgtgcagctacttcctagatgatcttgagcaagcagtctaatctctgtgcttcagttttctcatctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaagaggttggggccaaatatgtaaatttgggagtcatttgcatat

SEQ ID NO: 94974 - DNA, 601 bp, Human
catctataaattaggaagaataaaagcaacttgtcagggttgttgagttgctaatgtaaagtacctaaaatagtacctgactaacagtatttaatggggcttactttgcttattatttttatgattagttatctgagtagagaaaggtgaatatggatggaaattcaaggtcaggttcaagaagaggttggggccaaatatgtaaatttgggagtcatttgcatattgctgatctatgaggcatacagtatggatacagaggagcaggagatgaggaatggcctgggagcttttggcaagsggtccacattgggagggagggtctagcaacgccattgaaaaggactctgtttgaagaaggaagaaactagtgagagtctagtggcctggaaaccaagacaccgaggggttcttttcttcttattcttcgtgggctggagagtttcctattggctttgataagaggtggttgtgagtgaccttgataggtttggagtggtggggagaggaaacaaatagagtagaggtgggaacatcagtgtagacgactctctagaggagttctgttaaaagggaagagtcatgggatggtggctggagg

SEQ ID NO: 94975 - DNA, 601 bp, Human
cctgggttggcactgttgccatgatttagcggggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatayctctcaacttacgatgaggttcataacttaaatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctca

SEQ ID NO: 94976 - DNA, 601 bp, Human
ggggcagaggtggcagaactggagaaaagagagcaggtgtgaattcttggttgtgggcaatagatcaggtcttggagacaagggaagtggagggaccaagaagggctcttggagctctttggatggtgatgatgtgatgatgccacgttccagaggatctcaggttaggagtcttcaactagagacctcattttgtattgggttctgtttgagtctgcaaagcagttgtcatctaatatgtgactagcagaatatttgtttgtatagatacctctcaacttacgatgaggttcataacttraatatattgtcagttgaaaatgcatttaatacacctaaccttcaaaattcaaagtacactttctattaaatatgtatcactttcacaccatcataaagtaaaaaaatcataagtcagactgttgtaagccagcgtctgtctgtaccttcccacggcctacaaaatttgtaatgcattgtttgtaaaacacagacacgtgcatttaaacttttattaggtagaactggctcttcttcagggtccttgtaattaagtcagttattcctctcatgacattcttgtaggaggtctcattacccc

SEQ ID NO: 94977 - DNA, 601 bp, Human
cccaggtagctggggctacaggtggatgccaccacacccggctaatttttgtattttttgtagagacggggttttaccgtgttgcccaggctggtctcgagctcctggactcaagggatccaattgcctcggcctcccaaaatgctgggattacaggcggagccattgcacctggccaaaaaagcatctcttataagctgtttttggtgaaggagcaaacaggaaagtgtcccagaatttgggagatcaggattgtaatcccagccctgcttctgaacaggatggtgcattctcttcatgsctctgctgcaggctccttggatgtagaatgagggcagttgaattgcttgttgccgaggttctctccatttctggaagactattgtaagtcagagtcaaataatcattcattcagttgtccaataaatactcatcatagaacctatgtgtagtcctgtctaatggtaggtggtgctacgtcacttcctgccatggctgccgaggctcacgcgaggctggcacttggcagagagtcctgtcccttcttttgactcagtaactgtggaaagaggtgaggtataggaagggagggcctaggcct

SEQ ID NO: 94978 - DNA, 601 bp, Human
tgagttgatttccttgaaaaaaggaatcttttcaagaatgtaaagtggcttctcgtagtcttcgtgaggctctggagtcagacacaatactgggttaccctgggaccatgtgcagtgagcccgggcttctggagtcagacacagtacctggttaccctgggatcatgtgcagtgagcctgggctgccggatgccgctggtgggccctctgccagctgctgcatccccaagccctctcttgtgtcattgttttcccttttcaggaatagtttccactagggacctgctccctcaaatttctrtcatttgaggtgaggtttcgtgttggttcatctgactggccgagtgcaccctggctgtgagaacaggaaatagaattctggcttttgtcttagggatatccccaggtagagagaggagattcaaaagatgctggggagctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcag

SEQ ID NO: 94979 - DNA, 601 bp, Human
tccttgaaaaaaggaatcttttcaagaatgtaaagtggcttctcgtagtcttcgtgaggctctggagtcagacacaatactgggttaccctgggaccatgtgcagtgagcccgggcttctggagtcagacacagtacctggttaccctgggatcatgtgcagtgagcctgggctgccggatgccgctggtgggccctctgccagctgctgcatccccaagccctctcttgtgtcattgttttcccttttcaggaatagtttccactagggacctgctccctcaaatttctatcatttgagktgaggtttcgtgttggttcatctgactggccgagtgcaccctggctgtgagaacaggaaatagaattctggcttttgtcttagggatatccccaggtagagagaggagattcaaaagatgctggggagctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcagttaaacagca

SEQ ID NO: 94980 - DNA, 601 bp, Human
agctacagacgtgacctctgacctctacatgaagaatggtggaaaacacttactacttagtgttaatctacacatttcacttggtttagacctaagcataaatagtgtgaagtcgatttaaacagaggttacagtttccagaaacttcagcgccgtggctgcagttaaacagcaatgattggactctttacgtctactccattctcgatatgaatgaaagtagtcacatcaaatgcatatttattagtcttggtcattttgaatttgagtcctttacatactatgtatgtatgtacccagragcagagcagggttaaaagtgacatcttctaacttctactctggaattttttccctctgcactttttgttgtcacgtagtagatgttttcacccacatgcaggtgaatgagtgacatatttatcttgttacatagtgaagctttcaattctttaattttatccctctaatgaaactgtgaggaattgattctgttgacacagaaaaggctggtgtcacatgaacctaaaggacgtcattgagcatgtgcctctcacgcagaactgacatagagcctcccgtgcagctcaccttgaattct

SEQ ID NO: 94981 - DNA, 601 bp, Human
ttttgaatttgagtcctttacatactatgtatgtatgtacccaggagcagagcagggttaaaagtgacatcttctaacttctactctggaattttttccctctgcactttttgttgtcacgtagtagatgttttcacccacatgcaggtgaatgagtgacatatttatcttgttacatagtgaagctttcaattctttaattttatccctctaatgaaactgtgaggaattgattctgttgacacagaaaaggctggtgtcacatgaacctaaaggacgtcattgagcatgtgcctctcaygcagaactgacatagagcctcccgtgcagctcaccttgaattctccatgcacgaatcagccataggcacgtgttatgtgtggcacaggcaagaagtgcctgatagattttagttctgtttattgctggaagcccttgctgtaggaaaaggaaggttttttcctttcctggacaatgattttgagctacggtgtagaatggaaaaggcaggctttgatttgccagacactgcttgctatgtgtgaagccgggatagggcggtgctgttggacagaagacctgccctgtgtgccttttcaca

SEQ ID NO: 94982 - DNA, 601 bp, Human
taattttatccctctaatgaaactgtgaggaattgattctgttgacacagaaaaggctggtgtcacatgaacctaaaggacgtcattgagcatgtgcctctcacgcagaactgacatagagcctcccgtgcagctcaccttgaattctccatgcacgaatcagccataggcacgtgttatgtgtggcacaggcaagaagtgcctgatagattttagttctgtttattgctggaagcccttgctgtaggaaaaggaaggttttttcctttcctggacaatgattttgagctacggtgtagamtggaaaaggcaggctttgatttgccagacactgcttgctatgtgtgaagccgggatagggcggtgctgttggacagaagacctgccctgtgtgccttttcacactgcattgagaatttgtctagatgatttcctgggcttattgattgttgaaggaaacaatgcaaattgcaagttatgatcaaataatgctttgagtcttcacctttttagaatgctctgggaaaatacggggagaaaataaaccataggaaaggcattttgaggcggttttgttttgttttaaacagctgccatgaaa

SEQ ID NO: 94983 - DNA, 601 bp, Human
gggaagcagctcatgtcctgtgtcatcgtttgcatcaggctttcacttaacatgtttttcgggttcatccgtgtgttgtagaacatatcagtagtttgttccttttagtcgtattggcgtagcgtgttcgtttattccactccagcgatggactttgggttgtttctgcattctggctattatgaatcacgtgactttgaacattagcaagcatgtctgcgtgtggatgtgtattttcatttgtcataggtagattcctaggagttcgtaggagcttcgaaatggagtttaagacagaagmctttgtttgatactgataatgctagcaagggccatttatttggcttgctcttgaagtctgtctctgtgatgtgcattgtgcttcttgaattgtatgagcctactataggatgaaatatggttataatgtcgagcagaagctattagcatttcttaagctgaccacctgtgttgtgcacactattaggtcctcagcagatgagttcttaccgggtgtttgatgttttccccccacttatcagaagaggaagtcggtgaagtacggttgggcatattaaaaccacattcagcctacaacacc

SEQ ID NO: 94984 - DNA, 601 bp, Human
aagcggcagggccacagcaaagggggtggaaaggaaagtgttaaccttatttgggaaaatgataatgttgactggattctgtgaggctgaagagaactgtacaaaatagtagtaaatttttttctcagtgttaatggtgagcaatgtgaaacgactttatgtgtatgtggggattgaacaaataagcagaatcgtagtggataatgagagccaggtttctcactgtcccaggaagaagttacaaatagcaaaaggaagatggcagagggaggccgtgctgttggattgggataggtgtcastgtgactctgtggtctttaatagatgcatgtacagcacaggagtaaacataggtgtacgcgttacatgcatgggttagtgatacacctacatatgcatctcctagccttgtccgttgggaagacctagaagcaatgacctccagcaacagggagcacacctaaatatcagttgctgataaaaataagcagggctccttgcagaagatgagtctggaacctctgatgatgctggaaataaggaagtggccaaaatggatggggtgtgtcagagggcacataagcaacctggaggagcccca

SEQ ID NO: 94985 - DNA, 601 bp, Human
tcattgagtagtctgccctttgcccagttatcagaaatatcacctttatcactactaaatgttttctttcaatgatatttcaaattgcttattattcttgtgtgataaagtgattggtttttgtatgttgtgtccacagcttgtcatttgtgtctcatgttttctagatggaggatccttttgggaacatgcgtcttcctttctaagctttgtacttcccctgtattaattggctaggacttctggtactgtgctgagtgtagtgtttggatcatagtgatggctagcaggctgcatctcrttgttgtctttgacgtgaatgcttccagtatttcatccttaagtgtgacattactctagttgttttgtacataccctttatcttgtctagcatgttaccttctcttcctggtttgtccaaaataatctttatcatgagtggcagtagaattttaccatatgtgcgtctgttgaaatgatcacgtggttttccctccagtctgttaatatagcaaatttcattaatagatttcctgatattaaacattcctgcattctggggaaaatcctgtttttaacacagtgcaaaattaaaattgct

SEQ ID NO: 94986 - DNA, 601 bp, Human
ctggtttgtccaaaataatctttatcatgagtggcagtagaattttaccatatgtgcgtctgttgaaatgatcacgtggttttccctccagtctgttaatatagcaaatttcattaatagatttcctgatattaaacattcctgcattctggggaaaatcctgtttttaacacagtgcaaaattaaaattgctatttattttaataccttctattttttcaaaatgagtctctccccagccctacccctagtcttttcatttttttcatgtagtttacatgctgtagtagctacatagtgktataagtgcttaacacctggcttttggtgggaaggaggagtgggagtgtatggaaacccctgatttgtagcatttgccaatttccaagttataaatgtccctaccgtgccctatttcaagctaccgatgagctgtcaactggtttacaaaattcctgaaaatgtgacagtcttctctcatgaacaggtataagtataccagtggggcctgagtgtgcagcctggtgactctcatatctgtgtgcactcacacaaccatcactgggatcaacccggaggcttcctggtacctgtgcagctc

SEQ ID NO: 94987 - DNA, 601 bp, Human
tgatattaaacattcctgcattctggggaaaatcctgtttttaacacagtgcaaaattaaaattgctatttattttaataccttctattttttcaaaatgagtctctccccagccctacccctagtcttttcatttttttcatgtagtttacatgctgtagtagctacatagtggtataagtgcttaacacctggcttttggtgggaaggaggagtgggagtgtatggaaacccctgatttgtagcatttgccaatttccaagttataaatgtccctaccgtgccctatttcaagctaccratgagctgtcaactggtttacaaaattcctgaaaatgtgacagtcttctctcatgaacaggtataagtataccagtggggcctgagtgtgcagcctggtgactctcatatctgtgtgcactcacacaaccatcactgggatcaacccggaggcttcctggtacctgtgcagctcagcactcctaccctccccaggaggaccccggttctgacctctctccacctttgttctcacttggggattgaataccttgtttattttcacgtcatccttgttttctcttctgtgcacatgcagctc

SEQ ID NO: 94988 - DNA, 601 bp, Human
ctcagaaatccatctgttcatctttctgctaaactgatttggatttctgcttttttaatcctttgcaaaattaatttgtctttaatatgaaaatcagtgttttatttttagtaagagaaaataattctattttatttatttggaacaatttaaaagaccctagagatcaacatccttcctctttcatttcctagaggagggtgtagaggagcagagtgtgtgacaggcacagtgggactgacctttgcttctgggcctggattaccatgtctggagagtgatgctttggaggaagtatggrtcacttcgctcctgggccgtcggttcagaaggtgcagccttgcccggagctgaggtccagtgctagcagcacattccctttccttgccctgagcctgcatggcagccttcttcatcaactggaatctctgttgaggatggagaaaaatctgtggtccttttgtttactgggtgactttctgacctctctctcttctcattctctctactgcattacaactgtttgatgagagagattttaaaaatgaacataaacaatttttatggaaatatctgttatctattttttttatatagttat

SEQ ID NO: 94989 - DNA, 601 bp, Human
gggtgtagaggagcagagtgtgtgacaggcacagtgggactgacctttgcttctgggcctggattaccatgtctggagagtgatgctttggaggaagtatgggtcacttcgctcctgggccgtcggttcagaaggtgcagccttgcccggagctgaggtccagtgctagcagcacattccctttccttgccctgagcctgcatggcagccttcttcatcaactggaatctctgttgaggatggagaaaaatctgtggtccttttgtttactgggtgactttctgacctctctctcttctcmttctctctactgcattacaactgtttgatgagagagattttaaaaatgaacataaacaatttttatggaaatatctgttatctattttttttatatagttataccattggaatttactcttaccttcaggtaacagttgtgaggaccaaatcttaatcctggtaggtgacctttaaatcttagaatcaggaattcggctttagtcaaaagttaactttttccttattattgtgctcctgttggatttttaaaaatggatacattctatttattggtatttacaagtcacttgactagact

SEQ ID NO: 94990 - DNA, 601 bp, Human
atcaggaattcggctttagtcaaaagttaactttttccttattattgtgctcctgttggatttttaaaaatggatacattctatttattggtatttacaagtcacttgactagactgatactaatagtatgacacaggaaaaacaaaaacatctttctgtaaattttgaagtaatgaacaatattagggattattccaaaacagagcagacaaggcagaggaaaaccagtcaagctctttatagcttaaatctaaccctttacctgaataataatttaaaaaactattttataaatcaagyctcccattcctgtaaaataggagtaattcattatcacacatttttgtacctttaatttttttttttcttgatggagcccaagtcttaaagatgtcaaaactagtatcatgttccattttctaaagtcgaggctatctcagtcccatttctatagccaacagggtaatctgttactaggccctgaaacccttctgatgagtctcagcttataccccaccccacccccaaatattcacacaataggcacagtgaaaaccaggaaattagtctctgaaataagcagcctccccaggaaggaag

SEQ ID NO: 94991 - DNA, 601 bp, Human
gtgaagaggccctggaggctgatgcttccggccaagggcttcttctggattttcaaataaagtcccagaacagaattactttatgttttaatttcaggcaaatgtctctcatctgcccttttaagtacattaggattgggtttttcgaccctgcacagcacatgggggctcctcagagaagtgtctgataaaataaaattaaataactcgctttttagcacttcgtttttactggtgatttgttagtcattgattgaggtgattgtgattgatccaattatttgtctgcccatcctgattrtaactttttttatttacaggattttaaaagatagtttcttgatcttaatgttatatttaacgttctctttcataagatggttttttgatgactttgtgtttaaaaagtgagggtcttttgagaaatagaatatatcaaattatttgttcagaaacattcaaaagcattttttccaactctgcaagcagttgtctgttaaagcaattagcgtgtacccaattagagctctgttcaagatccctcactgataacctctgtgaggctgttggtccgtgtctttatcaagcagtagtgtggctt

SEQ ID NO: 94992 - DNA, 601 bp, Human
tcctgcctcagcctcctgagtagctggaaccacaggcgcctgccaccacgcccggctaattttttgtatttttagtagagacggggtttcaccgtgttagtcaggatggtctcgatctcctgaccttgtgatccacccaccttggcctcccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccmtttaggtacgagacgggtggggttggccctttccattctttaaggagagtattttccactgtgagatggtcacataccttctctttggtaacaggacaaaagagcaaatgctggaaaaactaagcttatgagctttggggaagcctgatgtgcaaatgagggaggctaacatgattttcgggctactggattggtgctcactcccaatttgaaaactagtcaggagataccgaggccctgtgtgatgtggtacaaagtataaggcgttggccatggtagagaatcatgattttttttttt

SEQ ID NO: 94993 - DNA, 601 bp, Human
cccaaagtgctaggattacaggtgtgagccactgcgcccagcctttctcctctttttaaatgttctcaagtagcttcctcttcaagtccggtttctttttcttgttttctgctgggaactagatgtagttcccctccttcctcagcagcaccctttaggtacgagacgggtggggttggccctttccattctttaaggagagtattttccactgtgagatggtcacataccttctctttggtaacaggacaaaagagcaaatgctggaaaaactaagcttatgagctttggggaagcctgrtgtgcaaatgagggaggctaacatgattttcgggctactggattggtgctcactcccaatttgaaaactagtcaggagataccgaggccctgtgtgatgtggtacaaagtataaggcgttggccatggtagagaatcatgatttttttttttttttctggaggtgggaagccattgtggttgggggcatgaactcagagttgtgccgtggaagggtccctgtggcaggagaacaggtggagagcagacgccgaggggccgctgtccaggcaggagtgatggagcatggctggtggggact

SEQ ID NO: 94994 - DNA, 601 bp, Human
aaggttctttggaagaatggggatgtgtgggtgagagtggagtagacaggctgggcttactaactaggcttgcactggcccccgtcagtcactgttcccaagtcaaatactgcattgcactgaacaccagagcagcagtgcatttcctagagaactctgcaaggctacaggtggcagacttagggagcgcttgccatccctgcccttcccagctctacccagaacaaggaggcctcgcacactacctggtcatattttgacttcatgcatttaatgaaccaaactaaaggtaaatattttmttttgattcccaaggcagacttgtgggtacccaagttcctcagcccatctttaactcagtaggatgtggcatctccattgaggctcttcatggaatccctggaggtgaaacctcggtgtccggttgctccaaaccagtgctggtgggattcagttttctggacccatttctgggtgaagtcaaggaatggaggcgggcggctgtcaagcgtctctgttgctcaatggggcaggccagtcccagcggcgacttagaggtggctggctgggcgtccctacaggagaatgggccacagggcca

SEQ ID NO: 94995 - DNA, 601 bp, Human
ctccggagctggctctgcgctcacgtgctcgctgtgccctgcgcgcgggcgggccgtgtccccgcagccccgcgcctggcgctgccaagctgcccagcgggctttagcaggtgctgaaatgcccgctgccagtcgccgagtgctgggtgcagaggatctctccagacacctaggctcccttctttcgcggcacgtgggaaaaactcctgaagtgcgtgcacagagtttttgttttagaggctttgacgttatgattaagtatacctgtgatgtaacgaaaaccttttttaatgcttctcaraagatttgctagcgtttaacatttacctcctgtactggagtttaaaggaagcgttgcttcttaagtaatcagtgatccttttgcttttggaaattgtaatgaacttcaccatcgtagagctttaatatttctttcctgaagcagaaagcatgtgaaattttctggatagtgtatacttaatacgcaagcttttggagtttttgaatgctgggtatgttagcacaccagtcttgctgactattacgtgggagatgagtgctgcttaaaattgtgtaaggggtcagtagttacagtggtgga

SEQ ID NO: 94996 - DNA, 601 bp, Human
gctgccagtcgccgagtgctgggtgcagaggatctctccagacacctaggctcccttctttcgcggcacgtgggaaaaactcctgaagtgcgtgcacagagtttttgttttagaggctttgacgttatgattaagtatacctgtgatgtaacgaaaaccttttttaatgcttctcaaaagatttgctagcgtttaacatttacctcctgtactggagtttaaaggaagcgttgcttcttaagtaatcagtgatccttttgcttttggaaattgtaatgaacttcaccatcgtagagctttwatatttctttcctgaagcagaaagcatgtgaaattttctggatagtgtatacttaatacgcaagcttttggagtttttgaatgctgggtatgttagcacaccagtcttgctgactattacgtgggagatgagtgctgcttaaaattgtgtaaggggtcagtagttacagtggtggacatacttttgccagacatggtttattttaaagtgaacatattttgtgcttatttatttatttgggacagggtctcactctgttactcaggctggagtgcagtggtaatcatggttcactgcagc

SEQ ID NO: 94997 - DNA, 601 bp, Human
taaagtctctgtgcttcccttggggaaatgctcccaagtatgaagcacccaggttctgagaacagagttggataaaaaggttgagttggagaaacttacctaacagggttaaagtggagacaaggatggcatgtgaagctttggctttacttcccaggtgatttttctgttacgcttagcatgcatcattgctgcttcgttgttttgttttgttttgttttgttttgtttttttagatggagtctggcactgtcacccaggctggagagcagtggcatgatcttggctcaccaaaacctcyacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcacccggcctgcttctttgtattttaatatttgtgtattttatgattttctagagaagcattggtttcattttggcctaagtatgatacaagag

SEQ ID NO: 94998 - DNA, 601 bp, Human
ttgttttgttttgttttgtttttttagatggagtctggcactgtcacccaggctggagagcagtggcatgatcttggctcaccaaaacctccacctcctggggtcaagcaattctcctgcctcagcctcccaagtagctgggattacaggtgcccgccaccacacctggctaatttttgtatttttagtagagatgaggtttcaccatgttggctaggctggtcttgaactccagaccctcagatgatctgcctgccttggcctcttaaagtgctgggattataggcatgagccactgcayccggcctgcttctttgtattttaatatttgtgtattttatgattttctagagaagcattggtttcattttggcctaagtatgatacaagaggtggaaggctggtttctctgtttccttcagctgctcctgactggtcctcatctgttccttctcagatcacaattaactgaatatattttaaaagagaaaactcgtaagtgccctaaggaaataaggaattattttgaacactaaagctaaaagcattctaacattgtgttgcttttatgttctttactaaatttgcttcatgcacacac

SEQ ID NO: 94999 - DNA, 601 bp, Human
tgcagatgatttcaaggactggcttccttcgtgaaaacgtattgttggttgcaagaagataggggactggaaacatgattcgtctgtctgtagaggtgaagttccaagaagctcaccactgtccagtctttatgcttatgaacttgttgagtgagttctttttttatagtgtacccatgtctaggaattttggctgaaatcagcttctttgcttttttaggctttttgctagtgatagtgttgtctttgttctgtaaaacaactgtaaaggaataccaacaatctagtgcagaaattcttytgtaagaacaagctaccctgatgtcatgtcgtgttttaggactgtttgcttctcaacctgatgaagttgttcttagctgtttgctttgttttctcatccacagcagtattcctttctttgcctttatgcttgattgcaggcttgttaaatcccgtgggaggcttttttttttttataggtcctttctctacttggctatgttgcctgctgagtttaaagcctttttatgatatttaacaaagccctctgtgttcagcgtgggttgtggttgtgtttaatgtttcaacctagactcgtgta

SEQ ID NO: 95000 - DNA, 601 bp, Human
gccaaatgctgggatgcctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacrgctggatgcacttttggggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaa

SEQ ID NO: 95001 - DNA, 601 bp, Human
ctgcactccgtttcttagccgtgagtctgtgcttggaaacccacgagaactctggggagccacaggccttggggcttttagctgtcccccttttctcttactctccggatgagtgacttgggaacttccgagcaacttaaaatatttagctcactttactttaataaaccatttttagtgctatctatgatagggtccttccagtgggaggtacacaaatttaacttaactatagttaaacaagagccagaaaggtaaagaaggtattgttgagaacaaatacggctggatgcacttttgrggtgcaaatttgtctcttctctgtgtcagttgtatctccccaaagcaaggaataagtgctggagttgagtgcgtcagagcagggcttgtggcaaggcaggaagaggctgcacaaagcacagatgtgcagtttcattagtcaatatggaggaatcctgaggtacccactggctatgttgagtaaaggaaagaaaaaacaaaggcataccatgtggaaaagaagaaataaaactacctcttttgggagtatctggaaaaccctagagcagtcctgtccagtagaaatacaaaattaatatgc

SEQ ID NO: 95002 - DNA, 601 bp, Human
agttttttaccattattttaaaaactaataaacattttaatcagatctcatggacagaaagccaagattcttgtgctgcttcctaaatgcagtgggcgcatctctgtcagtttttacctgctggaaggtactcctgagtgctgtgctgagctctgcccatctgtccatcctcttgggacactcatccctttcccattctctgctctgtgaggggatggtgctagtgagagctcaggtcgagagggctggggtgctccttcgtctctcagctcatcagcagtgacttggaagacaatcaggrtctacctgtgttgttgagaagcgttacgcaagcaggaaagcgcacaagaggaaggcgcagctgagtgaagcattgcagagcccgccaggctgtgccttccacccaggccagcacacggagcgctgcagtccctgaaggcttcctcaggctcctcctgttggcgtgggtgcctgccactgacctctgtgggtgacaggtttgtcactggagcttgtatcctgcaacctgtttgtttgggcgtgcctgtttgtttgtttttaacgttttaataaactttattttttagagcagttttatatt

SEQ ID NO: 95003 - DNA, 601 bp, Human
cttttgttacatttcatggaattctggactctctgagatgcctcccaaagtgcccagctacagcctctgtcatcagggaaggagcaggtatgggaatggtgtctctgcacacctcatgtcttgcctacatccttcttcaagaaaatactggttttccccctgaaaatgatagaaattgactcatcatttttgagtctagctcaggtgtcttttctggaattgccttttttattcggtgtaaagaggcacagggacttcatatctgctatagatgagtgaaggttgcctagacatgcacacraggcccttggtggacttcccctatccctggggctcctcataacccttccctcttctcttccctggactttctgggctggggccagggcttggggtcgggggtgagccttcctctcggtgtgtatctctgtgtagagttgcatggtgagattcggcttctgttctaaatgcagttgggtggaaataaagcagggatggtcctgagtcacccacattcctcttggtcagtctgccctggtgtgaggagctggcagcctctgcagacctttggtcccacttcccatttgggggatgtaggctt

SEQ ID NO: 95004 - DNA, 601 bp, Human
tgctgagttggttcagtctgggtcacagagtgagtgaatgctgggccgctgtgatgggaaagctgtctgctgaattggttcagcagtgcacctgcttcctcacggggcattagccggtcagggcgatgtctctggatcactcaacttgtccctgacagagcaaggaataagaaacccagttagattgtctgtatcatcagatgccatttacatcccagtcaaattagcagccagatcactgatttcttataggtatacatcttttgacttcagcataatctcttcccctttttctgcatcyttgggttttaaaggatgtttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgtttgctc

SEQ ID NO: 95005 - DNA, 601 bp, Human
tgcatccttgggttttaaaggatgtttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgyttgctcatcttttaagggtatttcttccccctgcaaagcaaaatgctgaagagatacatatttgttaattaactgatttcaccctcgtcatccatcctctttccataaggaactgtatgttgcattcttgctgagtgcagactaagtcctttgtgcaaggttgggtcatcctggggtgaaaaggtaagtgctttcggggatgctgattaaggtggtatctgctgtgcctctctcagtgtccccagggcgaaattcctcaggttacagtggcaggaacagctgcttgagctcatttttgtc

SEQ ID NO: 95006 - DNA, 601 bp, Human
tttactatgtaaatgtttaacatgtttactatttaaacttaatagttgaggtagcttttaaaatttgtgtccattaaacccaaggactcttgcagaagtcgtatggtttttcttctttcatctataatgcatgtaaggaattattcacttgctctaaagttcaaatgtgtgagtttctggtgctgttacataacacgtggtattgtgggtcaaggggagttagtgtctcacctaaaatctggggccatgatgtcaccacattaaatagtagggatgtttgctcatcttttaagggtatttyttccccctgcaaagcaaaatgctgaagagatacatatttgttaattaactgatttcaccctcgtcatccatcctctttccataaggaactgtatgttgcattcttgctgagtgcagactaagtcctttgtgcaaggttgggtcatcctggggtgaaaaggtaagtgctttcggggatgctgattaaggtggtatctgctgtgcctctctcagtgtccccagggcgaaattcctcaggttacagtggcaggaacagctgcttgagctcatttttgtcttctgaacaggatcagtcttggaa

SEQ ID NO: 95007 - DNA, 601 bp, Human
aagttggtttgctttttgtgccagctttttaggcttacaaaatgttgtgtgtgtgtacataggaaaaatatggaagggtacgtacccactagtttgtgtcagcactggattctggcatatataatagatgaggagtttctgttatgtatatgggatttctgagatacacaggggttttctgtgcacatctctctataacgcagctgtcccgtcacatcctgcatgtcagtacaggtagtgccgttctcttcgtaggactgtgacactttatctttgttctttcacagttaaaaaaaaaaamgcttctttaaaattctgactttatataactaacgcaatgctcatgctacttcacttgttacaagaacatattattctgtcctatagatgtactgcagttatttaatggatcagctattgataagggggcccttttaatgtaactattttaaaaaatggaagtaataccagcacatggtaaaaaacacattgcagctcatgaatgggtataaattaagttggagatttcctctttctccctccccaccccatgccccgtttccagaggtaaacaatgtacagtttgtgttttcttctctta

SEQ ID NO: 95008 - DNA, 601 bp, Human
gagatagtggggtataaacccattgtggaaaccccttcagcttgacaaatttggagtcatgctattttcagaagaggatttcctgcgactaggagcagtcacccagagaaagctctggaaaggtggtggtgctggggttgaagatgagctgctggcccctggcatgtcagtgggcggaggtgggagacgtgcagagctgcctatcccacagtacttccctttccccatccaccctttcaggtggctcactccccaccagtttcgcaggatggctcaaggcaaatggagaaaacggcacagrttgaaactcttggccgtagcttgcgagcttgcctcttagcacctccaaccacgatctccttgaatgtagtctcctcagtctctcttttttgtgtgaggaatataaagtttctagttgccttttcgcataatctcatagctcttctgcacctgtggttccttagctcttatctgagaccgtggcaggcagacagctggttgcagtggttggttagttgtttcatatggttgatcatacagcagctacttggtcccattgttattgatagtattgtataaaatcagttgtcattgctggcat

SEQ ID NO: 95009 - DNA, 601 bp, Human
tgtaactctcacccaggttaaatagacactgtgtacctcacagtttccttcatgctcctccctgatgataactccccctcatccatatgacacatctaatatatactacgtgtgtgtgtgtgtgtgtgtgtataattaattataattattattattttgagacaatgttttgctctgtggcccaggccagaatgcagtggtgtgatcacagttctctgcagtctcaacttcctaggcataggtgatcctcccactgcagcttccagagcagttgggattacagacatgagccaccactcckggctaattttgtttactttttatagagatggtgtctccctgtgttgcccaggctgttcttgaactcttgggctcaagcgatccttccgcctctgtctcccaaagtgctgggcttacaggtgtgagccatcgtgctggcctttttgtttgtttttgagacagtgtctcactctgtcactcaggctggagtgcagtggcaggattatggctcactgcagccttgaactcccaggttcaaacagtcctcccgccttagcctgctgagcagctgacaccacaggtgcacaccagcatgcctcgc

SEQ ID NO: 95010 - DNA, 601 bp, Human
ctgcagtctcaacttcctaggcataggtgatcctcccactgcagcttccagagcagttgggattacagacatgagccaccactccgggctaattttgtttactttttatagagatggtgtctccctgtgttgcccaggctgttcttgaactcttgggctcaagcgatccttccgcctctgtctcccaaagtgctgggcttacaggtgtgagccatcgtgctggcctttttgtttgtttttgagacagtgtctcactctgtcactcaggctggagtgcagtggcaggattatggctcactgyagccttgaactcccaggttcaaacagtcctcccgccttagcctgctgagcagctgacaccacaggtgcacaccagcatgcctcgctgagtttttaattttttgtagagatggggtttccatgtgttgcctaggctgatcttgaactcctggcctcacgtgatcctcctgccttggtctcccagagtgctgggcttataagtgtgagccactgtgtttggtaatatcctatattttgaaataatactgtccttttctttttaattttaccatgtaagaatgcatccccaatcaatgtagtt

SEQ ID NO: 95011 - DNA, 601 bp, Human
ctcagccttctgagtagctgtgactacaggtgcacgccaccacacctggctaattttctttattttttttgtagagacaaggtctcactatgttgccaggactgatcttgaattcctgggctcaagcagtctgcctgcctcggcctcccaaagtgctgggattccatgcatgagctactgcatctggcttctaattctttaatgtttgtagttttgtcagattttctgtttcctcctgagttagtgttaataagttgtatttcttttctttttaaatggtgatgtgtgtgtgtgtgtgtgagtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctccgaagtagctgggatgacaggcgtgtgttactacgcctggctaatttttgtatttttagtacagatggttttgctatgttgctcaggcttgtcttgaactcctgggctcaagtgatccacctgcctcagcctcccagagtgctgggatgacagacgtgagctaccgc

SEQ ID NO: 95012 - DNA, 601 bp, Human
tcagccttctgagtagctgtgactacaggtgcacgccaccacacctggctaattttctttattttttttgtagagacaaggtctcactatgttgccaggactgatcttgaattcctgggctcaagcagtctgcctgcctcggcctcccaaagtgctgggattccatgcatgagctactgcatctggcttctaattctttaatgtttgtagttttgtcagattttctgtttcctcctgagttagtgttaataagttgtatttcttttctttttaaatggtgatgtgtgtgtgtgtgtgtgtrtgtgtgtgtgtgtgtgtgtgtgtgtgtgacagggtctcactctggttgcctaggccggagtgcagtggtgcaatctcagctcactgcagcctcgaccattcaggctcaggtgatttctcacacctcagcctccgaagtagctgggatgacaggcgtgtgttactacgcctggctaatttttgtatttttagtacagatggttttgctatgttgctcaggcttgtcttgaactcctgggctcaagtgatccacctgcctcagcctcccagagtgctgggatgacagacgtgagctaccgca

SEQ ID NO: 95013 - DNA, 601 bp, Human
acacagagtggagcctttcaggctggcatggagagcttaaggggcaactgaaggagacacactggccaagcgcggagttctgcttacttcagtcctgctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccrgcacagatgatctgttactgttggttgatttctaatcttactgcagccttagctcacccatgagtccctcctgcttgttctggggtggtgcctgctgccctccagtggcatgtgtggcacctgctgccctccagtggcatgtgtggcacttgctgccctctttggggtcagttcaccatttattgagtcagtgcttcatgccgggcactagacttggtgaaagccttttaccatcaattattattttcttaggagtaattaaaagaaaattttcctgtaatcccagcacattgggaggct

SEQ ID NO: 95014 - DNA, 601 bp, Human
gctgagatactctctcagtccgctcgcaccgaaggaagctgccttgggatcagagcagacataaagctagaaaaatttcaaggtgagtaaaaacctgtaaagatctgatcaaatctgactggtagaaatgcctttttcttgatataaaccgcttaattaagccttttggcttgcctttgaaagatgctttattgaatacttcccggcacagatgatctgttactgttggttgatttctaatcttactgcagccttagctcacccatgagtccctcctgcttgttctggggtggtgcctgcygccctccagtggcatgtgtggcacctgctgccctccagtggcatgtgtggcacttgctgccctctttggggtcagttcaccatttattgagtcagtgcttcatgccgggcactagacttggtgaaagccttttaccatcaattattattttcttaggagtaattaaaagaaaattttcctgtaatcccagcacattgggaggctgaggcaggcagattacttgaggccaggagtttgagaccagcctggccaacgtgacgaaaccccatctctaccaaaaatacaaaaattagccaggtg

SEQ ID NO: 95015 - DNA, 601 bp, Human
ttttatataatataactgtgcattggagaaatgaattatttataatcctttgcaccaataaattgttcttaaaagcatagaaaaaataatcaggccagaaggagatatctaaagcatgtgctgagaaagcaaaactgaagagctggaaattataaaatattacgacatgatgagtcatatctcctcctcctgattctgtgttactaaatgctagctgcgaatagaaatcgtgtatttcctttctttcataaaataagagctaatttcggcagcaaacagtttggcgtgttattcttttccyttttcagggtggtttaaataaaaataaataaacatgaaagattttggctggaacatctttggaagcacggccgtcctcagcctcactgcactgtctggtttccctctgagcctccctcccgggtcctgccttagtgctgtctgtgccgtgtagccacaggtcgcactgcagggctgtggggagttatttttagtttcaggcagactcactgtttttgcctttctttttgcttgaaaagactgaagttatttcttgtgtttttatacatgagattatcttctgaggctggaacatcttggg

SEQ ID NO: 95016 - DNA, 601 bp, Human
ccttttgtgcaggacagttctttgtttccggggtggccctgctccctccaggaggtttaggagtgcccatgtcaccatgatgcctacgccacttctcatgttgctacctgttgctaccaccgggcatcgctgccgcctcctgctctgtgcacagtgtggtgtggccgcctgaccgactggtcaggaactaaagttctctcgaagccttgactgaaaggagaagtgaggaggggcatggagcccagtgccaagaggcagctgcgtctttaggggctggcacttttcagaggggctcttgggrccagaaggaaagagccgtcattcaaggcttacacagcgtggaggtgccctccctggggtgtcctgtgtgctgacctctgtcctggtgcctggcggtgtcctggcgcagagctccgcaagcctctgcggggctcttctctgtgtggaggttctcgagatgggcagtccgggtggatggtcaggccaatgagggccttcgaatgaagcacattattgtaaggatgctaattctggatcctcagatattgtgacaaaaacttgacatttttcttccttcaaagtaatttattgactaaaataa

SEQ ID NO: 95017 - DNA, 601 bp, Human
ctgtcaccaggaagctgtcagtgtggtgttgggcctgattgattcgcatcagctcaggtggcgtcctattggaaggtcggcagtgggagagcagctggccaggtcagaggattcatttctgtctgaagctttgtgaggaactaagatggcttttccagtagcctctgtcattccagagagttttaagattgcttttatttgttcttctaccctggaactaggaagccagacccaagaaatgtatccacaccaggttttgcccatagtttttaaaaatgttgaatttctttaacttgaggcyctcacaattttctgggcccccataagttatagaacagggaccaggcctgctaccttgtgggggctgggtgggcactggctccccagggcacagatccttcctgtgggtgggcttaggggatgtgagggattcactttcagatgtgacactccagatgtggggttggtggcacattttttttgtccggttacatccaagtaaaaaggaggacaaattcttactgaacctatgcagtaaactccattgtcaggaagagtaaagtgtcttagcatgagtgttcctgaattctgaaagttcagg

SEQ ID NO: 95018 - DNA, 601 bp, Human
gacttgaatagataagaatttaacaaaatacacactgttgggtgtaaaatcataaatatctgaagttcttagaaattggtaattttcttttagctttgctgtgctctgagcatgactaaactaaaagtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattccccygtgtaaggtgctggaggctgaggttccagcctgcagccgcttgtgatcctgatatgtggagagttctggaagactgatgactgctgacccccttcttaacctacgccatcgccatgctggtggtggggatggggctcttggccattcctgccccttggctgcccttccttggtctgagggtacgtgggtggcccttcgggtgtgccaggagctttgtgctttagtgaccaacagtcccctgatgtgtgaaggcccatcaatccgatttaaaataaaacatttgaagtctcttcagaggac

SEQ ID NO: 95019 - DNA, 601 bp, Human
aagtgtgttttgtggccagctttagtcacaaaagagacagaaaatgagcctttcatttttgtggcacccttggtagaggggtaggggaaagggcttcaggacgagcactggatcagcttaccaagcctgaaaccacgccccctgctggtcatcctagagactgagtggcccatgtgctcgtggcctgtgggccctgggcggcctctcagtttcctgcatggaaggcagcagaagcacttatccggccctcagctcctcggtggtgtcagtttgtctgacctctgtcagtttgttgtcttcttttttttttttttttaagacagagtctcgctctgttgcctaggctggagtgcagtggcacaatcttggctcactgcaagctccgcctctcgggttcaagcgattcacctgccacagcctcctgagtagctgagactacaggcgcatgccaccatgcctggctaatttttgtagtttttgtagagacggggttttgctgtgttgcccaggctggtcttgaactcctgggctcaggtgatccacccatctcagcctcccactgtgctgggattacaggcgtgagtcactgctcccagccttg

SEQ ID NO: 95020 - DNA, 601 bp, Human
acaggcgcatgccaccatgcctggctaatttttgtagtttttgtagagacggggttttgctgtgttgcccaggctggtcttgaactcctgggctcaggtgatccacccatctcagcctcccactgtgctgggattacaggcgtgagtcactgctcccagccttgtttgtcttctgtgttaccaaagtagaaaacttcttctgttctgtaaccttggttcaatcaaagttccaaattcataaatggcacttatattattatgacgattgctgaaagtcatgccacagtttaatttgctttawacttggatttggtatacttgattttttggttctgttttctctttttcctgatttccttgatttttttggttccgttttctctttctcctggtttccttgattttttggctccgttttctctttttcccatattcttgcctggcatggagtggtagagcagagtggggaatggagttgagtttggatccagcggtcgagcaagtgtctcaactcccatgctcagcttcctcctctgtcacgtggggcagggaaggtgcctgtcgggcgcagcgagcgtggtgagtggtagtgtggggccgc

SEQ ID NO: 95021 - DNA, 601 bp, Human
gcgtggtgagtggtagtgtggggccgcgtgcgcccgtgggccctgagcatcagcacttctgcctctccgtgttctcttgttgagagggaccactgcctttcttatgctatcgccagccttttccagcttattcattctgtttcttggaacccatttaattcattcttcttgaaatatgtgtattttctattttatttcaaattgagacttacctttcttatagaatttgttttcttctgggatctcttgatttttttaaaattggatttactgaggtaaaatgtacagacaataaaactcytttttttttttttttttttttttttttgacacagagtttcgctcttgtcacccaggctggagtgcaatggcatgatctctactcactgcaacctctgccttccaggctcaagcgattctcctgcctcagcctccctagtagctgggattacaggcgcccgccaccatgcccggctaattttgtatttttagtagagatggggtgttgccatgttggccaggctagtctcaaactcctgacctcgggtgatccacccacctcaacccagccaaaaatcattcttctaaagtgtgcactcta

SEQ ID NO: 95022 - DNA, 601 bp, Human
tgtgaggtacaggtccgcccctggcagcccatgccttgtagcttctgggtggctcctggcttggttgctgtggtgtggagcgttgagtgacctctgcagaacagcagatggtgctgtagggccgcttctaagactcagtggaggaggctcagtggcgttctgagcggtggccaccaggacaaacctcttgtctttacaccatctgtgtgtgtgtgcgtgagtgtatgtgtgtgtgcattccagtgtgcgtccagaagccagtttccttcagaaagctttctgttccctggcttcatttttrccatttagaggacctgtgaagcaatgagatggaatacttatagctggtttaattcagtgagtgatctgaattgtaaataaaattttatcaagtaatttataaatttgatataataaattaagtctgcggaaggggctgattgtgttatggaatgagaagttttgtacatcttttgcaattctaaaaattgtggccaggtgtggtgctcaagcctataatcctagaactttgggaggctgagacaggaggattgcttaagcccaggagtttgagaccagtctgggtaacatggtgaacccc

SEQ ID NO: 95023 - DNA, 601 bp, Human
attctaaaaattgtggccaggtgtggtgctcaagcctataatcctagaactttgggaggctgagacaggaggattgcttaagcccaggagtttgagaccagtctgggtaacatggtgaacccctgtctgtacaaaaaataaaagtaaaaataaattagccaggcatggtggcacatgcctgtagtcccagctactcgagaggctgaggtgggagaattgcttgatcccaggagacgggtggcaatgagccaagattgtgccaatgcactccagcctgggcgacagagcgagaccctgtctyaaaaaaaaaagttgtgactttgctgtgtagtctttgtgtaacataattttatgattctattgttttaagcttaatattccaaataggtaataattatgttaaaatgcaaaaaattagcctatactctcatgatctaaatatgtagtagtggttttacagaatatatttcaaaggattgccattctgttttatttttagtagccagttatagaaagcattatttttaaataatgcctaagaatctttaaagaaatacctgtcaatgtatgttccagtttagtatcaaatttatattcagag

SEQ ID NO: 95024 - DNA, 601 bp, Human
cattttaatctaactttttatatgaatgtagaacaaatatcaaacaggattatacagtgtgatagtcaggaaagtagcatgcttttgtgttttatagactagtctaaaaggagccccagtagacttggtattgttaaaccaaggagatcttgagaactgttctgtctcccttgtgcccatagaattgtagcctgtggaggtgaccaaggaaccagatcccaagaggcctctgccactgaaaggagatttttattacttgcgtttcctagacgggggggcactcgcgccaagcaggcccacrgggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggc

SEQ ID NO: 95025 - DNA, 601 bp, Human
tttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttayggtttcggactacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgat

SEQ ID NO: 95026 - DNA, 601 bp, Human
tgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggackacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgataggaagttgca

SEQ ID NO: 95027 - DNA, 601 bp, Human
tcttttaaggtaagagttacaatggagatggggaaattatacttttctcatttcaaggaaagcaacagtcatgagttatgcatcagttgggaaacgggatgataggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttccygtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaat

SEQ ID NO: 95028 - DNA, 601 bp, Human
catccgtatttaacaggagatcccgaactcccagcagggagctaagcacagatgtgtgcacagatgcgtgcttaggtaaggattttgtgcaaggtgacttgtaatatgaaactgtaaaacgtgctaccttagactggagagagaagggggtggtctgatgttttccacacgcctcttttaccaaaatgggtcatcttatctgtctcaggccaggcccccgggggtgcacaggaacagcacagctgcagtgaaggaggggctcctgcagccgggctggccccagagctgtgggtcgtgcccygcgtgttgctcagcgcgttctgcagttgccctggccttagtcccccatctcgctgtgatagccatgcaggtcagcaactgtgagccttcctggctcccacgctgcccccggcacctctctctgtttctgctcccagcatcctctcagcttctcttctgagccccacgcagcggttcctgctttaccagcaccacttctcctctgtcaccgagagagagcaagaggctgccgcgcctgtgccaactgcctggtgaggctccgtcgagtgatgtgcagggccttgcggtacagccctctcga

SEQ ID NO: 95029 - DNA, 601 bp, Human
cagcaatcttgtaatagtaccttgtaatataacaaaggtgacagcacctaatggaagtctgtgtctgggagtggggaacccctgaccctgggccctctgtgcaccgtgctgccaggtgcttgtgtccagggctggggatgccacaccctcgatgctttcctggactgacgggcggtctcaggacagccaatctgtgcggccccctctgccctcacctcaagaggtcacagcattggcctgtttttgtttcctcagttaagctttggaaattgagatgtcactaagacaggcaatagggagyaaaacaaaggcacaggcaaaaactaaaggacatttttaccaaataccctcaatttagaattaccaccacttttcccatggacactcatcactaattatttaagttgggaaaaatattgagaagtacaagaataattctgtcatcattcttttggaatttactgtgattcaagcttaaaatgtctttttcatgcattccataatctcattctgcagtgggaaaaccactctcaaatatgttgcattttcagaccaaggttataagaaattgagagggttataagatgtaacaatgaggccc

SEQ ID NO: 95030 - DNA, 601 bp, Human
ttagggtcattgtgttgttaagtaatcgacttacatagaaggtgtgcacctagaaggttaacagaaaacaagttgaaacatgactgaaaatatatttctgtaagaattactgtaattcttctgagagtataaatagccagggttttaaagatctgctttataggatttatactgcaaataacttggcaggattaattggcctgcatttgcttgctgtagtcagtaccatctagtgttttagtcaatatcagtttttgtagtgtggatgaggctggtgatggcagctgcagcctgtctggarttgctgctgccgtggtgtcagctgcagcgggggaggctagggctctgtgctccgcaagttggtgggaaccgggaacaggtggaagccccacccccttccaagttggaggggcaggagccccgccatcctgggcacagctgcagccgtccattagaagctgtggacccaggcatccctgcactcaccggggcccaggaagcccccctgccccgacaggctgagaagtgcctgctcccactgcttggtctctccccactcccagcacctgctccagtttcagatcaaagttgtggccgagct

SEQ ID NO: 95031 - DNA, 601 bp, Human
ttgtggccgagctgggacactgtcacaacctggctgggtgtgtgtttgctcagggcagtgctgacatgccagcaccctgctgcctcggcacccccagactttgggtgctgacaagcatgagagggaggccaacgcggggctgagggaagcacagcgcaggccttgcagccgcccctcggcaggaacactctggatgccatgcacactgtggatggcaggataatggtggccggaggcagacaagctcctgggaagaaaggggagggtccctggtgaaactccaccttcagcttacagaggrcttaaggcctggggcccaggctgtcagttccacagaccggagtgagaacttacggtgcttttccagggctcacccgtgactgcccatgcaccaatcagcacacactttcctctgaagcccataaaaacccccggactcagccagacttgggcagaagacaggacgacctgcttatggagaatagctgcccactgtgggtctctctgagctgttctgtcactcaatgaagcacctcttcacattgctcaccttccacttgtccacgcacctcattcttcctggacatgggagaagaactca

SEQ ID NO: 95032 - DNA, 601 bp, Human
gcagccgcccctcggcaggaacactctggatgccatgcacactgtggatggcaggataatggtggccggaggcagacaagctcctgggaagaaaggggagggtccctggtgaaactccaccttcagcttacagagggcttaaggcctggggcccaggctgtcagttccacagaccggagtgagaacttacggtgcttttccagggctcacccgtgactgcccatgcaccaatcagcacacactttcctctgaagcccataaaaacccccggactcagccagacttgggcagaagacaggaygacctgcttatggagaatagctgcccactgtgggtctctctgagctgttctgtcactcaatgaagcacctcttcacattgctcaccttccacttgtccacgcacctcattcttcctggacatgggagaagaactcaggacctgctgaatggcaggtctgaaagagctgtaacacaaacagggctgaaacacacccattgtttgccacattgcaggcaatgaggagaggaggagagaaggagagaagagctgcagcccttcaaggagcccagacctaggagctccctgagccagggcagtg

SEQ ID NO: 95033 - DNA, 601 bp, Human
acctgcttatggagaatagctgcccactgtgggtctctctgagctgttctgtcactcaatgaagcacctcttcacattgctcaccttccacttgtccacgcacctcattcttcctggacatgggagaagaactcaggacctgctgaatggcaggtctgaaagagctgtaacacaaacagggctgaaacacacccattgtttgccacattgcaggcaatgaggagaggaggagagaaggagagaagagctgcagcccttcaaggagcccagacctaggagctccctgagccagggcagtgaygccccctttggggccctgcggttcctggtgtttccaagcttctgggcactaccgtattccctggtttcagccatggaagctgtgtgtggtatgcctggttcagctgcagccttgcagggagccagtgtccatgccagtgcctaggtctgcccgtctcacctgcctggctgtacacaatggctggaccccacgcccactcactcacacaccccttgccactccacacctggctcccccttggcaggcatgggatccaggctggaagtgtgagccgagcgcagcctgccaggctgtgtgggc

SEQ ID NO: 95034 - DNA, 601 bp, Human
catttacaaatatttctgatttaaggacttagaggtcagttcgtatacagtcaagtttagatgtgttttggagaaagtggatacagcccacaaggtcccaaaaggcaacagggcacaggtaacattccctggctgtgattagttggttgaggacatcacaattggaagcatccacgttcttcctcacaggaagcacttggctgagagctgtggacactgaggatgaggcttgagtctgtcctagcagagctcagggcctggtgggaaaagcagggtggtcaggccagcgggggagtgagcrgggaggggcaaccagctttgcacaaggagccaggaatctcccccccacctccaccctgcaccaggggcgctgactctgggccctcaaggccccccactggggacgctgactctgggccctcaaggccagtggcatccacagctccatccacagcagcgagccttgtgcagtttcaccacaatagtagcacatgtgtgacctcctgggggctgctggggcctatgggagtcgggtgtggacggtgtgctccctgggcctgctcggggatgctgagtaccaggcagcagtgagtggggtgac

SEQ ID NO: 95035 - DNA, 601 bp, Human
aagttcaatgttcttccacactcaccacctcccagctctgtcttcttactgcattaggaggcattctgagaaatgaagaggttgttttgaatattgctatcaaataagtcttttttttttaattgaccattcttggaattttgttccataggggatatttgatagggttttaattcttatttgtttgtagttcaggtcataagaggttcttttaaaaagggaagaaaaaatagctctgtgaaatgtgctaaagtgcttgcatgtgctgttttgctttgttttataacctttggtacaagarttggcattcgtcaaaactgaaaacgttggcttctgctctgcaagagatttgtagctcccattcttaatgtgggcggtacctgcaggtactcacctgccaccacactcggcatgactattttctactgcgagacattttccatgtccttttaaaagaattttaatatgtaagggcaggaaaacaaagtgaactgtatgaattaggtgaactacatgagctgggctcactcctgtgcctctgcacttttattgttgttgtaaagtttgtttttcctggtcccagaaatctgagagaagtcag

SEQ ID NO: 95036 - DNA, 601 bp, Human
tctgtcttcttactgcattaggaggcattctgagaaatgaagaggttgttttgaatattgctatcaaataagtcttttttttttaattgaccattcttggaattttgttccataggggatatttgatagggttttaattcttatttgtttgtagttcaggtcataagaggttcttttaaaaagggaagaaaaaatagctctgtgaaatgtgctaaagtgcttgcatgtgctgttttgctttgttttataacctttggtacaagagttggcattcgtcaaaactgaaaacgttggcttctgytctgcaagagatttgtagctcccattcttaatgtgggcggtacctgcaggtactcacctgccaccacactcggcatgactattttctactgcgagacattttccatgtccttttaaaagaattttaatatgtaagggcaggaaaacaaagtgaactgtatgaattaggtgaactacatgagctgggctcactcctgtgcctctgcacttttattgttgttgtaaagtttgtttttcctggtcccagaaatctgagagaagtcagccttctcaggcaaaccaattattgattaattatgta

SEQ ID NO: 95037 - DNA, 601 bp, Human
gttgttgtaaagtttgtttttcctggtcccagaaatctgagagaagtcagccttctcaggcaaaccaattattgattaattatgtataagaattaaattagccatttgtgtgtcttctgcctattattaataaactttttattttgaaggctgggtgcggtgactcatgcctgtaatcccagcactttggaggtcaaggcaggcagatcacctgaggtcaggagttcaagaccagcctggccaacatggtgaaaccccatctctactaaaaatacaaaaattagccaggcatggtggcacrtccctgtaatcccagctactcgggaggctgaggcaggcagcttgaacctgggaggtagaggttgcagtcagccgagatagcgccactgcactccagcctgggtgagcgagattctcaaaaataaaaaataaaaaatactttttattttgagataatatagattcacatgtagttgtaagaagtaatacttatatgaacgtaagccttcatttctctgggataaatgcccaggagtacaattgctgagtcatgtggtagttgcatattttatttttaagaaactgccaaactactttctag

SEQ ID NO: 95038 - DNA, 601 bp, Human
tattgattaattatgtataagaattaaattagccatttgtgtgtcttctgcctattattaataaactttttattttgaaggctgggtgcggtgactcatgcctgtaatcccagcactttggaggtcaaggcaggcagatcacctgaggtcaggagttcaagaccagcctggccaacatggtgaaaccccatctctactaaaaatacaaaaattagccaggcatggtggcacgtccctgtaatcccagctactcgggaggctgaggcaggcagcttgaacctgggaggtagaggttgcagtsagccgagatagcgccactgcactccagcctgggtgagcgagattctcaaaaataaaaaataaaaaatactttttattttgagataatatagattcacatgtagttgtaagaagtaatacttatatgaacgtaagccttcatttctctgggataaatgcccaggagtacaattgctgagtcatgtggtagttgcatattttatttttaagaaactgccaaactactttctagagtagctatcccattttacatttctgccagcagtctatgagagatcccttttctccacagcctcatttc

SEQ ID NO: 95039 - DNA, 601 bp, Human
tttatttttaagaaactgccaaactactttctagagtagctatcccattttacatttctgccagcagtctatgagagatcccttttctccacagcctcatttcacctggggctgtcactatctttaaagcaacactatgttgaatagcccttctcggaggtgtgcagcggagttatctcacggtagttctcagctgcatttccctagtgactcgtgatcctgagcatcttttcatgagtttattttccatctgtagatcctcttcgtgtcctttgcccattttctaattggactatttgtwtattttactgttgagctttgagaatttcttatatattctatttgttggatatatatttttcaaatattttctcccagtctgtagcttgttttttcatctttttaacagggacgtttgcagagaaaaagtttttaacttccagtttatcagttgtttcttttgtggattgtgcttttggtgtgaagtctaaaaactctttgcctagccctagatcctgaggattttctcctgtaactttctaaaagttttatagttttatgttttgcatgtaagcccataatctattttgagttaagtttt

SEQ ID NO: 95040 - DNA, 601 bp, Human
tgaggattttctcctgtaactttctaaaagttttatagttttatgttttgcatgtaagcccataatctattttgagttaagttttgaataaggtaggagacctgaattgaggttcatttttttggatctctagttgccccaataaggctgtgcctcttcacgaaattgcttttgcacctttgtccaaaatcagttggacatatttgtgtggtgtattcggggttctctgtgctatcctcttgtgatctgctcgtctgccccttgccaacactgtaccgtaccgatgactgtagctttgtartaaatgctgagatcagctagactgattgctcccactttattttttttttatggtggttacattaaagtctttctaagagaattctaacacctgtgtcatctccgtgttggcatctgttcattgtcttttttcatttagtttgatatcttctgtttctcgatgtgacaagtgattttttattggaacctgattatatgatattatgagactctaaatcttactgaagccttctgttttagctgactttctcatacaccacggtgtcagaggaagcggggatgctgtctcattactgctgga

SEQ ID NO: 95041 - DNA, 601 bp, Human; identical to SEQ ID NO: 37994

SEQ ID NO: 95042 - DNA, 601 bp, Human; identical to SEQ ID NO: 37995

SEQ ID NO: 95043 - DNA, 601 bp, Human; identical to SEQ ID NO: 37996

SEQ ID NO: 95044 - DNA, 601 bp, Human; identical to SEQ ID NO: 37997

SEQ ID NO: 95045 - DNA, 601 bp, Human; identical to SEQ ID NO: 37998

SEQ ID NO: 95046 - DNA, 601 bp, Human; identical to SEQ ID NO: 37999

SEQ ID NO: 95047 - DNA, 601 bp, Human; identical to SEQ ID NO: 38000

SEQ ID NO: 95048 - DNA, 601 bp, Human; identical to SEQ ID NO: 38001

SEQ ID NO: 95049 - DNA, 601 bp, Human; identical to SEQ ID NO: 38002

SEQ ID NO: 95050 - DNA, 601 bp, Human; identical to SEQ ID NO: 38003

SEQ ID NO: 95051 - DNA, 601 bp, Human; identical to SEQ ID NO: 38004

SEQ ID NO: 95052 - DNA, 601 bp, Human; identical to SEQ ID NO: 38005

SEQ ID NO: 95053 - DNA, 601 bp, Human; identical to SEQ ID NO: 38006

SEQ ID NO: 95054 - DNA, 601 bp, Human; identical to SEQ ID NO: 38007

SEQ ID NO: 95055 - DNA, 601 bp, Human
actgataggttttaaaactgagacaaaatagaacattttctagaaaagtgtacattgctaaaagtgacttaagcatatgcagaaaattggaatagaactctgcctattaaatcacacacacacacacacacacacatacacacacacacagagaataaattaagaaaatagaaggaaggagagtctgtggagagaggggaagtggttggcccagacaacattgagtgagttctagacatcgtttgtgggatgatgatccccattttatgtaatattttccaaggatagaaaagtagggaakaattctgcagctcattgtgtggctcataactcaaaggttactacaacctttatctccacaccagacaaggacagtaaaggaaaacaaaacaacaacatgtcatggaaatacacatttatacacttacattatctttaaaaatttagcaagccaaattctattttatattttttaaagcttcattaattcctcttaaatctatcatttcaatgtgattttaataaaaatcttattttttcatagtacttaaaagttgaatcccaacatggcaatagaaaactaacaatataaaaccatagt

SEQ ID NO: 95056 - DNA, 601 bp, Human
tcatggaaatacacatttatacacttacattatctttaaaaatttagcaagccaaattctattttatattttttaaagcttcattaattcctcttaaatctatcatttcaatgtgattttaataaaaatcttattttttcatagtacttaaaagttgaatcccaacatggcaatagaaaactaacaatataaaaccatagtaatcaaaagtgagtggtaattttcggcagaacagtggcacaacatacaatctgaaaagacctgcagacccatggggcagcactggtgatcaggcctgccygtgtttaaaagaaaatgtaaactagatggaggcttgtctctctcacagaaaattaagtccaaaaataggtggcccagagaagctctggtggctccatggtctggagcctgatccctctttgtcccgcaccatctaagaggtctcttctgagttcagggtcttcataatccctagagctgacgaaatccctgagtacccagtctgaattccaggcacagggacacttcagccagctcagctcatcatccagagctcaggcacagggctccactcgctatggggcagctggggtggccgggc

SEQ ID NO: 95057 - DNA, 601 bp, Human
tggcaagggggccagagcactgtgttgggcagactcaaaggcacgcacaggaagggggatggctttattgtagggaaagggggaggctttgggtatgttctgatggaggtaggggaagccaagatgggctctgcagaaggtggcctcccgtgcagctgcttgaagaacccaggggcatctctggctggtcctgggttgaaagcaggaaggaatgggcgtggggcaaccactaggaagctgtagtccttcctgaaagcctggctgactgggccgagtgctgtggaggctgtggtttgggtcrgagtagttctcctgccctgtgtggtctggccgacgtctgtctgcagctcagtctctcaggccgggccctttactgaatcaggggacagatcagatgatagcagtctggactctgttcctaaagaaatggcacaaggaaaatgaaagacgaagaaggccaggcacagatgcctagacccgggtgcactgagccgaggccatgctgtgagagtggggacacctgtaggttccttgggtgtcagccaaacacacttcatggcacgctgtgagtgggcacctcccatggggtccgcaggacagg

SEQ ID NO: 95058 - DNA, 601 bp, Human
aatcaggggacagatcagatgatagcagtctggactctgttcctaaagaaatggcacaaggaaaatgaaagacgaagaaggccaggcacagatgcctagacccgggtgcactgagccgaggccatgctgtgagagtggggacacctgtaggttccttgggtgtcagccaaacacacttcatggcacgctgtgagtgggcacctcccatggggtccgcaggacaggtggctgtggacatgtagtgggtatctctaggagacgtcctgcctgcagtcttggcagagctttacttgttttattygcatggacgctgactgtgtctgacaccctctcgctggcgctaggcgatttcatcctgatgaagtttgtcccagctgtcctttgtgaggtgcattagtggaagctggtgccacaccatttcccacccagggcctctgcagagctgtagacactcttggaattctctttcaaagcatacgttcagaattaatgactcctaacaaatgaaggtttctgcaggatcactgctttaaagtttgcccagaagacctaattcagcttaaagatgctgagtccatagaggcttctaatctgtagaaga

SEQ ID NO: 95059 - DNA, 601 bp, Human
tgaaccctgtacgtgctggtatttttcctgtaagtaccttcctatataaagtttaatttatgattagacacagtaagaaattaacagtcactaataataaaataagagtgacttgaacacaagcacagtgatgctgtggccatcaatcttatcaccaaggcgactgctaatgggccagcggcatctgcaacgtggatggttcacatcccgggctggacagcacaagatcgcaccacactcctcagaacggcatacagttgaaagtctggaagtgtttatttctggaatttttcatttaatrtcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttcgtcagttggttgggatcctgcggaattgccagtgcatccct

SEQ ID NO: 95060 - DNA, 601 bp, Human
atacagttgaaagtctggaagtgtttatttctggaatttttcatttaatatcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgyactccttcgtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcct

SEQ ID NO: 95061 - DNA, 601 bp, Human
gaaagtctggaagtgtttatttctggaatttttcatttaatatcttcagatcacggttgacagtgagtaactgaaacctctgaaagtgaaacctcagataaggggacctgctataattaaatatgtaatttcctttctgatatttcccacagatttctcacaagaaacatatgtggctcattgattgtgggaaaacgtaatggtaaaaacaaacacagtgtaaaataacttttaagtagatttttgtctttgtgatcgtaagctgctaaatcagtctgttaactttttgttgcactccttygtcagttggttgggatcctgcggaattgccagtgcatccctgtaaccacgcaggcttgggctgggctgcgtcgacactgagtccgagctccctgaagactgtgctttcttctccctccagctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcag

SEQ ID NO: 95062 - DNA, 601 bp, Human
gctcagtggcaagtatctctagagtgtgctgatttaatctctgtcttgattttgcaatgttttcatcctcatgaatgaaaaaaacaccacctgagctgctctgtggctatcaaaagaacatcagagtccttctaaagagacccaaggtgatgtttctgaggctctccgggccttgtctctagggccttttaagtgagtctctctgtaagattaatctcctttaccaatcacaaacctagccattcatagaagaattgatgggttcacacctgtcatcccaacactttgggaggccaaggcytagtggattgcttgagcccagaagttcaagaccagcctgagaaaaatggcaaaaccccatctctacaaaaaatacaaaaaaatcagccagatgaggtggggcatgcctgtggtcccagctacttgggaggctgaggtgggaggatcacctgagcccaggaggtcaaggttgcagtgagccaagattgtaccactgcactccagcctggacaacagagtgagaccctgtctttaaaagaaagaaagaaagaaagaaagaaatgaaaaatgaaaagaatgaaattatgactgggctgggcac

SEQ ID NO: 95063 - DNA, 601 bp, Human
tactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcrcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctcgagcttt

SEQ ID NO: 95064 - DNA, 601 bp, Human
tttctgttttcctcccctttgcttttgctggaccgattaaattgtctttcccctttcttccgactggtgggaagttctaaatcttatttctattctgaccagtggttaccccaattttttaaaacaaatatgtttaaatcactttgaaaaaatgttggcatcaagaattaatatttgtaaagatccaaacttgggaaaagctgaaatattgggctcatttttattccacactcttcccatcctcatcttcctagattctgatgacatcatcttgagttttagaaactcattttatcgtgctttttttttaaaagcctttcgtaatgagtcacatagcctcatgatcaacaattgtttagatgaagccgtaagagctcctggtttctcttctaaccagttttctgtagccagtgctcctgcccttaactccacatccagatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactg

SEQ ID NO: 95065 - DNA, 601 bp, Human
aagcctttcgtaatgagtcacatagcctcatgatcaacaattgtttagatgaagccgtaagagctcctggtttctcttctaaccagttttctgtagccagtgctcctgcccttaactccacatccagatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactgtggatgtctgsgctctgccctaccccaaggacacgtcaagacctccatgccacccctccatggtcaccctttgtcacagagccagtttgagtttctttcctttctagaaggtacctccttgttttctctcctgtagcgttacatttatctattttccctaaaattcaggaatttcaacagattaagcctaggtgtgtggttagtttgtttgagtttctttcctacttactaccctgaaccctctgatctggattgttgagtcttcacttctgagaagtttccttctgtcctgtcacttctgctagaagcat

SEQ ID NO: 95066 - DNA, 601 bp, Human
gatttatttttcactttgctggaatatatccttaattggggtgacagggtgatttcttggttggttgtttttgtttggtttttggagaaaagtcctgtgtgggtggggccctggatcttgatgttacctggcccttgcctgtgtgccaggtggactggggactgtggatgtctgggctctgccctaccccaaggacacgtcaagacctccatgccacccctccatggtcaccctttgtcacagagccagtttgagtttctttcctttctagaaggtacctccttgttttctctcctgtagygttacatttatctattttccctaaaattcaggaatttcaacagattaagcctaggtgtgtggttagtttgtttgagtttctttcctacttactaccctgaaccctctgatctggattgttgagtcttcacttctgagaagtttccttctgtcctgtcacttctgctagaagcatcttctctgccctctctgttgtccctgaaaatgctgctgagcagaactcacaggcctgtgaccagtgtctctcctctcatctgatgtgcttttttgactgtactgcattctaagagaatgcctgact

SEQ ID NO: 95067 - DNA, 601 bp, Human
ctgtcagctcaagggctgcccttaagacgatcacaatgaaaggctcaaaggtgctctgctctcagcttaaatggcaggttggttttggacccagaggggctcagaggctccctcctgtgttgcatggcctgtatcatcctcactgggggtgctgtgcacagttttccttatactgtaacttatgcccaggtcttgactctttcttatttgcagaataaaggccactttcagtcgagattgtaagtacacattttccttgatccactaatgaatgtctgatagtttctataacatgaacccrtaataaccctaaaatatccattaatcattatgtatattattcatttttgattaccctactgtatgaggaacctattggaaaatacctttagggtagaaataagaaaaaacatcaatgccagctcttctgagttttttaattgtagcagttattaggccaattcacagtttctctgtgtttttgctttaaaagttctgattcagcacacttaatttacaacaacagagggattctcgttaccagccaagttgttcttgcttttattggtttctgtaccgcggcctgggattaactcattac

SEQ ID NO: 95068 - DNA, 601 bp, Human
tagtttctataacatgaacccataataaccctaaaatatccattaatcattatgtatattattcatttttgattaccctactgtatgaggaacctattggaaaatacctttagggtagaaataagaaaaaacatcaatgccagctcttctgagttttttaattgtagcagttattaggccaattcacagtttctctgtgtttttgctttaaaagttctgattcagcacacttaatttacaacaacagagggattctcgttaccagccaagttgttcttgcttttattggtttctgtaccgyggcctgggattaactcattaccctagttccctctttgcaggctggaaagataagcatctcactcacgtcagcccccacactgcactggcctcagggactcgtagacgtatgcgcttatgaccatttaggggctttctgccccagaaaaagcgtatggttagtattggaagctcgggctattttcttttttccttgtttcctccatttttgtttcaagatgggacttgatttaacttaaaatataaaaaatattttgtactattgggatcttatatttttgttaatcatttagttttagtg

SEQ ID NO: 95069 - DNA, 601 bp, Human
gataggtgtatgttgaactttttagaaaactattaacctgttttccaaaatggttgtaccattttcacattaccaccactagtgtgcgggagttgtagttctgtcacttatatgccggcacgcagtacgagcggttgctttagaaattttagcaggtgtttagtgatattccattgtgcttttaatttgcattgctctgatgactaatgaagttgaatgccctttcacatgctgatttgccatccctgtgccttcttcaataaactgttcaaaacttatgcacatttttactgagttgttyaacatcttattactgggttttgagagttatttatattttctagatacagatcctttatcagatatatgatttgaaaaatgctttctcccaatcagtggcttgtcttttaattctcttcatagtgtcttacgcaaaccacataattttaattttgacaaaatctaatttatagaaattttctttgatggatcatgcttttgatattatgtctaagaaatatttgcctaagtcagtactacaaagatttcttcttatattcttggaaattttacagttgcagtttttacatttaagactata

SEQ ID NO: 95070 - DNA, 601 bp, Human
ctcctgggcccaagtgatcctcctgtctcagcctcctgagtagctgggactacaggtgcatgccaccatgcctggttcatttttaaattttttatagagacaatgtcttcctatgttgcccagattggtcttgaactcctggcctcaagcaacccgcctgcctcagtctcccaaagtgctgagattataggaatgatccaccatatctggctgctgtaggttttttacagatgtctttatcagctcaagacattttttttttctatttatagcttactcagcgtttttaatcaagaatgtrtgctggattttgtctgatgctttttttctgctcttagatgactgttgtcattgcagtgacttaggcctatagtcccagctacttgggaactaaggcaggaggatcacttgagccctggagtttgaggccatcctgggcaatgtagtgagaccccatctgaaacaacaacaacaaaaaatgagatgagcatttagttcatttttcagtttgctagtggtgacgttaaaaaaaaattaaaccaactttgcatcttgggataaacgttatatggttattatgtgctattctttttatatattg

SEQ ID NO: 95071 - DNA, 601 bp, Human
cctgaagtttgctttgtaagaaaattctaactacaatttatttttctataatagatttagggctattcatgttatctgtttttatcttttttcttgagtaagcttcagtaatttgtctttcagggaatttgtccatttcatctaatttgtctaatatattggcataaaagcattcagaatattcattttaatatctgtgatatctctaatgatatcgtcttatcccttatattgatgatttgtatcttctcttggttgtttttttctgatcagtctagctggaagtttttcaattctgttygtctctaagtgccaacttttaggttcagtgatttttgtcttttgttttatatttcaataatttttactctgattttaattatttcttttttttccgcttacctggtgtttcaattgcccatctttttgtagttttttaaggtgctagttgaggtcattgttttaagaccctttttactgcttttgtagcatttaaaaattatgatatgttttcattttcacttatattaaaatactttgtcccttgggttatttagaagtctgctatttagtttcaaaatactagggattttacagagat

SEQ ID NO: 95072 - DNA, 601 bp, Human
ttgagtaagcttcagtaatttgtctttcagggaatttgtccatttcatctaatttgtctaatatattggcataaaagcattcagaatattcattttaatatctgtgatatctctaatgatatcgtcttatcccttatattgatgatttgtatcttctcttggttgtttttttctgatcagtctagctggaagtttttcaattctgttcgtctctaagtgccaacttttaggttcagtgatttttgtcttttgttttatatttcaataatttttactctgattttaattatttctttttttyccgcttacctggtgtttcaattgcccatctttttgtagttttttaaggtgctagttgaggtcattgttttaagaccctttttactgcttttgtagcatttaaaaattatgatatgttttcattttcacttatattaaaatactttgtcccttgggttatttagaagtctgctatttagtttcaaaatactagggattttacagagatctttctgttgttggttttttagtttcatttaatgacttcagtccttttaaatttattagacttggttttatggaccagaatatgatctatctt

SEQ ID NO: 95073 - DNA, 601 bp, Human
tgatctatctttataagtgttccacaaaacttgaaagaatgtgaatctgccactttggggtagagtgatctgtaaatgttgattaggccaagttgtttgattatactatttattttcttttatattcttaccgatcttctacttggtctatcagttattgagaggcaggattgaaaatctcttagttataattgtacattatctatttcttccccttttttagagtttttacttcctgtattttgtagctctgtgattagatgcataaaaatgtaggattgttggtttatcttaataaacygacctcctttaccattatatgatgaccctctttatttctggtaatagtgtttgttctgaaatttgttttgagattaatataacctcctcaactttcttttgattagtgttagcacagtgtatcttctatccctttatattaaagtactttatcttaaaaatatgtttcttatagacatatatttatatatatttatatgtttggatcttgcttctctctcccaccatggacaatctctgccttttcactgaggtacttagaccatttacatttattgtgattattgatattattaggttt

SEQ ID NO: 95074 - DNA, 601 bp, Human
catttattgtgattattgatattattaggtttaaatttcatcttgctacttattttctacgtgtttcatatgttctttgttcactttttcctcattttcttactgcttttgccttaattgggtgtgtttgatgattccattttgactccttcttgacttttgagctgtaacttttgttaatttggtggtggtttttagggtttatagtatgcattcttaccacgatctcccttcaagtgatattatactacttcacatatagtaaaagaaccttacaacaggatactttcgtttttccatycccaacctttgtggtattgttttcagacacttttgcatgtgttaaaaaaatccacatcttattattttcatcttaataattatcttttaaaggaatttaaataataagaaaaaaacctcttgtatatttatccatgtagctatcatttccagggctcttcattctttgtatagatctggatttccattttggtatcattttttcttctggctggaggacttccttttacattccttgtagcacaagtcttctgatgatgaattatttcagctttggtatgtctgggaaagtattttgctt

SEQ ID NO: 95075 - DNA, 601 bp, Human; identical to SEQ ID NO: 38008

SEQ ID NO: 95076 - DNA, 601 bp, Human; identical to SEQ ID NO: 38009

SEQ ID NO: 95077 - DNA, 601 bp, Human; identical to SEQ ID NO: 94965

SEQ ID NO: 95078 - DNA, 601 bp, Human; identical to SEQ ID NO: 94966

SEQ ID NO: 95079 - DNA, 601 bp, Human; identical to SEQ ID NO: 94967

SEQ ID NO: 95080 - DNA, 601 bp, Human; identical to SEQ ID NO: 94968

SEQ ID NO: 95081 - DNA, 601 bp, Human; identical to SEQ ID NO: 94969

SEQ ID NO: 95082 - DNA, 601 bp, Human; identical to SEQ ID NO: 94970

SEQ ID NO: 95083 - DNA, 601 bp, Human; identical to SEQ ID NO: 94971

SEQ ID NO: 95084 - DNA, 601 bp, Human; identical to SEQ ID NO: 94972

SEQ ID NO: 95085 - DNA, 601 bp, Human; identical to SEQ ID NO: 94973

SEQ ID NO: 95086 - DNA, 601 bp, Human; identical to SEQ ID NO: 94974

SEQ ID NO: 95087 - DNA, 601 bp, Human; identical to SEQ ID NO: 94975

SEQ ID NO: 95088 - DNA, 601 bp, Human; identical to SEQ ID NO: 94976

SEQ ID NO: 95089 - DNA, 601 bp, Human; identical to SEQ ID NO: 94977

SEQ ID NO: 95090 - DNA, 601 bp, Human; identical to SEQ ID NO: 94978

SEQ ID NO: 95091 - DNA, 601 bp, Human; identical to SEQ ID NO: 94979

SEQ ID NO: 95092 - DNA, 601 bp, Human; identical to SEQ ID NO: 94980

SEQ ID NO: 95093 - DNA, 601 bp, Human; identical to SEQ ID NO: 94981

SEQ ID NO: 95094 - DNA, 601 bp, Human; identical to SEQ ID NO: 94982

SEQ ID NO: 95095 - DNA, 601 bp, Human; identical to SEQ ID NO: 94983

SEQ ID NO: 95096 - DNA, 601 bp, Human; identical to SEQ ID NO: 94984

SEQ ID NO: 95097 - DNA, 601 bp, Human; identical to SEQ ID NO: 94985

SEQ ID NO: 95098 - DNA, 601 bp, Human; identical to SEQ ID NO: 94986

SEQ ID NO: 95099 - DNA, 601 bp, Human; identical to SEQ ID NO: 94987

SEQ ID NO: 95100 - DNA, 601 bp, Human; identical to SEQ ID NO: 94988

SEQ ID NO: 95101 - DNA, 601 bp, Human; identical to SEQ ID NO: 94989

SEQ ID NO: 95102 - DNA, 601 bp, Human; identical to SEQ ID NO: 94990

SEQ ID NO: 95103 - DNA, 601 bp, Human; identical to SEQ ID NO: 94991

SEQ ID NO: 95104 - DNA, 601 bp, Human; identical to SEQ ID NO: 94992

SEQ ID NO: 95105 - DNA, 601 bp, Human; identical to SEQ ID NO: 94993

SEQ ID NO: 95106 - DNA, 601 bp, Human; identical to SEQ ID NO: 94994

SEQ ID NO: 95107 - DNA, 601 bp, Human; identical to SEQ ID NO: 94995

SEQ ID NO: 95108 - DNA, 601 bp, Human; identical to SEQ ID NO: 94996

SEQ ID NO: 95109 - DNA, 601 bp, Human; identical to SEQ ID NO: 94997

SEQ ID NO: 95110 - DNA, 601 bp, Human; identical to SEQ ID NO: 94998

SEQ ID NO: 95111 - DNA, 601 bp, Human; identical to SEQ ID NO: 94999

SEQ ID NO: 95112 - DNA, 601 bp, Human; identical to SEQ ID NO: 95000

SEQ ID NO: 95113 - DNA, 601 bp, Human; identical to SEQ ID NO: 95001

SEQ ID NO: 95114 - DNA, 601 bp, Human; identical to SEQ ID NO: 95002

SEQ ID NO: 95115 - DNA, 601 bp, Human; identical to SEQ ID NO: 95003

SEQ ID NO: 95116 - DNA, 601 bp, Human; identical to SEQ ID NO: 95004

SEQ ID NO: 95117 - DNA, 601 bp, Human; identical to SEQ ID NO: 95005

SEQ ID NO: 95118 - DNA, 601 bp, Human; identical to SEQ ID NO: 95006

SEQ ID NO: 95119 - DNA, 601 bp, Human; identical to SEQ ID NO: 95007

SEQ ID NO: 95120 - DNA, 601 bp, Human; identical to SEQ ID NO: 95008

SEQ ID NO: 95121 - DNA, 601 bp, Human; identical to SEQ ID NO: 95009

SEQ ID NO: 95122 - DNA, 601 bp, Human; identical to SEQ ID NO: 95010

SEQ ID NO: 95123 - DNA, 601 bp, Human; identical to SEQ ID NO: 95011

SEQ ID NO: 95124 - DNA, 601 bp, Human; identical to SEQ ID NO: 95012

SEQ ID NO: 95125 - DNA, 601 bp, Human; identical to SEQ ID NO: 95013

SEQ ID NO: 95126 - DNA, 601 bp, Human; identical to SEQ ID NO: 95014

SEQ ID NO: 95127 - DNA, 601 bp, Human; identical to SEQ ID NO: 95015

SEQ ID NO: 95128 - DNA, 601 bp, Human; identical to SEQ ID NO: 95016

SEQ ID NO: 95129 - DNA, 601 bp, Human; identical to SEQ ID NO: 95017

SEQ ID NO: 95130 - DNA, 601 bp, Human; identical to SEQ ID NO: 95018

SEQ ID NO: 95131 - DNA, 601 bp, Human; identical to SEQ ID NO: 95019

SEQ ID NO: 95132 - DNA, 601 bp, Human; identical to SEQ ID NO: 95020

SEQ ID NO: 95133 - DNA, 601 bp, Human; identical to SEQ ID NO: 95021

SEQ ID NO: 95134 - DNA, 601 bp, Human; identical to SEQ ID NO: 95022

SEQ ID NO: 95135 - DNA, 601 bp, Human; identical to SEQ ID NO: 95023

SEQ ID NO: 95136 - DNA, 601 bp, Human; identical to SEQ ID NO: 95024

SEQ ID NO: 95137 - DNA, 601 bp, Human; identical to SEQ ID NO: 95025

SEQ ID NO: 95138 - DNA, 601 bp, Human; identical to SEQ ID NO: 95026

SEQ ID NO: 95139 - DNA, 601 bp, Human; identical to SEQ ID NO: 95027

SEQ ID NO: 95140 - DNA, 601 bp, Human; identical to SEQ ID NO: 95028

SEQ ID NO: 95141 - DNA, 601 bp, Human; identical to SEQ ID NO: 95029

SEQ ID NO: 95142 - DNA, 601 bp, Human; identical to SEQ ID NO: 95030

SEQ ID NO: 95143 - DNA, 601 bp, Human; identical to SEQ ID NO: 95031

SEQ ID NO: 95144 - DNA, 601 bp, Human; identical to SEQ ID NO: 95032

SEQ ID NO: 95145 - DNA, 601 bp, Human; identical to SEQ ID NO: 95033

SEQ ID NO: 95146 - DNA, 601 bp, Human; identical to SEQ ID NO: 95034

SEQ ID NO: 95147 - DNA, 601 bp, Human; identical to SEQ ID NO: 95035

SEQ ID NO: 95148 - DNA, 601 bp, Human; identical to SEQ ID NO: 95036

SEQ ID NO: 95149 - DNA, 601 bp, Human; identical to SEQ ID NO: 95037

SEQ ID NO: 95150 - DNA, 601 bp, Human; identical to SEQ ID NO: 95038

SEQ ID NO: 95151 - DNA, 601 bp, Human; identical to SEQ ID NO: 95039

SEQ ID NO: 95152 - DNA, 601 bp, Human; identical to SEQ ID NO: 95040

SEQ ID NO: 95153 - DNA, 601 bp, Human; identical to SEQ ID NO: 37994

SEQ ID NO: 95154 - DNA, 601 bp, Human; identical to SEQ ID NO: 37995

SEQ ID NO: 95155 - DNA, 601 bp, Human; identical to SEQ ID NO: 37996

SEQ ID NO: 95156 - DNA, 601 bp, Human; identical to SEQ ID NO: 37997

SEQ ID NO: 95157 - DNA, 601 bp, Human; identical to SEQ ID NO: 37998

SEQ ID NO: 95158 - DNA, 601 bp, Human; identical to SEQ ID NO: 37999

SEQ ID NO: 95159 - DNA, 601 bp, Human; identical to SEQ ID NO: 38000

SEQ ID NO: 95160 - DNA, 601 bp, Human; identical to SEQ ID NO: 38001

SEQ ID NO: 95161 - DNA, 601 bp, Human; identical to SEQ ID NO: 38002

SEQ ID NO: 95162 - DNA, 601 bp, Human; identical to SEQ ID NO: 38003

SEQ ID NO: 95163 - DNA, 601 bp, Human; identical to SEQ ID NO: 38004

SEQ ID NO: 95164 - DNA, 601 bp, Human; identical to SEQ ID NO: 38005

SEQ ID NO: 95165 - DNA, 601 bp, Human; identical to SEQ ID NO: 38006

SEQ ID NO: 95166 - DNA, 601 bp, Human; identical to SEQ ID NO: 38007

SEQ ID NO: 95167 - DNA, 601 bp, Human; identical to SEQ ID NO: 95055

SEQ ID NO: 95168 - DNA, 601 bp, Human; identical to SEQ ID NO: 95056

SEQ ID NO: 95169 - DNA, 601 bp, Human; identical to SEQ ID NO: 95057

SEQ ID NO: 95170 - DNA, 601 bp, Human; identical to SEQ ID NO: 95058

SEQ ID NO: 95171 - DNA, 601 bp, Human; identical to SEQ ID NO: 95059

SEQ ID NO: 95172 - DNA, 601 bp, Human; identical to SEQ ID NO: 95060

SEQ ID NO: 95173 - DNA, 601 bp, Human; identical to SEQ ID NO: 95061

SEQ ID NO: 95174 - DNA, 601 bp, Human; identical to SEQ ID NO: 95062

SEQ ID NO: 95175 - DNA, 601 bp, Human; identical to SEQ ID NO: 95063

SEQ ID NO: 95176 - DNA, 601 bp, Human; identical to SEQ ID NO: 95064

SEQ ID NO: 95177 - DNA, 601 bp, Human; identical to SEQ ID NO: 95065

SEQ ID NO: 95178 - DNA, 601 bp, Human; identical to SEQ ID NO: 95066

SEQ ID NO: 95179 - DNA, 601 bp, Human; identical to SEQ ID NO: 95067

SEQ ID NO: 95180 - DNA, 601 bp, Human; identical to SEQ ID NO: 95068

SEQ ID NO: 95181 - DNA, 601 bp, Human; identical to SEQ ID NO: 95069

SEQ ID NO: 95182 - DNA, 601 bp, Human; identical to SEQ ID NO: 95070

SEQ ID NO: 95183 - DNA, 601 bp, Human; identical to SEQ ID NO: 95071

SEQ ID NO: 95184 - DNA, 601 bp, Human; identical to SEQ ID NO: 95072

SEQ ID NO: 95185 - DNA, 601 bp, Human; identical to SEQ ID NO: 95073

SEQ ID NO: 95186 - DNA, 601 bp, Human; identical to SEQ ID NO: 95074

SEQ ID NO: 95187 - DNA, 601 bp, Human; identical to SEQ ID NO: 38008

SEQ ID NO: 95188 - DNA, 601 bp, Human; identical to SEQ ID NO: 38009

SEQ ID NO: 95189 - DNA, 601 bp, Human
caagcaagtgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggtcagccgtgggggctaatgaatggctagcataagtgggacaccacggtgggcttgggcatagctgcgactcatgccagtggcagcctgagggagacaccaacttcagctccaaactagcaaagataaaaatgtatyttttcatcaggttagatagtcctgctttaactggaacttgtagattatttatttatttatttatttgagacagagtctcactctgtctccaagctggagtgcagtggcgcggtcttgcctcactgcaacctccacctcccaggtccaagcgattcccctgcctcagcttcccgagtagctgggactacaggtgcacgccaccatgcccagctaattttttgtattttaatagagacggcctttcatcatgttggtcaagacggtcttcatctcctgacctcatgatccgcctgcctcggc

SEQ ID NO: 95190 - DNA, 601 bp, Human
ttcccgagtagctgggactacaggtgcacgccaccatgcccagctaattttttgtattttaatagagacggcctttcatcatgttggtcaagacggtcttcatctcctgacctcatgatccgcctgcctcggcctcccaaagtgctgggattacaggcatgagccaccacacctggctgaacttgtagattatttggaagccagaagggaccttatgagcaccccgttcggtttttcatatacctgcttctgtatcagaaagacttgtgcaactaacagaaatgcagctcttcttgccacsccctgcctagacttggggaatcacaatctccaggggaaggcccagaaatgctcctgaagcatcttgctgtcaccagtgcccctgctgaggccccagagggcaggtgacctgggtgaacctcctaacggacagggggcttctccgggccctgggtcccgggtgcccgctcccacccccttagcagaattttggagagtgtggctgtgtttccttcgtggttgtttggacagcggcagagctgtgtgttttgaaggtaaagtgaggaattgactcttctccttccctgtggtaggtgctgtg

SEQ ID NO: 95191 - DNA, 601 bp, Human
tgattcacagacagaggtcattgtttctgactttatttccctcatcagaggctacccgccactcatatcagtaggaacctgttacttagattttgtaaaatctgggtaaaagatgatgagaatggcctgcagttgtccgtgaggtcgttcagaagaccagacgaatcccaggactaataattctcaaaattaattaaaccctccttcccaattataagagaattagaatgaagttggttgctttaggagcgagcggcggtgtgaatctgggtcggcgtttcccggctgggtttgggctcaktgttggtgagtgtctttgtcttctcttttaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggaggtactttctgtttcgcacacttggagggcagcaggggtgtttttcattagcccgttaggatttaattagagtggtggcccatgtcgtcagg

SEQ ID NO: 95192 - DNA, 601 bp, Human
ctccgctgtgtctgcacagtccatctggaggccacagaactatttctgtctcggaggaatggagagacttcgatttcttttcctccctttttgttccagtgcatttagtcaggccctgttgctctcagggctgaggcacagctcagagagcaggcagggaagagaatgcgccttttcttccggcgggcgcttgggcagcgcccctcacactttgatgtatacacagttgttgggggcttgttttggtggagaccccgattcaattaagttggggcagggctggctgagtttctgcatttcygttgggtgccaagatgatgctggggctgctggttcacaggccacgctggggccggagcccaggaacatggaaagaccctcggaggggcttaggagttggtgcttctacgagtggacctgagggcctgcggggggttgttactgtatttacttttatttttcctgcggttctaagtgggaggtcattattgggatgtgtggctcatgtcaggaaagggagatctgaggtcaaccttcaggccccttggggaggtggccttctgagctggacgatgcctctccaccctgtgccccttggacg

SEQ ID NO: 95193 - DNA, 601 bp, Human
acaccctttcctgcccaccccgcaggcccttgttgtctgatcgcagggtggcttggctggtgaggttccagcggagggtggacccagccttcgtgagcatagttgccacagggcaggtggcctgttagcttcagagcagtcttgggccatgtgtctgctgctggagagttgtgaggaccccagagcctcctcacccatcgctgctccctgcacctgtctctgagcagctttttttgggaagggtcctcctggagtcaggggagagcagctgtccctgcgtggcgcaaagcagggacatcgygggccaagtctcctagtgctggtaaaatgcgacggctgcattcgtggatgggatgggaggtgcgctggcctgggtcccagttttcctaatctgtgtcgagagtggatttgacaggtgttgtccacagtctttatgatcttggaacttcgggtcttccttaaatgttactggatggtggcagaggtgcatgagcaagaatcctcatgtattcagcaaccctgagtcccccagaaggctccaaagagccatggatgtgggcctcactgcctgcgggagtacagacctgtcagcaggtgaggg

SEQ ID NO: 95194 - DNA, 601 bp, Human
tcgcagggtggcttggctggtgaggttccagcggagggtggacccagccttcgtgagcatagttgccacagggcaggtggcctgttagcttcagagcagtcttgggccatgtgtctgctgctggagagttgtgaggaccccagagcctcctcacccatcgctgctccctgcacctgtctctgagcagctttttttgggaagggtcctcctggagtcaggggagagcagctgtccctgcgtggcgcaaagcagggacatcgtgggccaagtctcctagtgctggtaaaatgcgacggctgcrttcgtggatgggatgggaggtgcgctggcctgggtcccagttttcctaatctgtgtcgagagtggatttgacaggtgttgtccacagtctttatgatcttggaacttcgggtcttccttaaatgttactggatggtggcagaggtgcatgagcaagaatcctcatgtattcagcaaccctgagtcccccagaaggctccaaagagccatggatgtgggcctcactgcctgcgggagtacagacctgtcagcaggtgaggggaatgtgcggaaggaggtgcctggaagctgcaggtggttg

SEQ ID NO: 95195 - DNA, 601 bp, Human
tgggccaagtctcctagtgctggtaaaatgcgacggctgcattcgtggatgggatgggaggtgcgctggcctgggtcccagttttcctaatctgtgtcgagagtggatttgacaggtgttgtccacagtctttatgatcttggaacttcgggtcttccttaaatgttactggatggtggcagaggtgcatgagcaagaatcctcatgtattcagcaaccctgagtcccccagaaggctccaaagagccatggatgtgggcctcactgcctgcgggagtacagacctgtcagcaggtgaggrgaatgtgcggaaggaggtgcctggaagctgcaggtggttggcgtgggtccccctcaggggcggggatgctcttgtgttcatctctaggtctcagcatctggtgctgggcctggcatgaggggtacccaagggtcttctgggactggaatggtgtaggagaaagggtggcattggtgaaggaggaagtcttcatgggccagaagcgtttgctgcagccactgaggagttgggcactcagccatcaggcacagggctgggtgtggacagtgggtgaggaggggccgtgagggactgtaccaa

SEQ ID NO: 95196 - DNA, 601 bp, Human
ccccatggttcacaccctgatttgctgtctggcggaaagggatgatttattattattattattattttattttttatttttatttatttatttttttgagacagtcttcactttgtcacacaggctggagtgcagtggcacgatctcagctcactgccagctccgcctcccaggttcacgccattctcctgcctcagcctcccagtagctgggactacaggcacccgccaccacacctggctaatttttttgtattttttagtagagatggggtttcactgtgttagccaggatggtctcratctcctgacctcatgatccgcccgcctcagcctcccaaagtgccgggattacaggtgtgagccaccgcacccggccgaaagggatgacttatacgagcttagtgtttcctgacttattacacatcagagaaggtgtggggtgggtgggtcttatctgaggatgtcaggggcgcagtggtgaggaaacagccaaatcctgcaagctgtcaggggctgtttcctggcatctgtaaggtatccagatgtgggggcaccctgcattccccggcagctcatggcccctcatgcagcctccccca

SEQ ID NO: 95197 - DNA, 601 bp, Human
gtagagatggggtttcactgtgttagccaggatggtctcaatctcctgacctcatgatccgcccgcctcagcctcccaaagtgccgggattacaggtgtgagccaccgcacccggccgaaagggatgacttatacgagcttagtgtttcctgacttattacacatcagagaaggtgtggggtgggtgggtcttatctgaggatgtcaggggcgcagtggtgaggaaacagccaaatcctgcaagctgtcaggggctgtttcctggcatctgtaaggtatccagatgtgggggcaccctgcrttccccggcagctcatggcccctcatgcagcctcccccacccctcactgtcaccagttccgagagcttccattccacggctagaattgcatggcttgagttggttgaaacagtacacatacctgcaggcagaaggatttcacttttttgtttgtttgcttgttttttgagacagagtctcactctgtcgcccaggctagagtgcagtggcatgatctcagctcactgcaacctctgcctcctgggttcaagccattctcctgcttcagccttctgagtagctgggattacaggtgcccac

SEQ ID NO: 95198 - DNA, 601 bp, Human
caagccattctcctgcttcagccttctgagtagctgggattacaggtgcccaccaccatgcccggctaatttttgtatttttagtagagatggggtttcaccatgttagccaggctggtctcgaattcctgacctcaagtgatccgcctgccctggcctcccaaagtgctgggattacaggcgtgagccaccttgggatttcacttctgagttctttatatctgtgaaaaattgaaaacagcctacctgttcattgataggggattggttcatctgtggaacatcttgaatggaacacgaygtagccactgaaaatgttaattaagacttttcaattacagggtgggaacatgcttgtattctaatattaagtgggataaaaagaaggtgcaattgatctcaagcacccctagcaatgagatagaaagtgaaggttcagagtgaggagagaggacatgaagggggtgggaggccccagccggaaagctcggaaaacccaggcaggagctcctggatgccaggctggtgtggtcagagcctctccttcagtacctcccgtattgtagatgagactgaggcccatttgggcatggggcttgcc

SEQ ID NO: 95199 - DNA, 601 bp, Human
gggattacaggtgcccaccaccatgcccggctaatttttgtatttttagtagagatggggtttcaccatgttagccaggctggtctcgaattcctgacctcaagtgatccgcctgccctggcctcccaaagtgctgggattacaggcgtgagccaccttgggatttcacttctgagttctttatatctgtgaaaaattgaaaacagcctacctgttcattgataggggattggttcatctgtggaacatcttgaatggaacacgatgtagccactgaaaatgttaattaagacttttcaaytacagggtgggaacatgcttgtattctaatattaagtgggataaaaagaaggtgcaattgatctcaagcacccctagcaatgagatagaaagtgaaggttcagagtgaggagagaggacatgaagggggtgggaggccccagccggaaagctcggaaaacccaggcaggagctcctggatgccaggctggtgtggtcagagcctctccttcagtacctcccgtattgtagatgagactgaggcccatttgggcatggggcttgcccaaggctaccagctgcttcaaccacgagctgggcc

SEQ ID NO: 95200 - DNA, 601 bp, Human
gctcctgcctctcacatggtgagagtctctttcaggtatttgcttttagattgttatttagattgctgttagacttgggccttaatttaggtcctactgctaccccagggtgagtgtccagccttggtaaggtctcctcatgtgtcttcatgcctcagttccctcatccatcccaggccctgatggcacctgctctcttccaaacagccagttatttgaggtctggggccgtgagttatttgcaaagtcacctacctcgactggcctctgttgcctgacttcccctaggagtccatgaggycggacctgttgggggctgggtgtttccacttagagtcactatttccctgtgccagaatatgcgtgagaaatatatttgcagagcagagcatggctgggctggaccgagctggaccaaaggaaaaagcagccctgtggtcagactggggaaaggttagtttaatcatctggctggagcagttcataagagcagacggcagaagcctgggagggcgagttctttcccagtctcttttgctgttgtgctaacactttggaggccataaatcttttaaaacacattttggcccagaggttttcc

SEQ ID NO: 95201 - DNA, 601 bp, Human
gcagttcataagagcagacggcagaagcctgggagggcgagttctttcccagtctcttttgctgttgtgctaacactttggaggccataaatcttttaaaacacattttggcccagaggttttcccctcctttaacttctaaaatggtgtaattttaaaagcaatttgattcagatgtttctcattgctttatactgaaactgtccaaatgctgttgtattttcctcctccactgtgggttctctttcaaaaatatttctgaacctctctgtgtgcctcactgagcaccagggactactaytcagagcctctgggataatatgaaaggtggagccatgaaacccagagctgggtctgatctcatgagttttgctagtttctggaatcaagcagccagacaggctttagacatcctgggatgtacctgcaatggccaacgcccacctcttccacgaagcatccactgtgtgctgggccaggtgtcctcccagtgtgggccgcaccagcaacatcagcatcccctgggaattgttagaaatgctaattcttgagccccaccttagacctactgaatctgagtctgtgggggtagagcccagca

SEQ ID NO: 95202 - DNA, 601 bp, Human
ccaggtttctggtgacttcctacttgagagtggtgggtgccctgggctggaaatcagacctgggtgcctgtcccactttgctttgctcccagggcctgtcctgggtgtctgtcccgagtgggctcctggcctctctgacttggtcttttccccagcacgctggagaccagaccagaccaaaggttactaaagctggccaagccttagactctcgtgacaatcactatgtaagtgcagggtccagggcagcccctgggctggggcctgggcatatgtatttttaatacgcttcacaggtcaytgggcgcagtccgtccaaggcatgaacaagatcccttggagtattcaagagtctcagggggggagactacggtttgcagctggtagtactggcggggctgtgaccaggctagcatagctagggtcaagcactagacgactttcagcagagcgctccagtgttccaggaggcgtgtgtgctacctactcatactgacagccctcctatcttcttcattggccctgctgggttcttggaaagtttttctgaggcacagttttgcttagtggcgaggcatgcatgtctatatgggaatgctgt

SEQ ID NO: 95203 - DNA, 601 bp, Human
atgaacaagatcccttggagtattcaagagtctcagggggggagactacggtttgcagctggtagtactggcggggctgtgaccaggctagcatagctagggtcaagcactagacgactttcagcagagcgctccagtgttccaggaggcgtgtgtgctacctactcatactgacagccctcctatcttcttcattggccctgctgggttcttggaaagtttttctgaggcacagttttgcttagtggcgaggcatgcatgtctatatgggaatgctgtgcaaatagcagaatatttagaygactcattttcattgtgttggccagagctagaaaatcccctcccaccacctgccttaccacacctaggaatctgtccaatacccctccattggtacgtacctccaagtccctggtgtctttgcactctgtctttttctgtgcctccaggatgtccttgtgggcagggcattgcttgttcaccactgtccccacatcaccgcttgcagcagacatcccataggggattatggaatctgatgctatcatgccagaggtgttcccggtgggctggtgtggtcagctgtctctgggtataaggg

SEQ ID NO: 95204 - DNA, 601 bp, Human
gcggggctgtgaccaggctagcatagctagggtcaagcactagacgactttcagcagagcgctccagtgttccaggaggcgtgtgtgctacctactcatactgacagccctcctatcttcttcattggccctgctgggttcttggaaagtttttctgaggcacagttttgcttagtggcgaggcatgcatgtctatatgggaatgctgtgcaaatagcagaatatttagacgactcattttcattgtgttggccagagctagaaaatcccctcccaccacctgccttaccacacctaggartctgtccaatacccctccattggtacgtacctccaagtccctggtgtctttgcactctgtctttttctgtgcctccaggatgtccttgtgggcagggcattgcttgttcaccactgtccccacatcaccgcttgcagcagacatcccataggggattatggaatctgatgctatcatgccagaggtgttcccggtgggctggtgtggtcagctgtctctgggtataagggtcagttgaggctggccgtggtctttggcccccctgccaggccccatggccagcagggagctgagtgggcc

SEQ ID NO: 95205 - DNA, 601 bp, Human
gccctgctgggttcttggaaagtttttctgaggcacagttttgcttagtggcgaggcatgcatgtctatatgggaatgctgtgcaaatagcagaatatttagacgactcattttcattgtgttggccagagctagaaaatcccctcccaccacctgccttaccacacctaggaatctgtccaatacccctccattggtacgtacctccaagtccctggtgtctttgcactctgtctttttctgtgcctccaggatgtccttgtgggcagggcattgcttgttcaccactgtccccacatcmccgcttgcagcagacatcccataggggattatggaatctgatgctatcatgccagaggtgttcccggtgggctggtgtggtcagctgtctctgggtataagggtcagttgaggctggccgtggtctttggcccccctgccaggccccatggccagcagggagctgagtgggccaccttccctggcttatccgagtttctctgctggggccacacacttttgccttggacctgatgcacccaggtgtgactaagtgggcaattactcttatttaagtgattttcaggacggctgttgatgc

SEQ ID NO: 95206 - DNA, 601 bp, Human
agcagagctgagttcccctgacagcctggttcacccaggaagcggggtgcaggctgaccacccagatgtttttcagatggttcaggagtgtactgcaaggttggacgcctggggcgggagcatgaggttggagacttcttcctgctcccagcagagtctagtgggaagagcatggcttggggtcaggcagatctgggctcttcttaccctctgcttaccagccgtgtcttctgggcaaatcaaggaacttctctgagattcgtgcagtggcgatggtagtggtcactacttctggctaccrtggaactaagcgagacaaggtctgcagggtggctagcagagcatgtgggcacggaggaagtaaatgtccacataacggaaacccgagcattcctctggcctgtcctggcctcacactcactgccactcagaacggctgccgtccagaatcagcctggccgccccatttccccaagcacaacaggtttgttctctgcttctggccgcagcccggggtctggactctgggaggctctcctggcccctgcctgtcgctccccttggttgcagagaccggcacacatgtttcacgtcacctctg

SEQ ID NO: 95207 - DNA, 601 bp, Human
aatttcctctctatcaaaagacacagctaatgctgtgttttaatgtgttatttacacacaaaataacctatttacaactcagtatgcgccggagggagaatggatgggcccctgttccctgcattctgttatatcagagtttaacaatctggattgctaatagaaccatttatcattacttgggagggggggaaagagataatttattttatgtttgtggccaggtctcaccgcctctgatcttgggaccattttgaggataatgaagtgaagccctgcatttggtgggggctgtggggcrcccgggcctgggtgcctctgggttccctgcattcatgtgcacatcctacagatggtcccgaactgtggaccagagaggtggtgatgacagggacgttgcctctgccttctaggagcttccagttagaggtgacactcagcagatggtgacgaatcctgcccatagggcttcacgggggaggcagtgtctgagcctggggacattcggggttccaccaggtggaaagaggaaagggtgggtgggccctggtgggaggaggaggggcagagtggccccctgggagtgtggggagggaggact

SEQ ID NO: 95208 - DNA, 601 bp, Human
gaagtgaagccctgcatttggtgggggctgtggggcacccgggcctgggtgcctctgggttccctgcattcatgtgcacatcctacagatggtcccgaactgtggaccagagaggtggtgatgacagggacgttgcctctgccttctaggagcttccagttagaggtgacactcagcagatggtgacgaatcctgcccatagggcttcacgggggaggcagtgtctgagcctggggacattcggggttccaccaggtggaaagaggaaagggtgggtgggccctggtgggaggaggagggkcagagtggccccctgggagtgtggggagggaggactgggcgccatcagctcagtctgtatgtctcctgcgtgagtccatatgtctcctgcctggcatatggggtctgaaggacaaggctcctgttgccctgcggggaggcgcagagatggctggcacccaggtgggtgcatagctgatccagggtgcaggccgaggtcccggaggctccactgaagtctctttgaatggacattgaggggtaaggagggaaagcgccatttgaagctgctgtcctctatgaagctctgtgtggacaccag

SEQ ID NO: 95209 - DNA, 601 bp, Human
catatgctaagagaaagaagccgggcataaaagcacaaatattgtaggattccattcccatgaattgtctagaatgacaaatccatagagacagaagggagatgaggaggtgccaggggctgggagaagagggaatggggaatgattgctatgggcttggggtttctttttggagggatgaaaatgttctgtaattagatagtggtgatggttgcaacagctctgtgaatgtactaaaaaccactgaattgtggactttacaagggtgcattttatggtatgtgaattacatctctgtttwaaaaagaagggagggaggagaaagaaaggatagaaggaaggaaaagaggaaggaagtgcgggggagggagggcgcctgtggcggcatgggggcctggtcgtgctgctgctcacagcccctgggatctccaagtgccttgtgcaccgctacccctcagggaggaccctgcttcccctggccaatgagcagccttcccatctaatctataggccccagaagctctaaaaataactgaagtggaagggggatgtttaatgacaaagtaaataattacattaagggtgcgagtttggaggggag

SEQ ID NO: 95210 - DNA, 601 bp, Human
gacatgtctctttctgtccgtgatctcgattggctttccgctggcctggcattctgatagctctgatcaccagagggtggagttgctgatgtgtgcctgatacccatgagctcagatggaggagtgtctcattccgggtgattccaggaaaagccctgggggcaacttattggctaggcctgggtcccatgcacccttgtgaaccatccactgtgaccgagccatgtagtattttgtggggtcccatgcatacctgtgcaaagtggggtgggtcagcccccttatctgctggagctgtgcrtagaagggtggcccatgtgctgctggtcaagccaaataccagtgtccgcctccctgaagccagatggcaggaggagtgtgcaggagacccggagaggcctgggctcctgtagacatccactggtggatggtggggtcagagttgggcccttcagaagcagcaaggagtcctctggtcattctgtccccccagcctcattctttgggttgtgccaggggtgctgtccccctcccctacttgtccttttgagctccccataagggtacacaaagtgctccctgagaagtgccagaccagagc

SEQ ID NO: 95211 - DNA, 601 bp, Human
gagttgctgatgtgtgcctgatacccatgagctcagatggaggagtgtctcattccgggtgattccaggaaaagccctgggggcaacttattggctaggcctgggtcccatgcacccttgtgaaccatccactgtgaccgagccatgtagtattttgtggggtcccatgcatacctgtgcaaagtggggtgggtcagcccccttatctgctggagctgtgcatagaagggtggcccatgtgctgctggtcaagccaaataccagtgtccgcctccctgaagccagatggcaggaggagtgkgcaggagacccggagaggcctgggctcctgtagacatccactggtggatggtggggtcagagttgggcccttcagaagcagcaaggagtcctctggtcattctgtccccccagcctcattctttgggttgtgccaggggtgctgtccccctcccctacttgtccttttgagctccccataagggtacacaaagtgctccctgagaagtgccagaccagagccttggagaggaaatgctagaaagttccaggggtggcatcgctaaggagggctccttaaagaatgagagagctactggga

SEQ ID NO: 95212 - DNA, 601 bp, Human
atgagctcagatggaggagtgtctcattccgggtgattccaggaaaagccctgggggcaacttattggctaggcctgggtcccatgcacccttgtgaaccatccactgtgaccgagccatgtagtattttgtggggtcccatgcatacctgtgcaaagtggggtgggtcagcccccttatctgctggagctgtgcatagaagggtggcccatgtgctgctggtcaagccaaataccagtgtccgcctccctgaagccagatggcaggaggagtgtgcaggagacccggagaggcctgggcwcctgtagacatccactggtggatggtggggtcagagttgggcccttcagaagcagcaaggagtcctctggtcattctgtccccccagcctcattctttgggttgtgccaggggtgctgtccccctcccctacttgtccttttgagctccccataagggtacacaaagtgctccctgagaagtgccagaccagagccttggagaggaaatgctagaaagttccaggggtggcatcgctaaggagggctccttaaagaatgagagagctactgggaaggtggaggtgagcagaggctcaacg

SEQ ID NO: 95213 - DNA, 601 bp, Human
tgtgaccgagccatgtagtattttgtggggtcccatgcatacctgtgcaaagtggggtgggtcagcccccttatctgctggagctgtgcatagaagggtggcccatgtgctgctggtcaagccaaataccagtgtccgcctccctgaagccagatggcaggaggagtgtgcaggagacccggagaggcctgggctcctgtagacatccactggtggatggtggggtcagagttgggcccttcagaagcagcaaggagtcctctggtcattctgtccccccagcctcattctttgggttgtrccaggggtgctgtccccctcccctacttgtccttttgagctccccataagggtacacaaagtgctccctgagaagtgccagaccagagccttggagaggaaatgctagaaagttccaggggtggcatcgctaaggagggctccttaaagaatgagagagctactgggaaggtggaggtgagcagaggctcaacggggggtggatgacagggcatatgccagggcagggagcagcgcctgctggagaggaggcttcatactaggggtaggaggagaggtgcagttggaaagggaggttgga

SEQ ID NO: 95214 - DNA, 601 bp, Human
atgtagtattttgtggggtcccatgcatacctgtgcaaagtggggtgggtcagcccccttatctgctggagctgtgcatagaagggtggcccatgtgctgctggtcaagccaaataccagtgtccgcctccctgaagccagatggcaggaggagtgtgcaggagacccggagaggcctgggctcctgtagacatccactggtggatggtggggtcagagttgggcccttcagaagcagcaaggagtcctctggtcattctgtccccccagcctcattctttgggttgtgccaggggtgctrtccccctcccctacttgtccttttgagctccccataagggtacacaaagtgctccctgagaagtgccagaccagagccttggagaggaaatgctagaaagttccaggggtggcatcgctaaggagggctccttaaagaatgagagagctactgggaaggtggaggtgagcagaggctcaacggggggtggatgacagggcatatgccagggcagggagcagcgcctgctggagaggaggcttcatactaggggtaggaggagaggtgcagttggaaagggaggttggaatcactgtgggg

SEQ ID NO: 95215 - DNA, 601 bp, Human
ggatggtggggtcagagttgggcccttcagaagcagcaaggagtcctctggtcattctgtccccccagcctcattctttgggttgtgccaggggtgctgtccccctcccctacttgtccttttgagctccccataagggtacacaaagtgctccctgagaagtgccagaccagagccttggagaggaaatgctagaaagttccaggggtggcatcgctaaggagggctccttaaagaatgagagagctactgggaaggtggaggtgagcagaggctcaacggggggtggatgacagggcayatgccagggcagggagcagcgcctgctggagaggaggcttcatactaggggtaggaggagaggtgcagttggaaagggaggttggaatcactgtggggagcctgggatgccctgagaggaatttggatggaggggtagtagggagccattgaagggctttgagcaggggaggggcatttagaatcagcacatctctttgctgattgatttgaagcattccatacccacaaatgaaatcctgctggacagctctgcttttcagaagattctttttcctccctccctccctccttccctccc

SEQ ID NO: 95216 - DNA, 601 bp, Human
atactaggggtaggaggagaggtgcagttggaaagggaggttggaatcactgtggggagcctgggatgccctgagaggaatttggatggaggggtagtagggagccattgaagggctttgagcaggggaggggcatttagaatcagcacatctctttgctgattgatttgaagcattccatacccacaaatgaaatcctgctggacagctctgcttttcagaagattctttttcctccctccctccctccttccctccctctttccttctcttccttttttccacaagtgtttactggggscctactatgcgccgggcagtgtagtccctgggtggcagcagcgaacacacaggcaaggtccacttctctggaactgacattctagttgggagacacaggcaagtacccaaatcaatgactgtgcggaacaggatgtaagatgggtattctggcagggagagatgggggatcggcggcctcagccttccttgagacaggaacacttttcccagggttgttgaagccactgtctctctcaaatgtgctggttagggcgcaatagaaaaccacttcctctgctgtgggaggagaagaaactca

SEQ ID NO: 95217 - DNA, 601 bp, Human
acctcagcctttatggcgccacaacccatctgtaacaggagctgcaaatcacctgtgggctgcagacgattctgcccaaaagttgggggcggaagtgagagtaaaagctgacttgctaccatgcagacagcattgcctgccccgccagccccctccctccaccgatagagggactgtgctgccgtgtgtgtggctcagccgtcttgctgtggctcccaagtaccacgggattgagcctgagctctgtggtcacgtgccccctggcccacctctctagcctctgtgcctgcgcacctctgayggtgctccctgcttccagagtgccttcccctgcttttctacccctgggagggctacccaaatgccctccccataccagttagagtccgatcagtggagtagaatcaccgtgagagacttggaaccagggtggtgataggatcagctcctgcccagtcgtgggagcagtgatatctctacaaagccacggtctctgcctctggtgctgggctgaagtcattgtaggtcagtggcattggcgatctgagggggtgttaggtgtgacgtgggggagaacaaggacaagctggaacccaccagg

SEQ ID NO: 95218 - DNA, 601 bp, Human
catgcccggctaatttttgtatttttgtagagacggggttttgccatgttggccaggctggtctcaaactcctgacctcaagtgatcggcccatctaggcctcccaaagtgctgggattacaggcataagccacggcgcccggccccaaagagcttttttaatgtgggttatatctattgatatttaccttgtttgaaacttaaaaaaatgagaactatttaaaatattttgtcttcaaattcatttgaaaataacaatgatacaactattatatttatgaaaagagcttctccaaaattaaaaaaaaaagtaagaagagtaggattacacttctgcaaatatccttaatttctgtcttaatggaagacagctaaattctcatgtctacttctgcattgagtctgttgcactatgttgttttggttaaaatatatgaaggaaatccagtctaatacagatctagagatagaaaagaggagggtattttaaaagccttttcgcctaatttggatgttctttgatgctgcaccaaaacacgacattatggaatctgaaacagatcaaaggccttcccatgctgttggttaaaatccatgggtc

SEQ ID NO: 95219 - DNA, 601 bp, Human
catcacctggccccgctccagactcctttgcgggcgtagcgtcctcacccactcgctcgtatggagcaaacctaagagacccggccggcctgagaaccatgtggcagggctgaggggatggatccgcacgggaccttctgaggacagcttcctgaggcctccatgtcctgccattacacatgaggcccagaagggtcccctggtttgcccagggcctcacatgggatttgatgggatcctgtttctaaaccccgtgctccactcttgcctgtgcttttccagggcccttggttcaagggcsctgtggccctgtgcctgcatctggttgaggttcacagctgcctgaacactggggccttgcagagaggtggtgggaggagctggagagctccaaggagccccgctttcatccccgaggggtggcagtgcctcttccaagcctgcagggcaggggtgtggagggtgaagtctaacaccaggacagccagtgggtacatttagggctcttgtttgccatccaagaagaagcctccaagaagaaagtagcatctgcttctctaatcagcccctgggaaggagtgtggacgtgccagtggcctga

SEQ ID NO: 95220 - DNA, 601 bp, Human
catgtcctgccattacacatgaggcccagaagggtcccctggtttgcccagggcctcacatgggatttgatgggatcctgtttctaaaccccgtgctccactcttgcctgtgcttttccagggcccttggttcaagggccctgtggccctgtgcctgcatctggttgaggttcacagctgcctgaacactggggccttgcagagaggtggtgggaggagctggagagctccaaggagccccgctttcatccccgaggggtggcagtgcctcttccaagcctgcagggcaggggtgtggagrgtgaagtctaacaccaggacagccagtgggtacatttagggctcttgtttgccatccaagaagaagcctccaagaagaaagtagcatctgcttctctaatcagcccctgggaaggagtgtggacgtgccagtggcctgagacagagataaatggtgtgcaccgaccctttgaactggctgggcctagtctgggtgcatttagtgcagacaaagccaagagccaggaaggactgaaccacacaaggccgaggtgggccaggcactggcattggctaagtccttaccgagtaggtgctgggc

SEQ ID NO: 95221 - DNA, 601 bp, Human
ggccctgtggccctgtgcctgcatctggttgaggttcacagctgcctgaacactggggccttgcagagaggtggtgggaggagctggagagctccaaggagccccgctttcatccccgaggggtggcagtgcctcttccaagcctgcagggcaggggtgtggagggtgaagtctaacaccaggacagccagtgggtacatttagggctcttgtttgccatccaagaagaagcctccaagaagaaagtagcatctgcttctctaatcagcccctgggaaggagtgtggacgtgccagtggcytgagacagagataaatggtgtgcaccgaccctttgaactggctgggcctagtctgggtgcatttagtgcagacaaagccaagagccaggaaggactgaaccacacaaggccgaggtgggccaggcactggcattggctaagtccttaccgagtaggtgctgggcactacaggaaggaagcaagagtgcgtctctccctgcccctcctccccaaaccccactcccaacacgaatcactcctgagtcttgataatattccgagtgagtctgggccccaggcgtgtctctccagggactctcc

SEQ ID NO: 95222 - DNA, 601 bp, Human
ctggctcccttaaaatcaggacagtggagcgaaggtgggtttgggggccaatttctcctcctctcagccatcccaggctttgctttcttgccgagtctaaactctcagctgtcgccctcgtatttgctcaggggcccctgttagggggactgtgcactttcatccagctggacgccggagttccctggaagccgagagggttaaatcaccaagccagctggtgagcattagttcccccctctccaggcagtaacgtcagaggctgatgctggcggcaaagaagctggtggcaggaggaggyggagagctgccttgaggcactccgggggtgggctcctggcctgggaccctgccccagcaacccccaggtaggctggctgtggatgtgtgggctccggacaccctgcggggacggctgctgtccacgccagtgtgtggacgtgtgtgcacaccctgtgtgtctgtgtttcttctctttgtgagagttagccttctgctgtggcaaaaacttcagtggagaaggaaagagtgagcgctggagagggtagctttttttctagtgggaaggggactgacttctttaaacaaacactcaagtgtt

SEQ ID NO: 95223 - DNA, 601 bp, Human
tgccccagcaacccccaggtaggctggctgtggatgtgtgggctccggacaccctgcggggacggctgctgtccacgccagtgtgtggacgtgtgtgcacaccctgtgtgtctgtgtttcttctctttgtgagagttagccttctgctgtggcaaaaacttcagtggagaaggaaagagtgagcgctggagagggtagctttttttctagtgggaaggggactgacttctttaaacaaacactcaagtgttccagtggccacggagcaggcagacgtgggccacactgcatcttccagggkttctctatgccacttggggtgcagtcttgagtggccagaggagcagtttgctgaggtggcttaagaacatgttttctcatctgtctgtgaccaggaggcgtttcgaagggcttgccatgtgccgactcagtaactagtgtgtggcctcccggtggtttcagatgccttgccaaggccgacccacccccctcctcgaggaaatgcaaaaagtgttttcagggcccagaacactaagcctgggatgatctgctcctccctgactggcagcctgtcttgcgtgggcggccgagctcgcagcca

SEQ ID NO: 95224 - DNA, 601 bp, Human
acactgggtgaacttctactgtgaaagaaatagcagatccggcggacatttatgggcgacagagaagggtagctcagcattgaggagggagtttggtctcattctggccgagactgtcaaatcctcggatgggcttgtaaaccagctcctggcctagcctcatcaaacgtgaggatgaggaagagagagcctggtgggccctggggaggggacctgcactctcagtgggacacctggtgaccagtaagcctggtccactgcccttcctcaccctctcgtctttctaataaacagaggggargtgcctgtgcatagacttggggactattacattgactcagaaagaccctcttttcccttttgccccaaccagtgctttacgaggttgcctaagcctgtgctgcgacccccagaggcaggtgcaaccccattttacagatggggatgctgaggctcttcaccagggccgcccagctggatggcagtggggtgggtcacaccgagcctcctttcccctgggctgggctgccacccgaggcccccactatgtgttcctgtttgcctttgactccacgggggccgggagaaagtggcactgggg

SEQ ID NO: 95225 - DNA, 601 bp, Human
ggggaggtgcctgtgcatagacttggggactattacattgactcagaaagaccctcttttcccttttgccccaaccagtgctttacgaggttgcctaagcctgtgctgcgacccccagaggcaggtgcaaccccattttacagatggggatgctgaggctcttcaccagggccgcccagctggatggcagtggggtgggtcacaccgagcctcctttcccctgggctgggctgccacccgaggcccccactatgtgttcctgtttgcctttgactccacgggggccgggagaaagtggcaytggggatgccaccaggctgcttgtcaactggcctttgctgtgttccacacctctgacatggagatgaggctgtggtggctaagaccgggcggtgggccgagttcatgttcctgctatgccagtgatagctggacgagacctagagcaaggctgtgaactcttgtggccttggagttcttgtctgtgcagcatcctttcgggtgcaaggattgttacaagggttgagtgagctgttatcagcgaagcactgaacagtgtctggaaggtgacaaactcaacaaagtgtctctggagttagag

SEQ ID NO: 95226 - DNA, 601 bp, Human
tttgccccaaccagtgctttacgaggttgcctaagcctgtgctgcgacccccagaggcaggtgcaaccccattttacagatggggatgctgaggctcttcaccagggccgcccagctggatggcagtggggtgggtcacaccgagcctcctttcccctgggctgggctgccacccgaggcccccactatgtgttcctgtttgcctttgactccacgggggccgggagaaagtggcactggggatgccaccaggctgcttgtcaactggcctttgctgtgttccacacctctgacatggagrtgaggctgtggtggctaagaccgggcggtgggccgagttcatgttcctgctatgccagtgatagctggacgagacctagagcaaggctgtgaactcttgtggccttggagttcttgtctgtgcagcatcctttcgggtgcaaggattgttacaagggttgagtgagctgttatcagcgaagcactgaacagtgtctggaaggtgacaaactcaacaaagtgtctctggagttagagcagccttcttgtggtccctggacccggcagtgtgctatgggcatagtgccctgcacagcgggtc

SEQ ID NO: 95227 - DNA, 601 bp, Human
tgactccacgggggccgggagaaagtggcactggggatgccaccaggctgcttgtcaactggcctttgctgtgttccacacctctgacatggagatgaggctgtggtggctaagaccgggcggtgggccgagttcatgttcctgctatgccagtgatagctggacgagacctagagcaaggctgtgaactcttgtggccttggagttcttgtctgtgcagcatcctttcgggtgcaaggattgttacaagggttgagtgagctgttatcagcgaagcactgaacagtgtctggaaggtgayaaactcaacaaagtgtctctggagttagagcagccttcttgtggtccctggacccggcagtgtgctatgggcatagtgccctgcacagcgggtccagctcaagggacagggacaaaatgaccttttcagaagcgtgttaggaaacagcccgatgggccctaaggctccagaacctttgtgttccctgaatcctgaccctcacagggtccttgcatgaacttgacacaattaataccaagagagatggtgctgtccccattccacccctttgcatgtggctgaaggtcacaaggatagcaa

SEQ ID NO: 95228 - DNA, 601 bp, Human
aactggcctttgctgtgttccacacctctgacatggagatgaggctgtggtggctaagaccgggcggtgggccgagttcatgttcctgctatgccagtgatagctggacgagacctagagcaaggctgtgaactcttgtggccttggagttcttgtctgtgcagcatcctttcgggtgcaaggattgttacaagggttgagtgagctgttatcagcgaagcactgaacagtgtctggaaggtgacaaactcaacaaagtgtctctggagttagagcagccttcttgtggtccctggacccrgcagtgtgctatgggcatagtgccctgcacagcgggtccagctcaagggacagggacaaaatgaccttttcagaagcgtgttaggaaacagcccgatgggccctaaggctccagaacctttgtgttccctgaatcctgaccctcacagggtccttgcatgaacttgacacaattaataccaagagagatggtgctgtccccattccacccctttgcatgtggctgaaggtcacaaggatagcaaatggaaatgcctccgcaaatcacctgtttactatttttctgattattaaagtgatt

SEQ ID NO: 95229 - DNA, 601 bp, Human
caaatttcccatctgattttattttcagtacactctgaacccatcttctgccccttaccctagctcttcctcaggcaaccttgagtttccttctctaaggggaatcttgcaggagtggtctaggactgggaggctgagggggcattggaggagacacctggacaggtgtgcacagaggtggatgtgagaggtggatgaaggacatcccaacagggaacctgctcccaccccctgcacccccgccacccggctgtgtgtttcccaggcgaggctgtgtttgacatgcagcggccgcacaccrtctttggtatgccgtttggtcccggacttaatgagttctgcagggacgctccactgtagctaaagatcatttacctgaattgctttttaatttctgccgtgggaagctgcccccggtgtgatataattacattataatttacagcaatcccaaatctataaatttagccatacagtggggggaagggactggagttgtgtgtggggctgggggagaaatcccccccatcattaagtaaacccacgtttctgggtgcaggttccagtccctgggcaggtgtggaggaggcagagagggaca

SEQ ID NO: 95230 - DNA, 601 bp, Human
ggaacccaggttcggagaagctaagtcacttaccccacatcacgtagctggtggaggagaaaaagaccctgtgaaggctgttggatggggaaggtaagtagggggatagagagggaggaagagggaggcagcaacaaatttactcgctgtgttgaccttgactgttacgagtttgccccttggccagggggactgtgtggagtggtgctctggcagcagccttcccccttacaggggtgtgggcccccaccctgatacaggtgattgtccctcgccaccccgggaagctgctgatcctcakgcccaccctctgagctttggctcttacgttcacgagcgctggggctcagagatggcagaatggcggctccagagtgtccttccaggtgcttgtcattagccactgccccctgctccatctctggctgtaagcccctttgggccccctttgggtctacaccagcacctgtcaaactgactctgaggaggtcagagagggcaagtcatttaccccaaatgacacagctggtctttgaggatgtaagcctgtcctgagggccttgctttgagataaggtgtcccacagcctgatgttccaacc

SEQ ID NO: 95231 - DNA, 601 bp, Human
tggtctttgaggatgtaagcctgtcctgagggccttgctttgagataaggtgtcccacagcctgatgttccaaccaagtgggacatcaggacctgaactcccttgtcagtgacacacctgacaaaggatgtccccatggcatttctttgttgttgttgttgttgttttgtcttgagacaggttatcgctcagttgctcaggctggagtgcggtgacacaatcgtggcccactgtagcctcgaccacccgggctcaagcaatcctcccacctcaccctcccaagtagctgggactacaggtkcctgccatcacacctggcttatttttgtattttttatagagacagggtttcaacttgttgcccaggctggtctcgaactcctgacctcaagtggtccccttcccaaagtgctgggattacaggtgtgagccattgtgcctggcccccatgatatttcttatagccattggtactgccatgatttgggagttttgggagaattgaagcaagtacttagaatctgaaagaatgcatttcctgtttaaggagcccatttatcactcaggttttacaaatacatgataaagcccaaggaaggcc

SEQ ID NO: 95232 - DNA, 601 bp, Human
gccctccctccatgtccccctcctggtgcttcctgcagacatcagatccctgtgggtgtcttctgacaagtcttacccctgcccctagggctaagccccaaggccaggagatgtttggataatctggccagggatcacaggagcgctccttcctgtggctgctggttcgcagatggccttgcacaagccttggctgctcagagctttgcactccagctgtggcccagcagtgtcccagggagggataggatgctgggtgagaacaccacaggcccttactgctgggcacgatgggaggctrcctggtgacggccgcctttgttatgacagagcagagcgttgggccgtggccaggctctgtccagagacagctgcgaggcttccaacccggctgggtggggtgggagggagctgtggctggcatgcatctgcatgcacccaacttagcaagttcagcatggaggagagagggagagaggggagaagctgagacagagaggggctgagtgcatgcagctgaagcagtgccctcgtcccagtctgaatgtgccagagccaggttgggcgtgagggtctgccgtcctgtttacatttactcgtg

SEQ ID NO: 95233 - DNA, 601 bp, Human
agcgctccttcctgtggctgctggttcgcagatggccttgcacaagccttggctgctcagagctttgcactccagctgtggcccagcagtgtcccagggagggataggatgctgggtgagaacaccacaggcccttactgctgggcacgatgggaggctgcctggtgacggccgcctttgttatgacagagcagagcgttgggccgtggccaggctctgtccagagacagctgcgaggcttccaacccggctgggtggggtgggagggagctgtggctggcatgcatctgcatgcacccarcttagcaagttcagcatggaggagagagggagagaggggagaagctgagacagagaggggctgagtgcatgcagctgaagcagtgccctcgtcccagtctgaatgtgccagagccaggttgggcgtgagggtctgccgtcctgtttacatttactcgtgcctcctgtactgcaggctccagagctggagtttttattcagcttctgatgtttatatacacagttttcatgcacaggcccagaacccagccagccccctccctctgctgctgttcgatctgggaggcagtgtgcgtctcca

SEQ ID NO: 95234 - DNA, 601 bp, Human
tcccagggagggataggatgctgggtgagaacaccacaggcccttactgctgggcacgatgggaggctgcctggtgacggccgcctttgttatgacagagcagagcgttgggccgtggccaggctctgtccagagacagctgcgaggcttccaacccggctgggtggggtgggagggagctgtggctggcatgcatctgcatgcacccaacttagcaagttcagcatggaggagagagggagagaggggagaagctgagacagagaggggctgagtgcatgcagctgaagcagtgccctcrtcccagtctgaatgtgccagagccaggttgggcgtgagggtctgccgtcctgtttacatttactcgtgcctcctgtactgcaggctccagagctggagtttttattcagcttctgatgtttatatacacagttttcatgcacaggcccagaacccagccagccccctccctctgctgctgttcgatctgggaggcagtgtgcgtctccacacagaggagaccgctggactgcactctggaggaagtggggtcccctccgtgtgggaccttgcttgaggtgggcagaggtgctttggagtg

SEQ ID NO: 95235 - DNA, 601 bp, Human
cttttgagcagaagcgccttgggtgaaaagtgtagcaggcttggaagtcagagtgtgctgctgagtgagtgggagtctggtggaggtggtctttctaaccggccacaagaccctgggcccgctctgcccctccgtctgagtacctgccatcccagggggtgagtgctggctgggctcctggtgcagccacctgcaccgtgcagtgccatcaccgggtcgtgtcttgagcccctccttgccctcctgtttgtttaagtggccttggcctagctccctctgccctctgagggtctcactgtgycctagccctgtgggcatagtgcctggcacatagggggccctcagtctagggcacagggtgagtagaggaggaggttggccctgctggggcagcatgcttgccaagcctgtgtgtgtgtgggtttttgttcatgcttctgctggtgtgtacggagaagtgggcccagacacacacagacatacacggatgcccaccaggccccacgtccatccatgggaagggcagcacatgctggtaatgtgttccccaaacagcagcctcttgggctgcctgagctcagggcagagcagggacggggcc

SEQ ID NO: 95236 - DNA, 601 bp, Human
gagagtgtgagccctctggagaatgtgcaggtggctgggggagtgcccttcccagaacctcatggctggacctgtgagactccctgcccgtcctggtccccaccatgttccctctgttttctgggtgactctctctgcctcctttctctggttctctctgtccttctctgactttgttgctgtctctctcactgtttctttgtctgtccctctcttctctgtcattctgtttctctcacttggtccctgtcctggatcactctgtgtctctgtgtcttctgtctctgtgtcctggtttcaytctgcctccgtatctctctctgtctctttttttttttttgcctgtttggtctctttgttttcctgtcattctttttccctcatttggtcctcagtttcagctctgcctgtctctctctctgtttctgtcattctctctctctctttctgtcatcctctctctttctgtgtcattctccatgtttgtccttctgttccctttccttgtctgtctctgcacaccaaggttgctcccagctgggaggttggccctgtcccgatgcctggcccttcttctgccaaaggcatcttggaaagactt

SEQ ID NO: 95237 - DNA, 601 bp, Human
ctcatcggtcttgaatttgccccctggctgcccctggcaagtgctggggcttatacccaggagacctggggtcaatgacttgaaaatgaagtacccagaaccccatcaccctaccccacagacccagaattttagagagatggcagagagaagaaaggaggtgctaggaagggttgcagaggctgcctgaggcacggggtggcaccaggctgacccgggcagcagggcctggggctgaggcccaggctgtgtcccttcctgatgcggcctgagcctgggcactggtcagtcatccctgtgaggcggagaactctaaacctcgcttgcttctcctctaggcacactcgggcccttgtaagggaacaatatgtccctctcccacccccagcccagggctgagcagacctcaggccctttgggactgctgcttctgcccagggtgaggctggctgtgactcttttggagtgtgttcgggcaatgagaaaatctgtgactttctgctttgagaagagacaaacctgggctggaaggtagctctttccctgcaggctgtgtgatgggcaggtcacgtcactccctgagccttaggccatggagtct

SEQ ID NO: 95238 - DNA, 601 bp, Human
tacccaggagacctggggtcaatgacttgaaaatgaagtacccagaaccccatcaccctaccccacagacccagaattttagagagatggcagagagaagaaaggaggtgctaggaagggttgcagaggctgcctgaggcacggggtggcaccaggctgacccgggcagcagggcctggggctgaggcccaggctgtgtcccttcctgatgcggcctgagcctgggcactggtcagtcatccctgtgtggcggagaactctaaacctcgcttgcttctcctctaggcacactcgggccctkgtaagggaacaatatgtccctctcccacccccagcccagggctgagcagacctcaggccctttgggactgctgcttctgcccagggtgaggctggctgtgactcttttggagtgtgttcgggcaatgagaaaatctgtgactttctgctttgagaagagacaaacctgggctggaaggtagctctttccctgcaggctgtgtgatgggcaggtcacgtcactccctgagccttaggccatggagtcttcaagaggacgggtgggctgttaggtggcagcagaccggggaaggtctggtcc

SEQ ID NO: 95239 - DNA, 601 bp, Human
aggtagctctttccctgcaggctgtgtgatgggcaggtcacgtcactccctgagccttaggccatggagtcttcaagaggacgggtgggctgttaggtggcagcagaccggggaaggtctggtcctccacagggcagcagcaggtggctcaggggctctgctggtctctttcctctctgagacccttcctcagccgggtgctggccaagaatagctggaaaggaccttcctgcctgaaggatgggatgtactaggttgtgctcagggaccaggtcagacatggaaacttggggcctggagyccagggacatggctgcccatggcctcttaccagcctggattgctctgggactcttcctctcccagcccacctccaggcctccttcattttcttctcctcgcctttgcctttctctcctgtccaccctcctgcatttcctttccctgtcctagctccttttctttcttcctcggcttgtgcctaaggcctccagggcctacgagatggtgtttgcctgttgcggattctcagggccagaggcagtatagctgggggcctggcatttggggagggttcctaagggctgtaaccccagaaaca

SEQ ID NO: 95240 - DNA, 601 bp, Human
acccacaaacccagttttaaaattcagttggaaaccaatccacaagtcttcaaagtcatcttagtgctgttcttaaacttgcaaagtaacacctagtgggtctgtcattggcttgtctggctcagctgaagtcagagctcacagcacactggcctaactctcagtctggcttcaaagtaacctgtgatgctgctgcacagctctgggggtgctcagtcccccgcccccaaccgccacatcatcttgcccagcatcctctgcacaatgtacaaaaatgttttcaaatgcaggttttagcatsattcaggtatggtgaggccagtagagcaggggagagttgccattgaaaagatgatttgttattcacacttcccagtgggaggacaccccacaccatacaggactacttggggaagcatcagggtcagtcagtgaggcatccaggggagagcatgggaaggaggcttcattggtttttgtggaagggctggcaaggcagggccagaagcttagggttggccggtttgaatgattctagcagtctctgggccataggggccatcgctctttgtctgagacctggccctggggtgttagggca

SEQ ID NO: 95241 - DNA, 601 bp, Human
cttgcccagcatcctctgcacaatgtacaaaaatgttttcaaatgcaggttttagcatgattcaggtatggtgaggccagtagagcaggggagagttgccattgaaaagatgatttgttattcacacttcccagtgggaggacaccccacaccatacaggactacttggggaagcatcagggtcagtcagtgaggcatccaggggagagcatgggaaggaggcttcattggtttttgtggaagggctggcaaggcagggccagaagcttagggttggccggtttgaatgattctagcagtmtctgggccataggggccatcgctctttgtctgagacctggccctggggtgttagggcagaggcatgtggcctcccagagtgtagagccaggtaggggagatggtttggagtatggactctggatcagttggtttgcacacaaaaaggctcactcctgggtgagtgctttgctgtcactcagccagccttgggaggggctgccttccctcagtcatcgaagccccagatgtgagaacattagaaacacagaaaacaagaaagtagagttaataccaatcatcaggagctgtgagatggggt

SEQ ID NO: 95242 - DNA, 601 bp, Human
tcgtgtgtaaggaccttctggtgcactcctcatgtggcatttcaggggctctgcaccccatgttctctgggctaaacccacatgggtcctcactcttcagctcgttttccactgtttgtgtgcgacatttgggtggagttgtgaccaggcagccttatcatttttggagcaaacattactattttgataaattgactggtttttgacaaacacaccaaactgaaaaaaagacaatctctctgagggaaggaaagtgatcatcaaacagtgaagaccaggatttgggggtggtatgggtggrgccaatggtcttttagtggcattgctgtactcatttgatagacaaagaagctgaagcaggaaaagaagcttaggcagtgccccacagagctgcccaggagctgagcacaaccaataccaggctttggtgggagttgatcagatgcagccttagggaagattggctcccgttgttgctcaggtgaggcgtcagtcctcccaggccccagccagtcacaggcaccagactttttttttttttttttggagacagagtctcgctctgtcacccaggctggagtgcagtggcatgatttcggct

SEQ ID NO: 95243 - DNA, 601 bp, Human
agacaatctctctgagggaaggaaagtgatcatcaaacagtgaagaccaggatttgggggtggtatgggtggagccaatggtcttttagtggcattgctgtactcatttgatagacaaagaagctgaagcaggaaaagaagcttaggcagtgccccacagagctgcccaggagctgagcacaaccaataccaggctttggtgggagttgatcagatgcagccttagggaagattggctcccgttgttgctcaggtgaggcgtcagtcctcccaggccccagccagtcacaggcaccagactttttttttttttttttggagacagagtctcgctctgtcacccaggctggagtgcagtggcatgatttcggctcagtgcaacccccgtctcctgggttccggagattctcccgcctcagcctcctgagtagctaggattataggcgcccgccaccacacctggctaatgtttgtatttttagaaaagatggggtttcaccatgttgaccaggctagtctccgactcctgacctcaggtgatccgcccacctcagcttcccaaagtgctgagattacaggtgtgagccaccgcatcggccca

SEQ ID NO: 95244 - DNA, 601 bp, Human
ccttagggaagattggctcccgttgttgctcaggtgaggcgtcagtcctcccaggccccagccagtcacaggcaccagactttttttttttttttttggagacagagtctcgctctgtcacccaggctggagtgcagtggcatgatttcggctcagtgcaacccccgtctcctgggttccggagattctcccgcctcagcctcctgagtagctaggattataggcgcccgccaccacacctggctaatgtttgtatttttagaaaagatggggtttcaccatgttgaccaggctagtctcsgactcctgacctcaggtgatccgcccacctcagcttcccaaagtgctgagattacaggtgtgagccaccgcatcggcccagactatctgttttgaccttacatgtaactttgctctggaagtatcttaccttggcatgtctggtctttggagaacacacatatgcacagaaagagatgtgtgtgtgcgtttgtgtgtgtgtatgtgtgtgtgtgtatacatatatatttaaatatttaatattttaaccacaccaaagagatgtaacaaatacatgtacctccatgcagcttaacttttt

SEQ ID NO: 95245 - DNA, 601 bp, Human
ttagtttcatttgcattctgctcttttgcaacgtattggacgtttgggctgcttctccctgatttgcctatccatctcctttgctgagctttttactgggttgctgtgttttcctgaaagtacttttaagagatactaatcttaaaaatcttaatcttaggccgggcgcggtggctcacgcctgtaatcccagcactttgggaggccgaggcgggcggatcacgaggtcaggagatcgagaccatcctggctaacacggtgaaaccctgtctctactaaaaatacagaaaactagccgggygtggtggcgggcgcctgtagtcccagctactcgggaggctgaggcaggagaatggcgtgaacccaggaggcggagcttgcagtgagccaagatcacaccactgcactccagcctgggcaacagagcgagactccatctcaaaaaaaaaaaaaaaaaaaaagtcttaatcttgtttagacatgttataaataatttctcagtcttctgttggccattatctttgggtatggcatggtttattgagacaacggttgtacattttaacacagtcgagtgtatgattcttttcctctgtggctt

SEQ ID NO: 95246 - DNA, 601 bp, Human
tattctatttcttaatttttaatgatttttttaaatgcaaaaactgtcacatgtcaattttccttgcatatgtagctctgtttccgggctccctactttgttcctttggtctattagtttcttctggtgccatctcacattgtcttaggtcttacagctttctgttaagcatggcagggaaaatcccctcatgtgttcctctttcaaatggtcttggctctttttctgcccttgttctaccgtgagaactttaggatcaacttgttagagtcctgaaaatccctgttggggttttgattakaattgagttatttgtgaatgaatttggagaagattgccatctttgtcattttgagttttcccgcccatgatcacggcctttctccctatacttattggttattttatgtctttttgttttatcatttgtatcataagggtcttacacattttttgttacatttattcataagtattctgaagttttctttgctgctgtaaatgttatatatataaaatatacacacacatatatatatgtttaaaaattacagtttctagttcattattgctggcatctaggcatgtagttaaattttat

SEQ ID NO: 95247 - DNA, 601 bp, Human
tactgaggccaacacccactcctgggctgcttagtgtcagctctctgtctggtctttggggtccctttgttatctggccctacgtggcctctttccttgccagctgaaatgtgcatctaaacagatgttcattctgtttattgagctggagggcctttagtttcccttgttgatcgtatggctgaaactcgaagtcgctacgctgttgtttttcctatgcaaaattaaaggtagaaaatgaagttgatggagaaagaaacacacattttgagaaagaactgtgtaattattatccactccmtgcaaaagacccatgaagtggtcggttttcagaggaggaaatccttggcgtctgccttattccaaaatccactggctaagtcactcaccacctaagccctcttggacgaggaccaaggcttctacgctccatactaaggcacaatgtgagggattctacagagggcctagtgaagagagaggagagggcccatttcatctcactttgcctggggccatcctgcacgctgctctgctgtgtgatctctgcaggacacttgaccattttgtgaacacatccttatcagtgaactgctatttt

SEQ ID NO: 95248 - DNA, 601 bp, Human
cctgggctgcttagtgtcagctctctgtctggtctttggggtccctttgttatctggccctacgtggcctctttccttgccagctgaaatgtgcatctaaacagatgttcattctgtttattgagctggagggcctttagtttcccttgttgatcgtatggctgaaactcgaagtcgctacgctgttgtttttcctatgcaaaattaaaggtagaaaatgaagttgatggagaaagaaacacacattttgagaaagaactgtgtaattattatccactccctgcaaaagacccatgaagtsgtcggttttcagaggaggaaatccttggcgtctgccttattccaaaatccactggctaagtcactcaccacctaagccctcttggacgaggaccaaggcttctacgctccatactaaggcacaatgtgagggattctacagagggcctagtgaagagagaggagagggcccatttcatctcactttgcctggggccatcctgcacgctgctctgctgtgtgatctctgcaggacacttgaccattttgtgaacacatccttatcagtgaactgctatttttgtaatggcagttcccccca

SEQ ID NO: 95249 - DNA, 601 bp, Human
tcaagagtgatgacttcttgactattctagtttttctgtcttcattcatttcaacagtatttaccgagggtcttctgtgtgcccagcactgtcctgggcactgtttaaaacattgcttcattgcctctggtatgccaggtgctggcaggacagaggagaactggacttgccttctagcctgctcagagtatggtgggggagaggcctgtccctagattccagtgcagagcagaatgcgtgggccagttggggtctctggttccccagttgggaggaggaccattgcaagccagtctggagtgtgtgtgtgtgtgtgtgtgtgtgtgtgtgtgtgtgtgtgtgatgctgggctctgggaaagataaatgaaggcccttctccttcactccagttcacttttggatgaactgttggaggtatttggcttttggtaagttttttttaaaattttattattttagctacagtaatttacatgattcaaactcaatagttacctatttgtcaactcaaaaaaaaaaaaaaaaaaacagacttctttgcttaaagttgatgagattgaaaccaaaaaaaattcaggagttactaaaggttatatggt

SEQ ID NO: 95250 - DNA, 601 bp, Human
caagagtgatgacttcttgactattctagtttttctgtcttcattcatttcaacagtatttaccgagggtcttctgtgtgcccagcactgtcctgggcactgtttaaaacattgcttcattgcctctggtatgccaggtgctggcaggacagaggagaactggacttgccttctagcctgctcagagtatggtgggggagaggcctgtccctagattccagtgcagagcagaatgcgtgggccagttggggtctctggttccccagttgggaggaggaccattgcaagccagtctggaggttgtgtgtgtgtgtgtgtgtgtgtgtgtgtgtgtgtgtgtgatgctgggctctgggaaagataaatgaaggcccttctccttcactccagttcacttttggatgaactgttggaggtatttggcttttggtaagttttttttaaaattttattattttagctacagtaatttacatgattcaaactcaatagttacctatttgtcaactcaaaaaaaaaaaaaaaaaaacagacttctttgcttaaagttgatgagattgaaaccaaaaaaaattcaggagttactaaaggttatatggtg

SEQ ID NO: 95251 - DNA, 601 bp, Human
ttttattattttagctacagtaatttacatgattcaaactcaatagttacctatttgtcaactcaaaaaaaaaaaaaaaaaaacagacttctttgcttaaagttgatgagattgaaaccaaaaaaaattcaggagttactaaaggttatatggtgaaaaatctccctctcagccagccccctggttcccctccctggagacgaccaatgttccctgcctctcacatatcctttgcaagagattctagatgtatacacataaataaaacattatttgtttatatttatatatgtgtgcttayctataaatttacacacatacatacatatatatgttttttaatgcaattgtcagcatcttgttttttttgcatgacaatgtatcttggaaattggtccatatcagacctggagcgcttcttcatttgtttttatggctgtttggtattccattatgtggacagactgtaatttatttaacgagtctccctctgatggatatttagatttccaatcttccgctattttcaaacaatgccatgagaaatcatcttgccaaggtgcgtcccacatttgagagcatgtttgtgggatgcaggatg

SEQ ID NO: 95252 - DNA, 601 bp, Human
aaaccaaaaaaaattcaggagttactaaaggttatatggtgaaaaatctccctctcagccagccccctggttcccctccctggagacgaccaatgttccctgcctctcacatatcctttgcaagagattctagatgtatacacataaataaaacattatttgtttatatttatatatgtgtgcttacctataaatttacacacatacatacatatatatgttttttaatgcaattgtcagcatcttgttttttttgcatgacaatgtatcttggaaattggtccatatcagacctggagcrcttcttcatttgtttttatggctgtttggtattccattatgtggacagactgtaatttatttaacgagtctccctctgatggatatttagatttccaatcttccgctattttcaaacaatgccatgagaaatcatcttgccaaggtgcgtcccacatttgagagcatgtttgtgggatgcaggatgtagcttacagggagctcctggcatgccgatgtgagaaccgaccctccatagcaaggctgccccacatggcgtgggctggcctggcctctgagcttcctaagggctaaacctata

SEQ ID NO: 95253 - DNA, 601 bp, Human
cttctgaacttgagaaggaagctcccgggatgggcctgactccgccgcctggttgcaatagtcctggaaggggcggcggagcaagcagaagcctcctgccctggcccgtgggtttgcaccagctagaacgtggggctcctccattaagagctccttggcgttgggagctacgcagcctcacccctcatcttatcacaccaggagaccggcgagcagagtggggatggccacacagggagttcgcagcagggtggtgctctgcctaccgactcgcccctggggttgtccctgtcgcctcagsctttctctttattttgggtggaggcagggtactcaggacagggatgaaaacttaggtctgtttttcattgttcatcctattcttggcaacttttgcagaaggcgctggcaggaaggagaccctggggagggaagagttggaggagaaagaagtctccttggcacctttgcctttcctgctaaaaatggtggcagttctgcatttctactaaaaatagctagtcctctgtcaagaaggccacccacactggggtgtggggactggggacagcaagatgtgggccctgggccacacattctg

SEQ ID NO: 95254 - DNA, 601 bp, Human
caaggatatgcgctaagtgaaacaagccagacactagaggacacgtcctcatgattctacttatatgaggcccctagggtagtcaaattcagagagacagaaagtagaatcgcagctgtcagcggctggggaagaggggaatgaggagttaatgtttaatgtgcacagagtttcagtttgggaagatggaaaagttttgaagattcacaacaatgtgaatgtatttgatgccactgaactgtacacttaaaaatggttaaaatggtaagtcttatgttatatatattttaccatcattttwaaaaaattaaatgggtgtcgttgattcctctcttcctctcaacctcccatatagaatgactagaatccaggtgtttatcttttatgccaatagtgatgatgatgatgatgatcatgatgatgatgatgatggcggcaattgtgttcttttgtagagaaagtaaggtaactctctggggtaaccagggcagaccctgtgagtattggatcctagtgccaagcttggagcactctggcatttgggggtctccctatggaattgctaaagctaccattggacaagccccactcatctatgcag

SEQ ID NO: 95255 - DNA, 601 bp, Human
agacaagctctcaggcagatgggaggggacaataaggctatcttcagtcatataggagggactcaaagcatttaccttctgtatatctttggcctttacttaaggattctctcttacagcgtaagggagtaagtgaatgcagggaagacctgaggtcccaggagggagacccccaagaagggaatgatagcaaggccggggctgtgcagctgccccctctctacagtcagagcagaggcttgagggattccaggggagggactccagaagagggctgcagccctggtgcctttggaggatsgggagctgctgtcatcactgtgcgagaggcaggggttggccttatacaccattctgtgtgtggtgggggaggtccaagtgaattgagttgtcctctgtataaataaccaataaatcagaaacattaagctcataggattaaagaatcaaaacgtggtattttaataccttccttatatagatcagatagctgccagaggaattaagagcaggaacattttttcaaagttaaaagtggttgcctccagggcacagggaggggactattgcctttcattataagccctttggtgctatttgt

SEQ ID NO: 95256 - DNA, 601 bp, Human
tcaaactgctcacattctggtggaaaaaaaccagccaagagtgtaggagttacagtgtagagaggtaagagcacaaaagggcagcccaagggcagggccgggagtcaaggagagcttcctggaggaggtgactcctgagctgagtctcagaagaggagcagaagtttgggtcaaaaatttctaggcaaagagtacagcaagtgtgaaggcagtgaccctggcaggccctgtcagttcacctccatcctctggtcacacttgggtcccacttttaagagggtctgcctgccagttccagccrcgcatagccttccctttcctgaggccgacaggatgtgtcatatcacctgcccagtgctgcttcaaggggggctgccccagtcatctgctgagtgtgtgagcagtcccctcccctgcaggctgtgacaatcaggggaaatcaggatcccagaagaacctttggaaccctgaggggctacagctgcagaaggggtcgtgtttcatgtcacccattatatttggtctccacgatgtgtatgttctgaggttttctgctttcaatgcctgggacacgcctgaagatgaggagaaaccagaagga

SEQ ID NO: 95257 - DNA, 601 bp, Human
gaggtcccagagggctttccggctgcacgctgaccctggaggcagctgtcagctgtggcaccatggttgttctcgtgcttggagctgtcttcaaagccagtgagcgagccactcaagaaacttggttggtcaggtggcttcacagatgtactctgctttttacccaaacagtctgcacagtgcattgtccatcagcatgtgtacccagggagcactgtgaattcagggccctgtgtctccagtactcagcatggttacagaatgggtgaaggtgcagtgaagtgacaccctcttcccatcwctaaggatattcacaaggtttaaaaacagttcccaaagcaggattcccaaagacgctctccagagaaaccgtggagccccccaggggaattgagatgatgaaactactgcgagctcacttttcttagggttccaggcactgcttggttttccatgcactggattatttaatcctccaacagccctggtaacagtcccataatcctcactggacagtgggggaaatggagaccacagaggtgatgtgatgggcctgaggtcccacagctggtaaggggtggagcagccttccagccctggc

SEQ ID NO: 95258 - DNA, 601 bp, Human
ctgtgctgggcctcctctccactcaggaaggcacacatatgttctattaggttcattaaggaaaatcagttaccctatttaaaacaccagcaggcaccatttgtgcagcgcctacttggatctggggacctggattatctcgtgccatcttgataaaagcaaggtcactgtgcttgtccccagtttacaaaggggtcatttgaggctcagggagggaggtgacttgagcagggctgtacaactggaactgatccctgggctgctgactcctcagcctgagttctccctgctgtccatcccrcacttattttccaacacctcaggctgagaagctgcctgttctgcctgcctggcttctctcatgatgccagccaggagggagtgagggcagggggtgcccacctctagcagctcaggcaggttctaatgtgggcattggcagcgccttctgggatcagagctgctgtgccactcaccttgccaccctttgttgcaccttctagctccttcctgtggggctccaggttgggaatcaggcctcccatttatggcaggtttgggccgactgtgcccgggccaggaagcaggacggctcctaggt

SEQ ID NO: 95259 - DNA, 601 bp, Human
gggctgctgactcctcagcctgagttctccctgctgtccatcccgcacttattttccaacacctcaggctgagaagctgcctgttctgcctgcctggcttctctcatgatgccagccaggagggagtgagggcagggggtgcccacctctagcagctcaggcaggttctaatgtgggcattggcagcgccttctgggatcagagctgctgtgccactcaccttgccaccctttgttgcaccttctagctccttcctgtggggctccaggttgggaatcaggcctcccatttatggcaggtktgggccgactgtgcccgggccaggaagcaggacggctcctaggtagagatttggatggggttctcaccatcatgggcctcgttttaaagtggacctgcccaccgccccgatctccactgcctgtagactttgcagtgtccggacctggctttgacctgggaccagccactgtgtaagggagctggctcagctgcctacagaacactctcatggcaccggaacctccagggccccctaatctccagggactgcagtcccgagccctctgtcattctacttgcctgaccactgccctcccat

SEQ ID NO: 95260 - DNA, 601 bp, Human
ctgactcctcagcctgagttctccctgctgtccatcccgcacttattttccaacacctcaggctgagaagctgcctgttctgcctgcctggcttctctcatgatgccagccaggagggagtgagggcagggggtgcccacctctagcagctcaggcaggttctaatgtgggcattggcagcgccttctgggatcagagctgctgtgccactcaccttgccaccctttgttgcaccttctagctccttcctgtggggctccaggttgggaatcaggcctcccatttatggcaggtttgggcygactgtgcccgggccaggaagcaggacggctcctaggtagagatttggatggggttctcaccatcatgggcctcgttttaaagtggacctgcccaccgccccgatctccactgcctgtagactttgcagtgtccggacctggctttgacctgggaccagccactgtgtaagggagctggctcagctgcctacagaacactctcatggcaccggaacctccagggccccctaatctccagggactgcagtcccgagccctctgtcattctacttgcctgaccactgccctcccatggctct

SEQ ID NO: 95261 - DNA, 601 bp, Human
ggagacctggaatgaatgtggggtgagccctggcccaaaggcatttgctaaatgtttgtggaataaacaaatgcctacacaggaaatgcctcctaacataaggatgcagttcgcccacccctccgccaggctcctgctgtgtgccaggcattgcacgaggtactggggacacagcaggccttgccgtctgggggctccagggactcctgggttatgtctgccctgccactaaggtatccgtgtgacttcaggcatccctgtttccttatctgtaaaacatgctgagctgtgcgtgaccccrtctctctgtcttctgtggggtggattggcaagagctgtgggagccggagcccttgtgggtccatcgtgagcactttgtgtgtaggtgggccggtgagggtgctgagctgggcaggtggggggccaagcctgggccttctcagatctttgaggaaatgcacaatatcttattcattatcgcttcactggtgcctgtgcagggcaggcactccgaggttctgggtgagcgagtgtggggttagcaatacagccaaagtggaaggctggccccggctcagagcggggctcctcccgcctaaga

SEQ ID NO: 95262 - DNA, 601 bp, Human
ggctgcagacaccttgggaaggggtctctctggagatggccgtggggtccagagagcagccctttctgtggggcattcactgttggggtccaaccagttctcttccaactcggtagtgcctcattctgagcctgaacattgccccagggaagctgaggggaagggctggtgatggtgccctgggattctgcctgaggcctcatcacttccatctatgggtagtatccggggctggggagcccgagccaggagggctgactaaacgtggctcgagtgtctgagcgcttgcctgtgtcagtgsagcccttcgcggttccagagcagccactgcatggaggggagcctcatcgatgagctcactgcatgcaaacagtagctgggccaggtcctgctgtctgcatagatgccctgccccccatgtaacacagttgccacccgactactgtcagaaggatcaggattctgaacttaaggagttctgtcctcgccactaggagggacggggtccttctggcaagggtcccatcaggaaagagttggaggctccattccaccagcctccagcatggtctagttctcccccgaggctgaggaaaagttt

SEQ ID NO: 95263 - DNA, 601 bp, Human
gcccctctgcattcaaggctttgccatgcgtcccactccgggtaccccaggcaggccaggctctctctctggacctggcaccccccctgttcaagagagggaagagcaggccatttccagcccaacaccctgtgcctggggccagcactgcccagactcagagtggggatgcagttggtgtttatgggactcactcttgctccccatgctgaaagatgtccacagttccttcaagattcgaggaaggcccatgcaggcctgagctgatttcttggcttaagatggggtcccatagcccccsgcctcctgcataagaaacatgtcttactctagaggcctcagcctgtgcttctgcaggaatgtagcagagggtgttggggatagggtagggctggagcttggccacagtcagagggtctcgggtagggacgtggagtctgagcctgtgacgaggagagctacgggacaggtcagggcaagggcagcgggtggccgactctggagtgcccccctcctggtcagggcccttcctcccatcctgtcctgggattaatgtcaaatgtcttgtgcttaatggtttaatgtcaaatgtcttgtactt

SEQ ID NO: 95264 - DNA, 601 bp, Human
tgtgcctggggccagcactgcccagactcagagtggggatgcagttggtgtttatgggactcactcttgctccccatgctgaaagatgtccacagttccttcaagattcgaggaaggcccatgcaggcctgagctgatttcttggcttaagatggggtcccatagccccccgcctcctgcataagaaacatgtcttactctagaggcctcagcctgtgcttctgcaggaatgtagcagagggtgttggggatagggtagggctggagcttggccacagtcagagggtctcgggtagggacrtggagtctgagcctgtgacgaggagagctacgggacaggtcagggcaagggcagcgggtggccgactctggagtgcccccctcctggtcagggcccttcctcccatcctgtcctgggattaatgtcaaatgtcttgtgcttaatggtttaatgtcaaatgtcttgtacttaatggtaatcccattgcttaaggtaagatctcccttttggggacagaagagctgtttttcatattcttgatgccttgagatcagatgcaaaagaaggtatagaatgccattggggtgacaaagagtgatg

SEQ ID NO: 95265 - DNA, 601 bp, Human
tgcagttggtgtttatgggactcactcttgctccccatgctgaaagatgtccacagttccttcaagattcgaggaaggcccatgcaggcctgagctgatttcttggcttaagatggggtcccatagccccccgcctcctgcataagaaacatgtcttactctagaggcctcagcctgtgcttctgcaggaatgtagcagagggtgttggggatagggtagggctggagcttggccacagtcagagggtctcgggtagggacgtggagtctgagcctgtgacgaggagagctacgggacagrtcagggcaagggcagcgggtggccgactctggagtgcccccctcctggtcagggcccttcctcccatcctgtcctgggattaatgtcaaatgtcttgtgcttaatggtttaatgtcaaatgtcttgtacttaatggtaatcccattgcttaaggtaagatctcccttttggggacagaagagctgtttttcatattcttgatgccttgagatcagatgcaaaagaaggtatagaatgccattggggtgacaaagagtgatgacgacaatagcaatgacccctccccaccccattatgtct

SEQ ID NO: 95266 - DNA, 601 bp, Human
gctctagctgctttctggagacaggactgggccaagagttctctattctgttccattggtctatgtgcctgtttttgtaccaatgcttttttggcagggaggtcacagaggagaccatttctgggcctggaattcctgagagtggcctggccccagtggggacagggaggggagagaagcaacctggggcacacttccctagccagtcctatgtttgtgagacctgggagggctgtggtcagggggctgggccctgggggcaacagtgcctttgcatttgaacacaaagtgccacttggtrtaatgggcacagctcagtcttggctgttcttgagttttaaacaaatcatgatccccaccttccaaacaatttagtttttttcccctagctagccccatcacaaacttttgaagcatgaaatgaattttgctggccctcaccaataggatcctttccctagataatggattttatgaaatggccataatcctcctaggtaatgagcaaaagctacactctccacttgggtccagcattcctcttcctgatttatgatagattggttaaaatagtaaactgatagcagttgcaaaatagtca

SEQ ID NO: 95267 - DNA, 601 bp, Human
acctaatagtaatagacccatttcatgttaatgaaaacaaccaatttttatggaaaatatttcccagaacaacaacaaaaatgtgaaagatggcattacttttcaatttgacagacctctttgctgtctggcctagtggaaggatgcattctcctagcttttccgccttgggtctgttgcatagcagcctctggacacccacagtgtctattcaagagagaagaagagtgaaaaacacaaataatgtattagtatagagatagttttgactttgcagaccccttgaggcagtcttggggawccccagggctctgcagtctacattttggtccgcttttgaatgcctacagaatgtttttgaccttcccacctgaggctgggctgggaacatccctccagcaaccacaggctccccgagcctcctcatctgaccgaacctgtgtccacagagcatctgagctctcctctctatcattgtgaaatggaccgacataaaatctctcttgtttgcagagttcgtaacgacagagaacatttccataccttctcacaatcatctttgtggggagacagccaggagactgcaccctcttgcctagaa

SEQ ID NO: 95268 - DNA, 601 bp, Human
tgttgcatagcagcctctggacacccacagtgtctattcaagagagaagaagagtgaaaaacacaaataatgtattagtatagagatagttttgactttgcagaccccttgaggcagtcttggggatccccagggctctgcagtctacattttggtccgcttttgaatgcctacagaatgtttttgaccttcccacctgaggctgggctgggaacatccctccagcaaccacaggctccccgagcctcctcatctgaccgaacctgtgtccacagagcatctgagctctcctctctatcaytgtgaaatggaccgacataaaatctctcttgtttgcagagttcgtaacgacagagaacatttccataccttctcacaatcatctttgtggggagacagccaggagactgcaccctcttgcctagaacacccatgttgtggccagatccccatgtcgggaacctgctccagggataatctgctgcccccaagtcctgggggtctggttccatggggtttgctcatcttctaggactttggtcacaggggaacaatccaactcctgcctcctcctcaccccagaggctcccggctgcacaca

SEQ ID NO: 95269 - DNA, 601 bp, Human
tgttcaaccgcctggtgcctccttttcagaaccacccctcccagccaacagagcccggtctgtgcgggctccgtgggtctgtgtgagagcccctgtttgccttggctttggtctgtcttctcaactggctggccggcccttttcaaaaatcggctgggtgttatgaaactttattttccaaagagaaaaatttctgggcctgtagcaagagggaaaaaagttatactaataatcaaaagcaccagtagtcaaagtaggatggtgagggtttggagaaacactgaaagttgtcacaaaacastgcagctcacccatcagccgcagcccccgtctgtgcgcagagccctagccatgctggcttctccctgcgtcagcatttggggaaagacggatgtgcctggaagcgggccttgctcctgtctgtgtagacaggccggcgttgaatgtctacgggtggcatctatcatccgtgacctgtagcatttgtgctttttgtttatggtctctcggcatgcattgttttctcggggctgaaatatagcacgctaatgaggtatctctctgctcaggaggacgcaggcagctcagaaagacgcctcgg

SEQ ID NO: 95270 - DNA, 601 bp, Human
ggtggcatctatcatccgtgacctgtagcatttgtgctttttgtttatggtctctcggcatgcattgttttctcggggctgaaatatagcacgctaatgaggtatctctctgctcaggaggacgcaggcagctcagaaagacgcctcggcagcatgctgactagtttgtcaacagccactcgctgtggcagctgctgtcccagccaagaagaaaagagtaggaaatgctaggagaagctgcagctgggggtggagggtactcggtgcctgggaacctcagctcagttgagtgtctgccctrcaggtgacttgatgtttggccctggtgccagtcatttctaggaggtatacgacttgggggtgtcaagcaaactaggttagggtcctagcttcccagacactttcggcctgaaacactcggctcctggagcctgtttcctaacccataaaacggtgaggtgacctctgcctttgtgggtgtctgagactcgccagtggcctgtgttctgtgctgggtaaatggcatcagggagcctgctggtggtgcctgtgcctggcatggggctactttgtatgtgcaggtgtttttcctaagctggga

SEQ ID NO: 95271 - DNA, 601 bp, Human
atggagaccatcctggctaacgcggtgaaaccccgtctctactaaaaatacaaaaaacttagccgggcgtggtggcgggtgcctgtagtcccagctactcgggaggctgaggcgggagagtggcgtgaacccaggccacggagcttgcagtgagccgagatagcgccactgcactccagcctgggcgacagagcgagactccgtctcaaaaaaataaacaaacaaacaaataaataaatgcaaagtggaatcaggagctgaatttcttaaacatccaaaatggtggcagtgggtctctccrctcagctgctccagcagccacacttcccccggaagctcactgatattctcccagcagcgaagataaatgagatcaaatctcaccaggaggaagatttaaaaatcacttaatacagtttaaaatactcaccggagaaatcagacaagtaggggatggcagaaggtggaggagggggacttttcttgcaggggtttgcagctggcagggttggaggagggacacaggtgagtcacatgccctctgaggaaggcctggctccactggggctttgtgtgccagctcccagtgggtcggcaggga

SEQ ID NO: 95272 - DNA, 601 bp, Human
tgaacccaggccacggagcttgcagtgagccgagatagcgccactgcactccagcctgggcgacagagcgagactccgtctcaaaaaaataaacaaacaaacaaataaataaatgcaaagtggaatcaggagctgaatttcttaaacatccaaaatggtggcagtgggtctctccgctcagctgctccagcagccacacttcccccggaagctcactgatattctcccagcagcgaagataaatgagatcaaatctcaccaggaggaagatttaaaaatcacttaatacagtttaaaatastcaccggagaaatcagacaagtaggggatggcagaaggtggaggagggggacttttcttgcaggggtttgcagctggcagggttggaggagggacacaggtgagtcacatgccctctgaggaaggcctggctccactggggctttgtgtgccagctcccagtgggtcggcagggaggagcaaggttctgctggctctgctgaggccgcccatgtcagggtcaggcacgtggggtccgaggcaggtggaggctcattctgaaaaggcagatgcacttgcagaatgatgtttaggatttggg

SEQ ID NO: 95273 - DNA, 601 bp, Human
ttcttatttgccatccttcgaaggcagcaccccctgttaccatgataacataaccttgtgcacctccatttctgaatctgtaaaatgggggcaagtcactaaccttataagatggtcggtggaattaactaagcaaatttatctaaagcacctgacaccctttcaggcacacagaggttccaagatcttcaatgtgacgctttcaagaaaggcaactcaagttcagggcttctgaatcctactccaaataccctgtcatagtcaacacatccctgaagttccctacaccatgcctagaagmactgaggctgggcagtatctccttgtgaaaggcctggcccccttccccagggtcctgcttgaatgtcagaggacaggtggggaggaggatgggtggagaaggacagtggcagggaggacagtggggagagggcaggtggggggaggacaggtgaggggaggacaggtaggggagggcaggagtgggaggactgtggaaggtggacaggttgggggaggacagtcgtggggaagacagtggggagagggcaggtcaagggagggcaggtgggaggaggacagtgggggaaagacagtggtg

SEQ ID NO: 95274 - DNA, 601 bp, Human
tgacaccctttcaggcacacagaggttccaagatcttcaatgtgacgctttcaagaaaggcaactcaagttcagggcttctgaatcctactccaaataccctgtcatagtcaacacatccctgaagttccctacaccatgcctagaagcactgaggctgggcagtatctccttgtgaaaggcctggcccccttccccagggtcctgcttgaatgtcagaggacaggtggggaggaggatgggtggagaaggacagtggcagggaggacagtggggagagggcaggtggggggaggacaggkgaggggaggacaggtaggggagggcaggagtgggaggactgtggaaggtggacaggttgggggaggacagtcgtggggaagacagtggggagagggcaggtcaagggagggcaggtgggaggaggacagtgggggaaagacagtggtggggaggacaggtaggggagggcaggtagtgggaggatagctggggtggcgggggggaggacaggtgggggaggacagtgcaaggagggcagtttgggggaggacagtgtggggacggcaggtggggggaggatagtcgggaggacagtgggg

SEQ ID NO: 95275 - DNA, 601 bp, Human
ggacccatgtggctgcctacagtgaacttgacctttaggggctctggcttctggaaggagggagttccaggagccacatcctccttccaggaggccaggtgacatggacaacgtgagggaaggcagccagggcgtgaggccttgggttgggtctccagggcagctcaccacagggaaggagtgaaggtggtgaaggatcacccgggagatgctgcttgggctggagggcgcccgctgcaggcgtcagctgctgccggctgcgggatgtgatcagcactcctcacttcatggcctcagttcrctcgcctgtgaaatgtaggtgtgtgtccctggagtccctccaaagctctgtgaatttgtggaacgcagatggagggaaggtcaagcttgggagagggcggtggctttggctgcaacgcgaagccgacaagcactggcagcaggcctgctgggctgtctttgagcgcgggtgtctgggcccaccctcctctgtcggatccctgggtcttctgtccctcactggacatgtggatctgaccgccatccaggacgtcccctctgggtcctgctggcattactccagaaccacttcatcttcctt

SEQ ID NO: 95276 - DNA, 601 bp, Human
caggccacccctgtgttcctgctcatacttttgcatagccaccacctgaagttagggcagccccagccctgggggagactttaggggccaggggcagctcagtgctgggctcacaaccacagaacaccagctttcctggcctaggtcacactttgccaggccacaccatgaaggggagagagcgcccatccttggggagcaggatccagggtctgtgagacccaggcgtgggctgcagggagagtgaggtcgtccgcacggatggtggagtggacagaggccagcagaggctgcgcgcccmtgtgcgggccaaggggagagcgtaggtaaaggacagtattgcagtcttgggaccaagtgccactaaaccttatgggtaatgggtttttcatcccctgggtaataggagacaccaaaaaatgaggacattacttagtgagtccctcacctccctggccccattcagcagactcggaggaaggacattgcccagcattgagccgtgtgtggatttaatggggtttccagctaaaccttccatcaaatttacggctgtgcctgtctcctgaccttccccctcacacattcttttcagaaatga

SEQ ID NO: 95277 - DNA, 601 bp, Human
tgaagctgtgtgcaggctgtgaggtgtcacttcccccacgctggagatatacagcttgggcctgggttgagacagtggatttaatcaggctgggtccccgcagttcacccgcccctaagctgagtgacattagggtggccgtcggagtccagctagagtgggcagcacggagccagcaagtgtttgtcctgccagccacaggcttctgctcagccttgcctcgcctccttgctgggagagtggcgcgtgggggcccaacatctgctcaccccctgggccggaaggtggggttcttcctgtmatcttctcccacagcccccacctcctaccattgctgccatggcgggagcatcatcagccggcctcactcctgctttccccactatcctaacagctgggctgctcctggctccctctccattcatttcttgccttccatcttggaagtgttcagtgtctgctgaatcctcccaccccaacctcactgcccctctagagcttattgcctttcaaatacagctcaaatatcacaacctccaggaggctttccccgatctcatcacccccagggaagagatctcccttctgcacatcatgcaga

SEQ ID NO: 95278 - DNA, 601 bp, Human
tcccacagaggccattatcccggagcggggtgctgtttgcctggttttgtctgggccacaatttgcattcacttgatggattgtcagggtcgggggtctcctccttgggaaacagtggagtgactgctcagcacactcttaagaggaaggggagcgctaataccagcgtttgcccaggtccttgagagggcccggggatcctaacgcagtgctagatcaatatgacaggcgctaagaagcttgggacatgcattcacaaaccccttttattgctccactccaagccagggagaggggagcygcagcttgggcacagctagcaggacctggccgacaggctcttgtttgttttcccggctgcggtggcctgcggttcagttcaagtttgccaaagtgatttggagtggccttccccagctgagccttgcgtgggacctgttaagcccctgctctgtcacctgccttctttctgtctggctggatgccgaaaagaaacctccagagggagaagggagtcggggaggggtagaagggaggcctgttttgcccgctggggcaagggcagctgtttctctgggggtaaacactcttagttgccaaa

SEQ ID NO: 95279 - DNA, 601 bp, Human
gaaagggcccctccagcaagggtgatgggttgggcgctgcaggaccgcggagaaacagaacgcatctttatctggtcctccgaaagaagtgcggtggccatagtctcctcttttagcccttttctgcccctgtgtctcagaaaagtcttgaaagggctggaagtctgtgggtgatgttagcctgctgagatgctcgaggaaactcaaatggctctttctttgtatcacgtctttcctgtcaactcataccccaccttgagccagccctcagaagatggttgcaagagacacaccttgggtrgtaaaggtggagaaagaatgctttccagttcagacagtcagctcctccatcgaggaaggatgagaaatcacagccttcaggatttcaggccaggcacaggactcttagacttgataccataagcatgattcataaaaggaatgattgacacattggacctcgccaaaatcaaaaattttgctcttcgaaagaccctgttgagagggtgaagagacaggctgcagaatgggagaaaatatttgcaaacctcatacctgacaagggactagtacatagaatatgtactcaaaactcaacagt

SEQ ID NO: 95280 - DNA, 601 bp, Human
tactgcataggacccaacagttacacccttgggcatttattccagagaagtgaaaatttatattcacacaaaaacctgtacacaaatatttataacagttttatttgtgatgtccccaaactggaaacagcccagatgtcttttcgtggtcgagtggttagacaaactgtggcacattcataccagggaatactactcagcagtgaaaagggacaaaccatagatgcctgtaccaatttggctgaatcttcggggaattatgctgagtgcaaaagccaatcccaaaaggttaccaactatrtgtttccatttatgtaacatgtttgatgtgatgaaattttagaaatggagaacagatcaatggtttccagggtttaatgacagtaggggtgagggagaggagggcagcagaagggtgctcatcgtgacagaactgtttagtatcctgactgaggtggtagatattgaatctgtacctttaatgaaattgcataaaactaaatgcacacacattcacatatatatatatatatatacacataaaactaaatgcatacacattcacatacatacatacctgcgtgcaagtaaaactgaggaa

SEQ ID NO: 95281 - DNA, 601 bp, Human
tcattttcacctcttggagtttgcatcttggggatggcttctcctaatgccttcccaggactgtgttcatttgttcattcattcattcatcagtccatttgtcagcagggatttcttgaggacccactgggcaccagacgtggagcccacagaaatgaaaagatggacctttcagcatcagggagctgatggctggtggggagcaggcagtggcttgaatgccacacaggaaggtgctatgggagagtagcaggcacccctcacccaggagtgggtgcactgggcggggtgtctggtggayaaagaagaaatcggggagccttgctggaggtgatggtgcttgtgttgcctgttgaacaagtgggtgtaggcagagaaggaatttcttgagaggcagtgttgcctagtggttaagagttggctgcctgggtttgaatttggtctctgtttaacttctcttcttcagtttccttttccatgaaatgaaggcaaaaagggaccctaccttataggcatcgtaatgtggatcaaaccagttcacatttttcaggacctggcccatggtgaatgctgggtaagtgtttgataaattaaatcacac

SEQ ID NO: 95282 - DNA, 601 bp, Human
ttggtctctgtttaacttctcttcttcagtttccttttccatgaaatgaaggcaaaaagggaccctaccttataggcatcgtaatgtggatcaaaccagttcacatttttcaggacctggcccatggtgaatgctgggtaagtgtttgataaattaaatcacacaaatagatgaacgggcgtacagaatgtgattgaagcctgggctatgctgggagaaatcagagctggagtacaggctgtgaagggaagggggagcagcaaagggcagggcctggctttcccctggatgcttatgggcrcctctcctctggggagccggctatgctcctggctccagtagagtggagggcaccacacatgctttctttacaggggaaggcgctgttcccttctcttccttacttgccctttccatgcaccctgaccccactgaaaaagcagcagagaggggctttgcacaccaggctgtcctcatttactcagtccagatacctgggagattgtgagaagctggatgcaccttcctggaccagcgacccctctttccactgcactccaggtgtgaccaatgccagtcttcactgagcacagtgggtgaa

SEQ ID NO: 95283 - DNA, 601 bp, Human
ttccatgaaatgaaggcaaaaagggaccctaccttataggcatcgtaatgtggatcaaaccagttcacatttttcaggacctggcccatggtgaatgctgggtaagtgtttgataaattaaatcacacaaatagatgaacgggcgtacagaatgtgattgaagcctgggctatgctgggagaaatcagagctggagtacaggctgtgaagggaagggggagcagcaaagggcagggcctggctttcccctggatgcttatgggcacctctcctctggggagccggctatgctcctggctcyagtagagtggagggcaccacacatgctttctttacaggggaaggcgctgttcccttctcttccttacttgccctttccatgcaccctgaccccactgaaaaagcagcagagaggggctttgcacaccaggctgtcctcatttactcagtccagatacctgggagattgtgagaagctggatgcaccttcctggaccagcgacccctctttccactgcactccaggtgtgaccaatgccagtcttcactgagcacagtgggtgaagcccccttcccatcccaccccaccctgcaccttgtg

SEQ ID NO: 95284 - DNA, 601 bp, Human
tttagccttgagtatacgcagcctgggagtctccagtgctcagagtgcctgctctgttccctcctgagcattctgttcccttctcactctctttctagagcgccagtgtgggatcagttcttactgccaggggtgggggctaatctgtgtcttgtgtccttgaggaccacaaatgaagacatgcattaacccttgggggggggtaccagtgatttcaaaccgcccccccataaatccccccacttccattttacctctttcctcccatatggttttcttttctttcttttttttttttttsagacagagttttgcccttgttgcccaggctggagcgcagtggcgcgatcttggctcactgcaacctctgccttctggtttcaagcgattctcctgcctcagcctccggagtagctgggactacaggcgcctgccaccaagcctggctaatttttgtatttttagtaaaggcagggtttcaccatgttgaccaggcttgtcttgaactcctgacctcgtgatctgcccgcctcagcttcccaaagttctgggattacaggcgtgagccactgtacccggcccagtatggttttctttctag

SEQ ID NO: 95285 - DNA, 601 bp, Human
gtatttttagtaaaggcagggtttcaccatgttgaccaggcttgtcttgaactcctgacctcgtgatctgcccgcctcagcttcccaaagttctgggattacaggcgtgagccactgtacccggcccagtatggttttctttctagtgcctcaatgggtgcctccttgaggacctggctgatggggaggggaggggaggggctccccggtggaggcttgggccaccaggctgtggacactgcatggacctcagccatccctgcaggctggcctggcttccctctgtgtcagcctttccagygtttgcagccagcaattctctccttggaaactgggagggaaaagaaaacaacaacaatgaaaaaacaacaacaaaactaaacgtgtgaacttggctgtaagtatggagcagaaaagttttgcttggatgtggcactggggaactgatggaaggaacagtcctttgttagaaggggaggaaggggaagtgaagtagtctctccttagaattggggtgaattgttatgaataaaaaatacatacttctcagggctggatgcagtggctcacacctgtaatcccagcactttgggaggccaag

SEQ ID NO: 95286 - DNA, 601 bp, Human
aaacaacaacaaaactaaacgtgtgaacttggctgtaagtatggagcagaaaagttttgcttggatgtggcactggggaactgatggaaggaacagtcctttgttagaaggggaggaaggggaagtgaagtagtctctccttagaattggggtgaattgttatgaataaaaaatacatacttctcagggctggatgcagtggctcacacctgtaatcccagcactttgggaggccaaggcaggcaaatcacctgaggtcaggagttcgagaccaacctggccaacatggtgaaacgccatstctactaaaaatacaaaaagtagctgggcatggtgacatgggcctgtaatcccagctgctcgggaggctgaggcaggagaattgcttgaacctgggaggtgaaggctacaatgaactgagattgcaccactgcactccagcctgggtgacagagcgagactccgtcacaaaaaacaagaacagaaacaataacaaaaacaaaacaaaaacatgcttctcagtaagtttccctgggaggatgggcccggaacccagagacacttcgtctggtcactggtctcccctcgtcttgtaatccct

SEQ ID NO: 95287 - DNA, 601 bp, Human
acttctcagggctggatgcagtggctcacacctgtaatcccagcactttgggaggccaaggcaggcaaatcacctgaggtcaggagttcgagaccaacctggccaacatggtgaaacgccatgtctactaaaaatacaaaaagtagctgggcatggtgacatgggcctgtaatcccagctgctcgggaggctgaggcaggagaattgcttgaacctgggaggtgaaggctacaatgaactgagattgcaccactgcactccagcctgggtgacagagcgagactccgtcacaaaaaacaaraacagaaacaataacaaaaacaaaacaaaaacatgcttctcagtaagtttccctgggaggatgggcccggaacccagagacacttcgtctggtcactggtctcccctcgtcttgtaatcccttccttgcctctttttaaaaggaaaggtttgagcccactgtggttgctatggttttctaaccaacaccttgatatttgcaaagggctctgaagtcattagagctatttcttgctcatcacctcctggtgagacagatgtgactctcccctcccattttatgggtgaggaaactgagatt

SEQ ID NO: 95288 - DNA, 601 bp, Human
ggatgggcccggaacccagagacacttcgtctggtcactggtctcccctcgtcttgtaatcccttccttgcctctttttaaaaggaaaggtttgagcccactgtggttgctatggttttctaaccaacaccttgatatttgcaaagggctctgaagtcattagagctatttcttgctcatcacctcctggtgagacagatgtgactctcccctcccattttatgggtgaggaaactgagattggagaaggcagacaagggccagggtgtcctggagctgtgtgaaggttctagggttgtgrttcatcaagccaacagttagaactgtcatagttttcctgtccctctctgtccctgagtgatcttgggcaggttggttctcacctgccttgatggtctgtggatctcatagcattaagtgtggctcagatttctccctcccttctttcccccaccctctctccgccccaccctgaggtcagcctgaaggcagccccctagccccaccccaggcctagtgggagactcagacacaccaggggtgtgggtaggcgagggccatgaccccagaaggctgtttggggtccagagggagcccagag

SEQ ID NO: 95289 - DNA, 601 bp, Human
acccatacacacacacacacacacacacacacacacacacacacacagccttcttcggaggccttggccctttttctcaaggaatccccagcttgggcgttaatccctcaagagtcaccaagagttaactcttgagaagctcgtttattcatttttaccctatgtagttctacaggcagcctccaaaaatgcatagtgtgtaacagggctgaacaaaaagtggcggagatcaggggaaagaaaaaaaggggatcatgaaatagaaattaacaagttgaagttgaggccagtgcttgcctargggcaggggaggaacgtgtccacctctgtcccaggtggcctgtgtgagggagaggggctgggggaagagattcctgcactgttccccatggggctgcctgcgggcacatgcctctccccagcaccacccccactgacacgctccagccgccacgccctctccatcacaaatgtggccacagctcctggtcttgtccgggtcagcctcagaagtagcaaactccccgtgttgacttcctgttaggggaacgaggattccatcctttgagtcctaaacctctgaaacagcatgggcccctgc

SEQ ID NO: 95290 - DNA, 601 bp, Human
ctttttctcaaggaatccccagcttgggcgttaatccctcaagagtcaccaagagttaactcttgagaagctcgtttattcatttttaccctatgtagttctacaggcagcctccaaaaatgcatagtgtgtaacagggctgaacaaaaagtggcggagatcaggggaaagaaaaaaaggggatcatgaaatagaaattaacaagttgaagttgaggccagtgcttgcctaggggcaggggaggaacgtgtccacctctgtcccaggtggcctgtgtgagggagaggggctgggggaagasattcctgcactgttccccatggggctgcctgcgggcacatgcctctccccagcaccacccccactgacacgctccagccgccacgccctctccatcacaaatgtggccacagctcctggtcttgtccgggtcagcctcagaagtagcaaactccccgtgttgacttcctgttaggggaacgaggattccatcctttgagtcctaaacctctgaaacagcatgggcccctgctccctggctctgcccagagttgtcagagattcagagaatcgtctctcagttttgctcaagagcctgaac

SEQ ID NO: 95291 - DNA, 601 bp, Human
aggctaaaaataaattttgaagcaataaaggtgatcacagtagagacagttctccacttacaatggctcgactttactgtgggtttactggggcatggtaagttgaggagtaaatgtgttactttgtaaggagggcaaagattgtaggcacagggtttttggaggccaggggattgattctgttgggtttctagtctcctctggatgacatcaccaacctgaaatcccttacctgtgtcataacaaaggacactttgtgtaattttcttagatactcacatctttaccactctattctggaaaaaaatacccatttaggccttgccgttaacatgtctgatctcaggcctgaagatctcttagagactcagtttccctttctgtacaatgagtgggtttgactgatactcatgctgagctggtatcttttatcctgtatttatataacatggtcacctctttagggtgctaacattttatgagacctctttaaggtgctaaagtctcatgatatcatccagtaactctaccccatgaagggacattttattactcattaggcatcaatgtcaggttcagcaagtcttatcttgatgctgac

SEQ ID NO: 95292 - DNA, 601 bp, Human
aaagtctcatgatatcatccagtaactctaccccatgaagggacattttattactcattaggcatcaatgtcaggttcagcaagtcttatcttgatgctgacccttgggaactgcacctttctgctttccaccgttcagaggagttgatacactgtgattttcagtgaagggggaccacaggtccccttcacctgtggtcttttcttgttgctgttttgtggagtggtttccatccaccccctactccctcgaaattagggttaaaacgcaatggcataaggcactgatatagattaaaacacacacacacacacacacacacacacacacacacacacacaaaatgattgtcataaagaaaatcattccagtcctgtgagtttgggattatattttccccagacatttactgtgtttatagagaaaaataaatatctctgtaaacatgtgttgtatttacagtgaaaataaatatctaaataaatattaagcttttaaaattggagcactcgcagaaggaaatgcaaatggatgtgagcgagggctgcctcacttggggcgtgcatgcctggattcgcactgaattggggtgcgtttgtc

SEQ ID NO: 95293 - DNA, 601 bp, Human
agcctgcgcaaggccatcagccagtcttgtctgggtcgaaaaggtctcgttggctgtgtgatgcaacttgcagtgaactgagggtgactgtgggcgtcacagcagcgtctcagaaggccctgttcagccctgtctgggacctgtatataacggaactcagtctcacctctgcagaataggaatggcggtgcccatcttcctctttcttgtggctactctgagggttaagtgaagtcatcgatgaaaatacgctttagaaatgaggtttgtacagcgagtgtaaaggcaggctgtttttctwactggtgtccaagccaggtgtggacctgcagtaaaatgcaaatgaccctgttatgtggacaggggccattgtgacagtgagctttgttaggattgctgcatcacccacaagcctgttactgctgagccccaactccagcttctgattccaagggcctgggaaggtgcggaggatttgcgtctctagcaggctcccaggacatgcagaggctgccggccgggggccacactgggaactgctggggaaagtttgctttactttgagttctgaggcaggcaaggcagaagaggcagaatctcc

SEQ ID NO: 95294 - DNA, 601 bp, Human
agaatctcctgggggtgggagggtggttacaaaatgaggccccagcttgtttgcagcccccattgcctcttgaatggtggatatcctggctgccttgctcttttcccttccggctctttcttgttccttctttaacagaatatatcccttaaaccagtgcttcccaaacttcagtgtgcaaaagaatcagcccaggatcctgctaaactgccagcttctgaatccacaggtccaggatggggtctgggagtcttcattttaaacacacaccaggtgatggccactgctgcagctgctgagragcaaggaccaaaacaggcagtttccaaatagtaaagtcacttctgttttgcaaactcagatggcattttctccatgaagctctcattacctagcttggtgaccctgtgcataggatctgagaactcgctgccttggtttcccttctgcaccctagcgatgttaacccttggccctatgagggttctgtggaagaaacaagatgaggggacaacacccagttccttttaggctctagataaacattatttgctgtcttcttctgtcttttactttcacagcccctgggtaaaatagacaa

SEQ ID NO: 95295 - DNA, 601 bp, Human
gagccagctcataccagctaacaccagcttgtgagagctggttctacgcatctctcccaaactatatgctcagtgtcttctccttggtaccttgaaatcagccacagtgagagcatttacaccatggaaattggcacatgctacaagccattgacacccacccccccccacccccaaccccttgccccattgcttcccccaaaagctggttgttaacatgtgtcagcataccactgcagctatttaacaaccggctatagaggacttgctgggaaaacacacaataataagaaaagcctakggtccagtgagagaagaagcaatggtggttaatattataataattgacactctgtggccaagggctgtatctttgcagtactcatcgggtgtagtgggaggggaaacagtcccttcaaggtttgagtatttcaggaaggctttgcaggagaattagagctccagccagattccccagagtgtgcaaaataaggagggaagggggaatgaaggctggaggtatggtgtgctcatgggggtgtcaggaggcactcattccttgttgtagatgatggccaaaataaaaattccagctggtgct

SEQ ID NO: 95296 - DNA, 601 bp, Human
tggggccagacaacatgggggaataaactttttttaatgcaattcagggccgggcgcagtgggtcattcctgtaatcccaacactttgggaggctgaggcaggtggattacttgaggtcaggagttcgagaccagcctggacaacatggtgaaacacgatctctagtaaaaatacaaaaattagccgggcacagtggcaggcacttagaagaattgcttgaacccaggaggcgaaggttgcagtgagctgagatcacgccactacactcaggcttgggcgacagagtgagactccatctcaaaaaaaaaaaattgcaattcagacagtttctttaaacagtccaccagcctcttgattgtgggttctgggtgctagtgaccctccccctgagagcccccaggcaggcctgggcctcactgagagagacaaagtcccactgtcagttctgactgactgtccccaggaccctcagccttagatccctggactttggcataaccacaggcaggttggctaaggatgcctgagaaaaaatagccaggctcttggagtcagacttagctcgctggtcctttatttcacatcctgccttcatttcca

SEQ ID NO: 95297 - DNA, 601 bp, Human
gggcagcccaggaccagtcttcacccagatgctcgttctaaactctgcctgctctggtgggaaggcagggccctgggctctgagagcctgtcggtccctggctttctgtgacctcacgagctctgggttttggttttctcccatcaggagaacgtctgcctggcacctcctgggtgcaggacagggtctgtgtgaacatgtgtgagccatggagcggcctgccaagggaagtggcactgtgactgaggaaggacccaccttcccaggaggagggacccacctttccaggaggaggcgcagmtgttctcaacgccccctgcccgatggaatccactggggagctttttaaaacgctggtgccctggagccaccccagagagtctgcttctgtactgggctgggttttggcctctcttgattccctggtgtttctcctatgcctccagagcctgcgatctaccaaagttggaaaataaaggaggtgaggtgggggtggatgatgtctctcccaactctattggcccctgtgcttcggcctctggcccagcagagagaagggagggagtttggctggtgtggggcagggaggcaggaaggacag

SEQ ID NO: 95298 - DNA, 601 bp, Human
ggagaacgtctgcctggcacctcctgggtgcaggacagggtctgtgtgaacatgtgtgagccatggagcggcctgccaagggaagtggcactgtgactgaggaaggacccaccttcccaggaggagggacccacctttccaggaggaggcgcagctgttctcaacgccccctgcccgatggaatccactggggagctttttaaaacgctggtgccctggagccaccccagagagtctgcttctgtactgggctgggttttggcctctcttgattccctggtgtttctcctatgcctccagrgcctgcgatctaccaaagttggaaaataaaggaggtgaggtgggggtggatgatgtctctcccaactctattggcccctgtgcttcggcctctggcccagcagagagaagggagggagtttggctggtgtggggcagggaggcaggaaggacagagcgcctgagctgcaggctttccctcagccattaaagtttatcgttgccacggacagtgattgaaaaaggctttttgcaggactgaaatgtgagcaatgaaacttgccagttggtaccgacacagggcacttatctcataaaaata

SEQ ID NO: 95299 - DNA, 601 bp, Human
cgtctgcctggcacctcctgggtgcaggacagggtctgtgtgaacatgtgtgagccatggagcggcctgccaagggaagtggcactgtgactgaggaaggacccaccttcccaggaggagggacccacctttccaggaggaggcgcagctgttctcaacgccccctgcccgatggaatccactggggagctttttaaaacgctggtgccctggagccaccccagagagtctgcttctgtactgggctgggttttggcctctcttgattccctggtgtttctcctatgcctccagagcctgmgatctaccaaagttggaaaataaaggaggtgaggtgggggtggatgatgtctctcccaactctattggcccctgtgcttcggcctctggcccagcagagagaagggagggagtttggctggtgtggggcagggaggcaggaaggacagagcgcctgagctgcaggctttccctcagccattaaagtttatcgttgccacggacagtgattgaaaaaggctttttgcaggactgaaatgtgagcaatgaaacttgccagttggtaccgacacagggcacttatctcataaaaatatcctcc

SEQ ID NO: 95300 - DNA, 601 bp, Human
tctggacacagccactctgtgttccacagcatctcaaactcagcactttctcgccctcaaaacaggccttctcccctgtgtcccctctcatagttgaggccaccagcacccacctaaggtagttagcatccttcctccagaatgcttgactcgccctccctgcatccccgcgtggcagagtcctgctggccctgcatcctgcattgagcatgagtgcacccctccctccttgccgcctctgcccttcccgccctggtagaggccctccatctgtcacccagtggtcacaaggtaagaccartgtcttaattcatccccttgtctgcagcatcacacacacaccccaccctccacaccaacctgtccctgtcacccccttgcataaaccttcctaatgtctctccatcaccagcagacttgtgcccagcgtcattacatcaaacaagcctagtcgcagcccagccctcacctgctgccttgccgctgatgctctgaccacacagggctctcggagtcccagaagactccactgctcctcatccctgtgcctttgtgtgtgccttctcagccctctcctcggcttggcttcacctgttgacgg

SEQ ID NO: 95301 - DNA, 601 bp, Human
agagcagaggctgggcccgagatcctgctggaggtccgtaaaccagagaaacttccctgacctgaagatgtgggctgcacggtggagactgaactgggagcctggagactctggggctctgggtggcaatggcctctcgtaggaagatcccacagggctcatttatccattaccatggggagtgcgttttctgtagtcagggcttttgcttctcacgttattcagccgggctgtgtaatgggaaagaacagtcaccatctgcatggcatcttcctcgccagccagtgggcagggcaggtgrctgcttaaggctgcaagctggagaatcgcagacgagggttcagatcttccttgacagttcctcactgtgtggtcttggatgggtcatgtactcctcaagcctctgtttcctcagtgtaaatgggggtggtgatcataacccccccaacacacacacacacagagttgaaatgaagagcaaatcaacacaggaatatgaagtgcctacaaccgtgcccgcaggggaacttgcagcagcttttgtcattgtgtggtacactgagtgcttcccaccggactgctgggcatgggaaagcaatct

SEQ ID NO: 95302 - DNA, 601 bp, Human
agggtgactcatttgtgcacacttgggtagaacaagagaagtggcatcctcgcctcccctctggtgggcagctgcatggggacccctttcccaagccccttgcatatggaggccccctcttctgagcactggatctgcttcccgtgcagactcatgctctagagtcatccactgtgggtccctctcagcacctgaaaagggaaaagaagcctgggtcctgggctgagaactatgaggcagggccctgcagccatctgtgatgtgggagaaggcagtttccccttcctaggagggaagacaycccctgccccccaacagacctggccactgcttgggccccctggctccagcccctcccaccgatgggccacacatagcatgtgctctgaagctgaagctgtggtttaggggaaaccaatgttatgggaacagctcccagctctagcttgtgtcactccagcctggaggcagattcagggtgggtggtttggtttgggaatcttattttgcccagaaaggaaggggggagccagccactaaggagagtgctgaatggctgatggctggaggacagactgtctacaggagtcagatgcaggct

SEQ ID NO: 95303 - DNA, 601 bp, Human
ttccccttcctaggagggaagacaccccctgccccccaacagacctggccactgcttgggccccctggctccagcccctcccaccgatgggccacacatagcatgtgctctgaagctgaagctgtggtttaggggaaaccaatgttatgggaacagctcccagctctagcttgtgtcactccagcctggaggcagattcagggtgggtggtttggtttgggaatcttattttgcccagaaaggaaggggggagccagccactaaggagagtgctgaatggctgatggctggaggacagackgtctacaggagtcagatgcaggctgagaaggcttcacgttagtgcctagatcaccccccgtctctgcctgtgcctggaaaatggcatccctgacccagggtggggaattggggtgcagtgttgtctatggcttgtgcttgtgctgaggagttaacctccagcagagaggctgtgaggctcccccagttccccggtcccctgagccaccagaagccataggattgtggcatgattgttgtcattcattgggaataaatgcaccctccgccttttggctgacgtggggagggcttgctcctg

SEQ ID NO: 95304 - DNA, 601 bp, Human
aactgtcttttacaaagtgccatccagaaggaaagaaatgctcaaaggacattgacttcatggccccagacctggcaacctgatgcccagaggtataaaaatatgcctctgtgactgtggttagatcgtgcacaccccctcatttataaacccactttaggccgggcgtggtggctcacacctgtaatcccagcactttgggaggccgaggcaggcagatcacgaggtcaggagattgagaccatcctggctaacacggtgaaaccctgtctctactaaaaatacaaaaaattagccgggmgtggtggtgggcgcctgtggtcccagctactcgggaggctgaggcaggagaatggcatgaacccgggaggcggagcttgcagtgagctgagatcacgccactgcactccggcctgggcgacagagtgagactccgtctcaaaataaaataaaataaaattttaaaatccactttacaggtggggaccccacaaccctggggacagcagacccttcgtaggccttcctacagatttattccataagggaccgatgactgaagccatagctacagctcctccgtgtaggcccagctgggggt

SEQ ID NO: 95305 - DNA, 601 bp, Human
tcatggccccagacctggcaacctgatgcccagaggtataaaaatatgcctctgtgactgtggttagatcgtgcacaccccctcatttataaacccactttaggccgggcgtggtggctcacacctgtaatcccagcactttgggaggccgaggcaggcagatcacgaggtcaggagattgagaccatcctggctaacacggtgaaaccctgtctctactaaaaatacaaaaaattagccgggagtggtggtgggcgcctgtggtcccagctactcgggaggctgaggcaggagaatggcrtgaacccgggaggcggagcttgcagtgagctgagatcacgccactgcactccggcctgggcgacagagtgagactccgtctcaaaataaaataaaataaaattttaaaatccactttacaggtggggaccccacaaccctggggacagcagacccttcgtaggccttcctacagatttattccataagggaccgatgactgaagccatagctacagctcctccgtgtaggcccagctgggggtggagtgagcctccgtccagccatagctggggctgtgggtcccatttccctctgggtc

SEQ ID NO: 95306 - DNA, 601 bp, Human
ctgacccagggcaagttactgaacgctcctgtgcctcagtttcctcatctctaaagtggagataatagtaacaataccttcatcaattgctatgaggatgaaatgagttaacaaatgcaacatgctcaggaaggctccagtgtgaaggaagccctgtgcactggctgttagaaccactgcggtttccagtctccaaggaagggccagtgcgtggctgactcctagaaactgctctgtctcctactgcggccccgagcagcatggctttctctcctcggtcctaaattaatttagactgacmgtcggtagctactggccacccttgttatcctcgggttctgttttccaatagtgggaggattcactcattcatgtattcattcattcactcactgggcacatactcctcacctcctccatgccactcgctgggctggtcgttgactcagaggaaatggtgtggagggagtatcgtctgcctgcggtggaggggggtggcagaagaaaggtccaggaagcttcctggaggcaggctcgtgtggactggggttgctgagggcaggctgagttggcatgatgaggatgagggggtgtggtgggg

SEQ ID NO: 95307 - DNA, 601 bp, Human
ttaattcacatgcttagctcatcaaaatattgttttgcaagaggtttttttttttttttttgatgtcaggaaggctttggcatgttttcctcctccctttcttctacagtcttattctaggaaataagattctgggcaccgctcagggctggagggttgggtcatgagaccacatattctgtgtctcagtttctgaaccaacaaaataggggagcaggctcttcccacggattcatggactggcctccagtcctgctggtggacaccgtatcccagcaaagagaaatactgtttccatgcrccacagtggtcgttggtggggagagtggggagggtggtgggaatggcatgtgctccaaccatcattcagttaactgggtccagaatcacacgggcagggagccaggcgtccgaaagtgtaacacggcttgcccggtgtttctccacggtcctgccgcactgcccctcatgaccccggcatgggctttgctttctgcggaccctcttatttgtcgaagatctcgggagtccacacacccactcccgtgtctgggaacactccaagcttatcaagaacgcagcgggcagcaatccagggcag

SEQ ID NO: 95308 - DNA, 601 bp, Human
tttccatgcgccacagtggtcgttggtggggagagtggggagggtggtgggaatggcatgtgctccaaccatcattcagttaactgggtccagaatcacacgggcagggagccaggcgtccgaaagtgtaacacggcttgcccggtgtttctccacggtcctgccgcactgcccctcatgaccccggcatgggctttgctttctgcggaccctcttatttgtcgaagatctcgggagtccacacacccactcccgtgtctgggaacactccaagcttatcaagaacgcagcgggcagcaayccagggcagaacaagggaggtgctgtcgaccagctctgcgcggagaggtcaagggtgtggaagggtggggagagaggcacaggctgacttaatcccttgggcggggcaccggcctcacccacagaatcgcaagtaaccctcctacgattctgggaacgtttgtgagttaaatgaatggaagggagggaggaaaggagggaagaaaaataactgtgttttcatcagtaaatgtaagcgaccaaatagaagtctgtaggaagctaagattcagaggtgaggaaggactgaggtttggggaga

SEQ ID NO: 95309 - DNA, 601 bp, Human
aacacggcttgcccggtgtttctccacggtcctgccgcactgcccctcatgaccccggcatgggctttgctttctgcggaccctcttatttgtcgaagatctcgggagtccacacacccactcccgtgtctgggaacactccaagcttatcaagaacgcagcgggcagcaatccagggcagaacaagggaggtgctgtcgaccagctctgcgcggagaggtcaagggtgtggaagggtggggagagaggcacaggctgacttaatcccttgggcggggcaccggcctcacccacagaatcrcaagtaaccctcctacgattctgggaacgtttgtgagttaaatgaatggaagggagggaggaaaggagggaagaaaaataactgtgttttcatcagtaaatgtaagcgaccaaatagaagtctgtaggaagctaagattcagaggtgaggaaggactgaggtttggggagaattctcatcaccatattttgtgtattgatgggacttttactaagctagactagaattccgaagcagtggaaagtcaataatgataacgagttaggcctgagctgttcagtagggtagccgcgagctgtg

SEQ ID NO: 95310 - DNA, 601 bp, Human
gcggaccctcttatttgtcgaagatctcgggagtccacacacccactcccgtgtctgggaacactccaagcttatcaagaacgcagcgggcagcaatccagggcagaacaagggaggtgctgtcgaccagctctgcgcggagaggtcaagggtgtggaagggtggggagagaggcacaggctgacttaatcccttgggcggggcaccggcctcacccacagaatcgcaagtaaccctcctacgattctgggaacgtttgtgagttaaatgaatggaagggagggaggaaaggagggaagaraaataactgtgttttcatcagtaaatgtaagcgaccaaatagaagtctgtaggaagctaagattcagaggtgaggaaggactgaggtttggggagaattctcatcaccatattttgtgtattgatgggacttttactaagctagactagaattccgaagcagtggaaagtcaataatgataacgagttaggcctgagctgttcagtagggtagccgcgagctgtgtgtggctgagtgcttgcaatgtggctatcctaattgagatgtgctgtgagtgcaagataggtaccaggttttgaa

SEQ ID NO: 95311 - DNA, 601 bp, Human
aagcttatcaagaacgcagcgggcagcaatccagggcagaacaagggaggtgctgtcgaccagctctgcgcggagaggtcaagggtgtggaagggtggggagagaggcacaggctgacttaatcccttgggcggggcaccggcctcacccacagaatcgcaagtaaccctcctacgattctgggaacgtttgtgagttaaatgaatggaagggagggaggaaaggagggaagaaaaataactgtgttttcatcagtaaatgtaagcgaccaaatagaagtctgtaggaagctaagattcaraggtgaggaaggactgaggtttggggagaattctcatcaccatattttgtgtattgatgggacttttactaagctagactagaattccgaagcagtggaaagtcaataatgataacgagttaggcctgagctgttcagtagggtagccgcgagctgtgtgtggctgagtgcttgcaatgtggctatcctaattgagatgtgctgtgagtgcaagataggtaccaggttttgaagacgtagtaggaataaaagcatgtaacacatctcattaacaatttttttactggttccatgttgaag

SEQ ID NO: 95312 - DNA, 601 bp, Human
ggaagggtggggagagaggcacaggctgacttaatcccttgggcggggcaccggcctcacccacagaatcgcaagtaaccctcctacgattctgggaacgtttgtgagttaaatgaatggaagggagggaggaaaggagggaagaaaaataactgtgttttcatcagtaaatgtaagcgaccaaatagaagtctgtaggaagctaagattcagaggtgaggaaggactgaggtttggggagaattctcatcaccatattttgtgtattgatgggacttttactaagctagactagaattcygaagcagtggaaagtcaataatgataacgagttaggcctgagctgttcagtagggtagccgcgagctgtgtgtggctgagtgcttgcaatgtggctatcctaattgagatgtgctgtgagtgcaagataggtaccaggttttgaagacgtagtaggaataaaagcatgtaacacatctcattaacaatttttttactggttccatgttgaagtgatagtatttttgacgtactggttcaattaaattgtgttattaaaataatcacctgtttctttttagttttttttaaatgtggctcc

SEQ ID NO: 95313 - DNA, 601 bp, Human
actagggcctgggcaccgtctcctccagctcctgggctggattcctgctttctgcattggattctgcaaggtgccagggtccctgggagccatggtcctctgggcttcaaatctattgcattttgcagtggggaggctgcacactacttttttagaaaccttctgtgaccaagacagagttttcaaccttaagcaagcttgaccagccctattgtttcttccagccctaaaattctctaatgtgggactctacatgtctacccagacagacaggcagcccctcccattccttgtgatggcrgggatctcccaggtgtccctctggagctcaccccagtctcccaccccttgctaaaggggcaggagcccagcagaggggtctgtagggatggccacaccggcacccttcggggccctactgcgtgcctggccctgcactagctcttctccacttcacagtctccctctgacatgggtcctgtccctatcctcattttacagataaggacaccgaggcacaggaaggttcggtgagtcagcaatcaagccagacttggctgtggcactggcggcagcctcagctctgtccaacaggacacta

SEQ ID NO: 95314 - DNA, 601 bp, Human
tttttcccccaagtgagacagaagcactttttagttgcacgttgtggagtggccattcaggatattattcttattaaatgcttcctgtggggtggtggctgggcatcaggagggcctctggaattctcctgtcctgtggcttattattgaaaatcatggtgccatttgcataaggccctggggaaggaggttttccatgattcgtgctcttttggtgcttcctacctctgatgcttaggccagtgacttcgtcctcatttgcgaacgaacacctggtcacctgggctcacgtggctgaagsgctggcctttgaaagtgtcaggatctcagaacagaccaaggctccctagcaaggggagaaagtccctggcagcctctcccagccctggtgtgcactttcattcatgtaccatcgaaaagcacagacccctggatgccttccaaacctgcattcccagtggcacccagaccccttgcagctgctgctcagaagcactggtaaatggtcaccaggattcaaatgtctcccccactcccgcctctctgatcttctgtgttgagtttctccagttagtacaatgcctagtaggcgcatggacat

SEQ ID NO: 95315 - DNA, 601 bp, Human
ccgcactgccctgagcctgaagagcctgccatcctcccccttccttctggctctgccaggtctggcctcttccaatgagccttcctggctgctccagacctcatggaaatcttttcctgactttgaggccacttgggcagtttgtgctgcgtgggcctcgctgaatcccgcagggtcaggctctccagctgtggcagtggcttacacagcagcgccccggggcactccctgtgggcaggaattatgcctcttgttctctgtggcctccagagcccatgagcagcgtcctcttacattgagygagtaggggaagccttgacctgcagcagggtgtgtggttgtgacttccaactgtggatggagaactctgccctgggtggtgagcagctccgccgtggattccagagacagctgtggagccaggcttgatggggcccaaagcctgtgtatgtcaaggccatattagtgggacaatgtgtctgaactacatcgtatccctagatcagacctggatggttgaaggagggagcatccagcctcttctttgaagctggtgtcgtcgtttctggtatcttctgggaagcctttaggtacaacttcc

SEQ ID NO: 95316 - DNA, 601 bp, Human
gctgaatcccgcagggtcaggctctccagctgtggcagtggcttacacagcagcgccccggggcactccctgtgggcaggaattatgcctcttgttctctgtggcctccagagcccatgagcagcgtcctcttacattgagcgagtaggggaagccttgacctgcagcagggtgtgtggttgtgacttccaactgtggatggagaactctgccctgggtggtgagcagctccgccgtggattccagagacagctgtggagccaggcttgatggggcccaaagcctgtgtatgtcaaggccrtattagtgggacaatgtgtctgaactacatcgtatccctagatcagacctggatggttgaaggagggagcatccagcctcttctttgaagctggtgtcgtcgtttctggtatcttctgggaagcctttaggtacaacttccctggggattgggcctgggatctccacaggaataggagagagcagagtcttgctccatgggatttgtgacaagcccagaataaatggccagaagcgaccttagccatgcaaacagcaagctgacatccagcatcattggtgttgggagggcgctggcctt

SEQ ID NO: 95317 - DNA, 601 bp, Human
agttttcccgattctttgtctgaactctgcagacccctacctccttctctcccccaggaatccacaggatcatttctaatggggcattaacttgagccaggtttccggggaagggctgtccttgccccctcactgccctcctcactaacacaagaagaccattacacccagtacactgcccacaccaatgtctgctcgccctgggaccgccagcaagaaacatttggtgttgaaactgcagcgtagaaaagttccaggattttaaagaaaaagccgtcactccgccgccaccctcagcttytcaggctgttgggctttctgtgtaggatcaaaaacaaatgtgcattttttttttccagaggggagtgatgatccattgaaaattcccatcttagagtttcttcctcagaaacttaaaaagagagtcatttctttgaaatggcatacggggtgtgtatgttttcagggggatggtgtgtctgtccctctgccggaaggacatgattaattttggattttttcttttacttgaaaaaaaaaaaaaaaacacaaaagccaacaatgaaagctgtgtgtgtaagggtctggctcaggatgtcac

SEQ ID NO: 95318 - DNA, 601 bp, Human
tggactgtgtgtgcatttgttaactaaagtacatagcaaggtggggacgtggtgggtcgatgggggtctgggatcaccctggcacttgggagctgcctccgagtgtcatttaggctgggtggagggaaaagccattcagagccttcgattctcctcttggcactgtcgttttttagtcctgtgactttgggcaaggccatgaatcattcttggcttccgtttcctcatctctttaatgggcatagtaacactagttgcatcagggggcttctggatgtgcaaggaaacatttagaaatacccacacacacacacacacacatacacacacaaccatttttattttgttggcaaaatactgaaatctggtctgccctgccatgtttttaaggcccttttctacacatttgggaaagcgaacactgtttccctgctgactccctggggatccagtggtctcttggtctgtgagcaagcagtgcttggccccccaccctccctagggtttgcaaccagtatgagccagttttcctgtgccccacattagtaaattcatagtttgatgatggactttggaggctccaaacatgagtgctacttgt

SEQ ID NO: 95319 - DNA, 601 bp, Human
ggcactgcggagccccttgtcctggctgctcttgctatgaaattcattgagctttaaagccctttgaaagtagctttttgagggagggggaaagtttttgaagtcttgtttctctctccccctctgcagtgccgcagcatctcttgccaccattccatgcgcccctaccgattgacatgcgacaccaggaaggaaggtaccattacgagcctcattctgtccacggtgtgcacgggtaagtcctgccctctgcctgctgctcctggcgtgcagtcacctgccatggggaggctgggccggyagcctcagccacatctcctgcctctgtctttcttttgggggttcctgatctacattgtcctgagcgggcgatcacctttgctatcatggcctgggaccctgtgtgagcatgtgcgtgggcagtgtataaacaccaaccacccccgagcccacatcaccacttataaggctctgggcttccttggtgtatctatacatggtttggagctctttcttcatccatgaagtgggaatcctctctaggtctaagatcccatataagtaaggtgatcttaggtatctgttgttccagcataataat

SEQ ID NO: 95320 - DNA, 601 bp, Human
acattagaaggaaagccaagtttcactgcagacaccctgcagggtgctgggccagtggtgtcctattcagtcctcccaacaccctgtaaggtgggggattttctcctcaattcatagaggcgagaactgggcgttcccagaatttaagaacttcccaagattgcccagcttgtgagatctcaccaagccagagctcttccctatgccgtgattgtcctcagagaggaaagagagtctcgccatggttctcagggctgcagtgtgttgtttctgtctgcagacatggaaacagaacagtaaycaacccaaaggaattaatcactaacagtaaagtttcaggcattggtggggtggattggcctttgaggtggggagtcctcttagactgcacatgttcagactgtccactcggtggaagctgacgccactgccagatgcattcatttattcagccaaactcattgttgctggatttattgtatcccaagtgctgtcacttgaggccactcctgccagcccgagtcaaggtgttgctgagggaaaatgtgagcagtgccctgcccctgaggcactgcttaaaaaggtcagaaattgctgctgc

SEQ ID NO: 95321 - DNA, 601 bp, Human
gcctatactactcaccacctccattccattctcttataagagtctgggcacagttcagatgccacctcctgcaggaagccctctcagattgcaccaacagagtgggtgaattattttcctcccacccctcttcctgctccagcaccttgtatactgttagaaggctatagtcagtgtccattctctctctgtgaccccagaggtcctggcatggtgattcggccaaagcaccagtgtgaactatgggattgagggcctgtgatttcctgagctcgtaactggtcttgggaatgcctgccamgcagcagcaccctgtcttaccatcaccatggcttcatgggcactcagggggtctgctgagatctgtgcacttgtggattcagagtagaccttgggaatgtggggcacagcacttgtcagtcaggtttgcagccacctgccccctcactacctgggtgcatgcggggccctggccgggtctgtctcagaaccccagctccccacacctgctccctcactacctgggtgcatgtggggccctggccaagtcggcctcagacccccagctccccaccatcagtgccatcagaggcccatgctc

SEQ ID NO: 95322 - DNA, 601 bp, Human
gcttcatgggcactcagggggtctgctgagatctgtgcacttgtggattcagagtagaccttgggaatgtggggcacagcacttgtcagtcaggtttgcagccacctgccccctcactacctgggtgcatgcggggccctggccgggtctgtctcagaaccccagctccccacacctgctccctcactacctgggtgcatgtggggccctggccaagtcggcctcagacccccagctccccaccatcagtgccatcagaggcccatgctcagtaaacatcagctgatccgggggagtgacrtgtggacgcagacacagatcagcaatgaatgtctgcaaactgcggcctcagctcccgtacacagagcctccccatgaggacagactgccaccagacacacaggagagtgcagattgataaaagacatggactgcgcttcagtttgaggaagggacagttctccattgttttccaaaagaatttgctgtacggctcttaaaaaatgcaaatccccttagtacattttggaaaggacttgatttctagaactttttaaaacaaatgtatgggaaacatggtaagcaagcttgccagtgtaca

SEQ ID NO: 95323 - DNA, 601 bp, Human
gcacttgtggattcagagtagaccttgggaatgtggggcacagcacttgtcagtcaggtttgcagccacctgccccctcactacctgggtgcatgcggggccctggccgggtctgtctcagaaccccagctccccacacctgctccctcactacctgggtgcatgtggggccctggccaagtcggcctcagacccccagctccccaccatcagtgccatcagaggcccatgctcagtaaacatcagctgatccgggggagtgacgtgtggacgcagacacagatcagcaatgaatgtctgsaaactgcggcctcagctcccgtacacagagcctccccatgaggacagactgccaccagacacacaggagagtgcagattgataaaagacatggactgcgcttcagtttgaggaagggacagttctccattgttttccaaaagaatttgctgtacggctcttaaaaaatgcaaatccccttagtacattttggaaaggacttgatttctagaactttttaaaacaaatgtatgggaaacatggtaagcaagcttgccagtgtacagtttcacctacaaaaccaaacaacaaaactcaaacc

SEQ ID NO: 95324 - DNA, 601 bp, Human
gggctgtgtgctgggtggattctggctatggggagtcagtgaccatgaaatccaggcggcgggggggaaagcccgctccacagccctgtgcacatggggatgggaacgcaggactcagacaccttcctccacccagcacaggagttcccctaccctgccagcctgcctcaaagggagcatctactggaacctggttattccgagcaataaataggagccctgctaagagtttagtctcagaagaacgatggcactagtgacggtgatgtctgccacctccctagggccaactctaggccartgcaacatgctttccatgacgagttcatttcctggggctgctgtaacacggtaccacgaactcagtggcttcaaacaatagaaatatgttctctcggtttcagaggtcagaagtccaaaatcagtatcactggaacaagatcgaggtgtcaccagggctgtgcaccctcagagacccccaggggagactctgtccttgcctttcccagcttctggtgctgccaactttccttggctcctggccatttccctgtagtctctgtctccctgtcgcatggccatctcatcttctgtgtctcag

SEQ ID NO: 95325 - DNA, 601 bp, Human
gctcaggtcagaggaaggagccacctaacacagaagcaccgtaggaggatcctgaccttgacctggggctagggggcaccttgggtgagaggtccctgagctggcacctctgggaggagaacaggagttaactgggggaagggatgaagaggggaagggcatgactggaggtgcagacatcaaagggcaaagctgtgagaggcaagcatggccaaggaccagagagtggcatacaggacacagaggggagaggcaggccctggccacatgggattgtggcccctcgcctgctgccactgargtcataagtcaccctgagaagcaggcaggtggtgagatttgtaggctcatatccccaagtgactgggcctccttttctcttcatcagcaacagctgttggaccagtctgggggcatccgggtgcctgtgttcccacccgctgctgccgctggcctcactgtggccatgcccctggtgctttgggactcagcagtgctgtctgttaaatgggacatgaaggagctgttcctgcctgtgtctggccccagcgaccagcacagatctcggagcaaagccatctctggcatgccaagggtgggc

SEQ ID NO: 95326 - DNA, 601 bp, Human
ttccctttctctcacaccttaaggaacatgccggttcttgcccccacaccttggctcaggcggtgctcaggccagatgccctcctttctcctccccagccctcaaagtcttacttgtttctcaggcagaagctacacaccgtccaggtacacatcccccatcattctcactcccagggacagcacccactccgagggtctggcatgctcgcttaggcccagccagctgcatgctgagttacacatggctgtgcagagtgctcattaccttgaccttttatctcccaccaaaaatctcatgkcagcagatggggaagggtcctgggatttgatgccgaaaggtgtggcctgggtctgctgcactctctgagctgctttcgtttgctcatctgctagatgagcggggtgagcactaattgagcacctactaagtgcctggtgctacactgcatgctttccatgcttggctcatcctacctcacagctgccccacctgcgggcaagggatcctgaggctcagggcacatagcactgaggctgcaacagcaccaaagccatgattcagacctagatctgtgacttcagagtccagattctgctta

SEQ ID NO: 95327 - DNA, 601 bp, Human
cacacacacacacacacagctttgtgctccagcctttctttgcacacactgcttcctttgttggtaatgcactgcctcgtgaactcctattcatccctcaagacccagccctaatgtcaccttctctgagaagccttcctgcacacttccaggcagagttagagaatcactcctctgctggagcccttatcatactgcctggtaattacctgatttcatgggtctgcctctttccccctgggctctgagctgcctacaggtccctaggcacagccctgttgggagcgtgaagaaatgtaaraaggaacaactggtcagatcaggctcagacgagctctgagctggactgaggggagaaggcaatgcataggggcagtgtcctgagctgagcggcctgcagaagggctggctgtgccactggttgattgtgccatgggagtgtgtgagggtgtgcacatgtgtatctgtgatgtaggagactgtgaccatcttttaaattgagctcatgcagccagctcctcctcccatcctgaagggcgtctctttgagtctctgcctagctgtcggaattcaaggactggatggccgtggctcacaccaa

SEQ ID NO: 95328 - DNA, 601 bp, Human
gcctgggatgggggcaagtgtccaagaaagaggggcactggaccctgaaggacctgctgtgtggtttggcaatgctggcgtgtttcagggctgctgggaagcgccctcaggccccacatgcctgtgtgatgctggcagttctgccagctctggcccattcctctggctgtgtttagtctgtcaaaatgaccatctctgggaacatgtgtgcccctggatccttagcggtcatcacaacatagtggggttggggggttccagctccctacccagagtagggtgggattgtatgtgatgaccyggtaggggtggggtggggaccagagacagagaagaagctgaaacggtggggagaaagctctcctgccctcaggtactgccccctcccttatcctgtccacaccctgagccctgcttaccaccaaccagtgtcatcaagaacgcccacttccctgccagggcacaggcaggggctccagcccagccccacctgggttggttgtggttctaccacctgctatctgggcacccttggccaagggacctagcctatctggggatgttcccatccacaagatgggcataaagtgcctgtgttgtg

SEQ ID NO: 95329 - DNA, 601 bp, Human
gcccagccccacctgggttggttgtggttctaccacctgctatctgggcacccttggccaagggacctagcctatctggggatgttcccatccacaagatgggcataaagtgcctgtgttgtgaatgttttatttgaattcacaaagaaaatatgtgcatgtgccccaccgatggctggcacacagtcagccctaccctggggagataccaggtaagagcacggctgtgatctcactggccctgtgcaaaagagacatctcggaaggcttcctggaggaagtgtctagacagtcattgatrgctacgatggccagtgggcctgtctctggtattgtgtgccctgggtttccaggccagcagacactctatattccaaattggcttgttgctgaggagagaaggaaagggagttaatgcatataaaccccctaccaggtgcccggccctggtcatttcacaccaccctggtgaggcaccagagaggagcagcattctggctgaggctacacagccaagcgggaaggattaggaagccagtgcccttgaagggacaggcagtgccaggtgcagcatcctgccccaccttgctgcatcccgaga

SEQ ID NO: 95330 - DNA, 601 bp, Human
agtgcctcgatgagggagtcccagcctgggagtgaggcccgctggagggagctcctgcttgcctctcactggccgcacagcatggagaatgactcccctgtctggatgcagtgtgctcgtggtcaagtgcagtggttggttccatttttccataccctcctgaggggcacacagccggtgcttacttcatgggggctgccatgaggatatagtccaggcatccctgcagagacccctggatgtccctacagagcccagggcctgagagaggaaaaggctgccctgggctacccctgggctyctgactcccttggtgatgcttgcggtgggaagggggaggtggagtctaccttccccaaatggtggcaactgcaccgtggaggcggaagtcccagctcctccatgtgtgacccaggccccacctgccatctccaggcccagctgcctccatggcagccccagacagtggtgtgcatgtggctgtgacaacacctcactccgggcctctcaggggaggctcacctggccagtgggacctgggtcaccttggacagactgggcctgctgtgtggcctcaccatgtagcttgaaatccccacgt

SEQ ID NO: 95331 - DNA, 601 bp, Human
cacagcggcctcccaggggggtgtttgtgaaacccagatgtgaggatatctggatgtcacctgtttgggtcctggtttgtactgtactgtaagcccagttttcatgcactattgagcatgatcagtaattatctctggtttgctcagccaacagacaaatcatttcctccctgaaataaccagttccagcagtggcctttcacacgtccagcatcaatccagtgtgaagattgggagggcctcccgggcaatgctaggttagccctcaaagtgtggttctaaccctctaacagcagttctyctttcatgactgcctgccatgtctctggcacagttttggggactttcatcctcacgacaaccctatgaaacagacactattatgatccccattccacagatgaggaaactgaggctcggagaggttacagtgtgatgtggctgggattctaacccaggtttgtctgattctaacacactctcttttctttgcacaatgtcaaattatagactaaagaataaaaatgaaatcttggtaaatgtggttcctggtgacttagctgtggttttgcagctgcttcaccataaagtctgattcatc

SEQ ID NO: 95332 - DNA, 601 bp, Human
attctaacccaggtttgtctgattctaacacactctcttttctttgcacaatgtcaaattatagactaaagaataaaaatgaaatcttggtaaatgtggttcctggtgacttagctgtggttttgcagctgcttcaccataaagtctgattcatctttaatgagtgagttttggagtagattacctcaaaatacacctgcagctgcatagaggccccaggtcagcaggcctgacataagggcctgaggtcacatcgaatggattccatgactcttggtgggcggacttggggacatggggrtgggccctggccatgccagcccaagccagcggcaccaagcccaatgcacacctgactattggggcatcggagaagggtggttctgttagcgctaggaggaattccatggaaggagaacgaggagatattccaagattttagttagggctcatcaatttcaaaacttgccttgaatcctgaccctgcggccgagctggtcacaccagcaaccaaccatccaactgaagccagaaactctccacttgcaggacatctcctgatccctctctttttcacatatcctgttagcagtatgagctc

SEQ ID NO: 95333 - DNA, 601 bp, Human
atgtcaaattatagactaaagaataaaaatgaaatcttggtaaatgtggttcctggtgacttagctgtggttttgcagctgcttcaccataaagtctgattcatctttaatgagtgagttttggagtagattacctcaaaatacacctgcagctgcatagaggccccaggtcagcaggcctgacataagggcctgaggtcacatcgaatggattccatgactcttggtgggcggacttggggacatgggggtgggccctggccatgccagcccaagccagcggcaccaagcccaatgcacrcctgactattggggcatcggagaagggtggttctgttagcgctaggaggaattccatggaaggagaacgaggagatattccaagattttagttagggctcatcaatttcaaaacttgccttgaatcctgaccctgcggccgagctggtcacaccagcaaccaaccatccaactgaagccagaaactctccacttgcaggacatctcctgatccctctctttttcacatatcctgttagcagtatgagctctttgcgttttacccgtggtattcgtattttcatattcgttttcatacatg

SEQ ID NO: 95334 - DNA, 601 bp, Human
tgaagctgtggcattgtgttcagatgcctgagagagaacattgattggcctggctcagagatcagatggccaccccggtgtgactaatttcagccagaaaagggcagggtcacatggtacaaatatgtctttatatgtataaagcagatctaaagttttacacttctagtccccacccaccccaccaacagacacatgcaaacacatattagtaacccggacatttaggggccagtcccaccatgccgtctccctgggaagtgcacccccatccatagcatggcatggccccgtgccgccyctgagagcgctgttagccactcattgtccccatccttgaaagcagccaagtgcaacttctcagaattcacgaagctaagacttgacctctcaggctagaggacatctgcaacttgaacttcagagccccatgggcagaggctctaggaaatggggtcccagcgagtctcttatcactaccagcattctccccgagaggaatgcatcctcttccaactggtgggtgtgaccacgagttgaagcggaggcctggctctgagaatgtgcaggctgggattgcacgatgaaaaggaggcatcca

SEQ ID NO: 95335 - DNA, 601 bp, Human
ggcatggccccgtgccgcctctgagagcgctgttagccactcattgtccccatccttgaaagcagccaagtgcaacttctcagaattcacgaagctaagacttgacctctcaggctagaggacatctgcaacttgaacttcagagccccatgggcagaggctctaggaaatggggtcccagcgagtctcttatcactaccagcattctccccgagaggaatgcatcctcttccaactggtgggtgtgaccacgagttgaagcggaggcctggctctgagaatgtgcaggctgggattgcaygatgaaaaggaggcatccagttttcaaatgtgcagaagggctccctgaatcgttgactcatcttcctggcacggaggtttgcactttgcctggtcctcacaaaagagaaaccaaacaaggcaaatagttgtagccagggggcttgaaaatggctagctggaatgtgacaccattctgaaatggcccctcaagtcagaactcagccctgaactctgcgtgcgtcccctgtgtggccttgaccaagctggggtgccctgaggcctgtgctgcctctatgcccagctgctgtcttgttggaca

SEQ ID NO: 95336 - DNA, 601 bp, Human
cctcttccaactggtgggtgtgaccacgagttgaagcggaggcctggctctgagaatgtgcaggctgggattgcacgatgaaaaggaggcatccagttttcaaatgtgcagaagggctccctgaatcgttgactcatcttcctggcacggaggtttgcactttgcctggtcctcacaaaagagaaaccaaacaaggcaaatagttgtagccagggggcttgaaaatggctagctggaatgtgacaccattctgaaatggcccctcaagtcagaactcagccctgaactctgcgtgcgtccmctgtgtggccttgaccaagctggggtgccctgaggcctgtgctgcctctatgcccagctgctgtcttgttggacagtgggcccagccctatccacatcactcctgaggtcccagtgctgggattataggtgtgagccaccatgcccagcccatgatgggctgaccaagagtgagaggacacaggtcaggttccagagtctgcctggctcacactaacactgtcaactccccagccttggttccctcggacagtgaccaggctggcgttccttcctactactcctgaacaacgggttgatg

SEQ ID NO: 95337 - DNA, 601 bp, Human
cagcacagtgcaaacagtggggcagtgggggaaaatgccgaggagagaaaccccgacaccaggtgtgcatttctctctgctttttttttttttttttttttttttttggcaggagaaggcacagccagtgccaggttctgacggcttctttctctcccctctgcccacagtggcccaggagcaccttaaggagaggggactgtttggccttcctgctccaggcaccaccccctcagactattaccaccagatgaccctcgtggcaggccaccccgcgccctacggggacctgctgatgcaragcgggggcgctgccagcgcaccccatctccacgactacctcaaccccgtggacggtgagtgctggccccgaggggctaaggatggggccagcagatctcctcttgaggctgagaaggtcactcgctgtttcttttggggacaaggacccttaaggagaggtcgggctgtaccccaatgccttccaggatggctgtccacaggcactgaatctttggacaacacttactgagtcaccacaggccaggaggcattgtaagcatcgcagacaccacagcaaacaaagctggaacttacagtg

SEQ ID NO: 95338 - DNA, 601 bp, Human
tggaaggggctggggagcaactttgccttccgggcactcagcatttggcagccccgggggctgagcatctctgggaagcagcagaggagtgcagaggtgagctcagcagtgggcgcgagagctcccagccctccagcagctgctggttaactcatcacaccccacccgctgtgccttctccacctccgccttgggaacacatctggcttcaggacatggaggtaacggggaagcatcaccagattccagagtccacctgaggagggatatcagtttctccagctccagtatggggtggggrtgggagcatttttcttatccatggatttcaggagcagatgccttctttccctttgttcccagtcagttacaatccaagaaaatcagagtagtccaggattatctcctatttttattgctacttaatacattttttccaaaaccagtttcaactagaaccagaaccttcgcttcaccttttaaaaatgctttccgcacttccacttagctccgaggcctgtgtggacggttactcacgtatgtctctaagagacgctgaacacaacacctgggctctcagccaggcggctcgggctggacc

SEQ ID NO: 95339 - DNA, 601 bp, Human
cccctccaccacattgagaagattgagatgtttccgactgaaatgttgtctgtttactgctcatactgcctccaagccatgcattttattgtcatattgacactaatttggctcggatgtcacctccattctgacgcctgttctttatgctgcctgtggatccggggggttttcagaaaccaattacattgatcaaacccagagaggcaggaagagctggtagaggggctgccagaggcccaagtcaggcagggatccctttccgagacaggaaggggaaccgaggcaaaggaagccacaytgcaggtccctgcgtgagatggtggagctgctgtgtacaggcacgggctaagcggtgtctatgggccatctggtaaagccacacagactgtcccgccacaccagcttcacaaagccgcttcacaggagcctgcagcacagcctgtttctctgtgttcatcacttagctaggccgtggtcctggcaactctgaacctcgctgctccacggcccaggcacttgctactcccccatcagaggggtgagagggctgtggatggctaggtgtggggggcattaaggtcctcaggtcagatttcct

SEQ ID NO: 95340 - DNA, 601 bp, Human
ctcggatgtcacctccattctgacgcctgttctttatgctgcctgtggatccggggggttttcagaaaccaattacattgatcaaacccagagaggcaggaagagctggtagaggggctgccagaggcccaagtcaggcagggatccctttccgagacaggaaggggaaccgaggcaaaggaagccacactgcaggtccctgcgtgagatggtggagctgctgtgtacaggcacgggctaagcggtgtctatgggccatctggtaaagccacacagactgtcccgccacaccagcttcacraagccgcttcacaggagcctgcagcacagcctgtttctctgtgttcatcacttagctaggccgtggtcctggcaactctgaacctcgctgctccacggcccaggcacttgctactcccccatcagaggggtgagagggctgtggatggctaggtgtggggggcattaaggtcctcaggtcagatttccttagagcatctcctcggcaagccagaaaatatctgggtgagggagttgggctatgcagggaacacatcttagccagtgaggattcagggtacccgagccccaccaccaggct

SEQ ID NO: 95341 - DNA, 601 bp, Human
caaacccagagaggcaggaagagctggtagaggggctgccagaggcccaagtcaggcagggatccctttccgagacaggaaggggaaccgaggcaaaggaagccacactgcaggtccctgcgtgagatggtggagctgctgtgtacaggcacgggctaagcggtgtctatgggccatctggtaaagccacacagactgtcccgccacaccagcttcacaaagccgcttcacaggagcctgcagcacagcctgtttctctgtgttcatcacttagctaggccgtggtcctggcaactctgarcctcgctgctccacggcccaggcacttgctactcccccatcagaggggtgagagggctgtggatggctaggtgtggggggcattaaggtcctcaggtcagatttccttagagcatctcctcggcaagccagaaaatatctgggtgagggagttgggctatgcagggaacacatcttagccagtgaggattcagggtacccgagccccaccaccaggctgcatcctgctggccttgtattttttcctgaaatggaaaacctaatccctgtctgaggaggatgttcctgtctctgtctccat

SEQ ID NO: 95342 - DNA, 601 bp, Human
tggtagaggggctgccagaggcccaagtcaggcagggatccctttccgagacaggaaggggaaccgaggcaaaggaagccacactgcaggtccctgcgtgagatggtggagctgctgtgtacaggcacgggctaagcggtgtctatgggccatctggtaaagccacacagactgtcccgccacaccagcttcacaaagccgcttcacaggagcctgcagcacagcctgtttctctgtgttcatcacttagctaggccgtggtcctggcaactctgaacctcgctgctccacggcccaggcrcttgctactcccccatcagaggggtgagagggctgtggatggctaggtgtggggggcattaaggtcctcaggtcagatttccttagagcatctcctcggcaagccagaaaatatctgggtgagggagttgggctatgcagggaacacatcttagccagtgaggattcagggtacccgagccccaccaccaggctgcatcctgctggccttgtattttttcctgaaatggaaaacctaatccctgtctgaggaggatgttcctgtctctgtctccatcaaacctaaaataacccagccccg

SEQ ID NO: 95343 - DNA, 601 bp, Human
ggaagccacactgcaggtccctgcgtgagatggtggagctgctgtgtacaggcacgggctaagcggtgtctatgggccatctggtaaagccacacagactgtcccgccacaccagcttcacaaagccgcttcacaggagcctgcagcacagcctgtttctctgtgttcatcacttagctaggccgtggtcctggcaactctgaacctcgctgctccacggcccaggcacttgctactcccccatcagaggggtgagagggctgtggatggctaggtgtggggggcattaaggtcctcaggycagatttccttagagcatctcctcggcaagccagaaaatatctgggtgagggagttgggctatgcagggaacacatcttagccagtgaggattcagggtacccgagccccaccaccaggctgcatcctgctggccttgtattttttcctgaaatggaaaacctaatccctgtctgaggaggatgttcctgtctctgtctccatcaaacctaaaataacccagccccgggctgaggatggcatctggcacagagaaggctcctgggaccaggtgccaggatgatgctctttcctcctgccc

SEQ ID NO: 95344 - DNA, 601 bp, Human
gccgcttcacaggagcctgcagcacagcctgtttctctgtgttcatcacttagctaggccgtggtcctggcaactctgaacctcgctgctccacggcccaggcacttgctactcccccatcagaggggtgagagggctgtggatggctaggtgtggggggcattaaggtcctcaggtcagatttccttagagcatctcctcggcaagccagaaaatatctgggtgagggagttgggctatgcagggaacacatcttagccagtgaggattcagggtacccgagccccaccaccaggctgcrtcctgctggccttgtattttttcctgaaatggaaaacctaatccctgtctgaggaggatgttcctgtctctgtctccatcaaacctaaaataacccagccccgggctgaggatggcatctggcacagagaaggctcctgggaccaggtgccaggatgatgctctttcctcctgcccctcagcccaggctcctgggcacacaggccgtggggggatccccagccccgattccatgcaagtccacccacaggtatagatgatatgttggttgtcagcccatagcatccctggggtgggtgct

SEQ ID NO: 95345 - DNA, 601 bp, Human
gggctgtggatggctaggtgtggggggcattaaggtcctcaggtcagatttccttagagcatctcctcggcaagccagaaaatatctgggtgagggagttgggctatgcagggaacacatcttagccagtgaggattcagggtacccgagccccaccaccaggctgcatcctgctggccttgtattttttcctgaaatggaaaacctaatccctgtctgaggaggatgttcctgtctctgtctccatcaaacctaaaataacccagccccgggctgaggatggcatctggcacagagaagsctcctgggaccaggtgccaggatgatgctctttcctcctgcccctcagcccaggctcctgggcacacaggccgtggggggatccccagccccgattccatgcaagtccacccacaggtatagatgatatgttggttgtcagcccatagcatccctggggtgggtgctggtagcccatcttctgcatgagacaaccagtgattggctcaaagctacccagttcagagtgtgcaagcagggttggaacctgggtctgcctgagtccagggcctgttcttgcatctcctgcccttcctactgc

SEQ ID NO: 95346 - DNA, 601 bp, Human
gtgggtgaagcaaggtccagaggcaggtggtgtcagcgtccgcccaggtgagggtgggcaggtggccagtcacccgtggccgaccggcattaaaacaggtgcctccacagatgaatactccatgttcccggtcataaatcacaggagaaaccacgggaaatgagtgccaggcttttctttctatttagtaatttatcaagggaagaggtgcattaataaacatatttcccatgagaggcggggataacagagatgaatatcactgtcagatttggcctgtttcctcttgttaggggcacaygagagggtgggaatccaaatattagcggcagattctttttttaaaaatgtgttacgaagatgtgtgtgtttcttactttatatcatgttagatggtttttcccctcacattaccgtatttgccactcagtttgtaagtaataggagcctttcagagaattcactcctgcatctttctttgagtttcctttgaagcgaggattgacaaggagtggactcagtaaataagaacccagaagctgagagggcgccgaatgcaagccgatgagtgaatgtctaatgacagctgtgttgctgagtg

SEQ ID NO: 95347 - DNA, 601 bp, Human
ccatgagaggcggggataacagagatgaatatcactgtcagatttggcctgtttcctcttgttaggggcacacgagagggtgggaatccaaatattagcggcagattctttttttaaaaatgtgttacgaagatgtgtgtgtttcttactttatatcatgttagatggtttttcccctcacattaccgtatttgccactcagtttgtaagtaataggagcctttcagagaattcactcctgcatctttctttgagtttcctttgaagcgaggattgacaaggagtggactcagtaaataaraacccagaagctgagagggcgccgaatgcaagccgatgagtgaatgtctaatgacagctgtgttgctgagtggcccaatcatctttcctagacttgctgcccttcactccattattgactggaggctcaccctgccccttggaacagtcctcctggcccttgaagaagccacattcattagcaatttcattttggaatgcccgctgggttttaggcactattcttggcattctatgtgtgtcttcacaacagccctgcaaagcaagccacactgccctgattgtacagatggggaaagag

SEQ ID NO: 95348 - DNA, 601 bp, Human
tcatgttagatggtttttcccctcacattaccgtatttgccactcagtttgtaagtaataggagcctttcagagaattcactcctgcatctttctttgagtttcctttgaagcgaggattgacaaggagtggactcagtaaataagaacccagaagctgagagggcgccgaatgcaagccgatgagtgaatgtctaatgacagctgtgttgctgagtggcccaatcatctttcctagacttgctgcccttcactccattattgactggaggctcaccctgccccttggaacagtcctcctrgcccttgaagaagccacattcattagcaatttcattttggaatgcccgctgggttttaggcactattcttggcattctatgtgtgtcttcacaacagccctgcaaagcaagccacactgccctgattgtacagatggggaaagagaggctcaggaaagctaagtaaatgtgctccaaggaagccacaaagtgacaggcttgacagggacagtggcagaggctgtgtgcctctgcatcttgtgtgtgtgtgtgtgtgcgcgcacgcgcatccacctggggtatgtgtctccacctggggtg

SEQ ID NO: 95349 - DNA, 601 bp, Human
cattattgactggaggctcaccctgccccttggaacagtcctcctggcccttgaagaagccacattcattagcaatttcattttggaatgcccgctgggttttaggcactattcttggcattctatgtgtgtcttcacaacagccctgcaaagcaagccacactgccctgattgtacagatggggaaagagaggctcaggaaagctaagtaaatgtgctccaaggaagccacaaagtgacaggcttgacagggacagtggcagaggctgtgtgcctctgcatcttgtgtgtgtgtgtgtgygcgcgcacgcgcatccacctggggtatgtgtctccacctggggtgtgtgtctccacctggggtgtgtgtgtatgtgtccacctggggtgtttgtgtgtgtgtccacctggggtgtgtgtgtatgtgtccacctgggtgtgtgtgtgtccacctggggtgtgtgtgtgtgtctccacctggggcccccctcccatgcagggggccctccctgtgccttcctgccgtcatactccctgccccctgagacacctctcctcctctgcaccctgggcataggccctgtggcaggtggttttggtg

SEQ ID NO: 95350 - DNA, 601 bp, Human
ccatccctctacccagagtcccttcatcccaggctgctggctgtctactcccctctgtggcctcagactcccctcatcccatgaaagaggctgttaggagagaaaaccctggaagcccctttcggcccaatggtcctggatgtcctctgtcctctctatgccttggagaggtgcttctcctggtggcctggcaggaaagagcctccccagggatccctaggtctcctcagggttgcagccaagcttggggctgggccgggcatggttgcctcgaggggccaacatggatcccagggcttgyggcttgttcagtaggtgggtgcgggctctgccctcacacagccttcttggggactggtaggtgtggagtggggggctcagaggctcgtaggccatcaccccctgccctcggtgctcctgcagctgtggagacataaggaactgccacgtgcatgattcagagtggccctaaggtcagtggtcaaagccatcaggaaagcttcgggagcacccgccaagaggctgtgtgtactgtgagcaggaggcccatggagccagaccctgcagtcagggcagcctgcctggaggagggggcacccag

SEQ ID NO: 95351 - DNA, 601 bp, Human
ttgcaccttttttatgaattcaaaaccaataatgatcaaattgaaatgagcccatatctgagtacatcttcatggaccaggcctgtcatgaatgactcaaatgtgaaatcaaaggtgtttgaggtcaaagatggttttcctagtatttcactgaatttggtggagcagccaagtattggccaaccttggagaccacacaaaatgtgacattgacatggcccatgctctcagcaagcctctgggctggcagcaggcctccctctgtagccgcatggtggcacacccaagcctcactgacacyagccacccttctcccttctgtgcggctctagtctgtctgaggactcagaccccagccagcttgactgaaactcacatgcctctccagcacctccggaagaggccaggaggagttaggaatgtcaggagagtttgtcccaacgacctggagatggaaggaataacaagtgtatttgttatcttttgctgcctaacaaattgctccaacgcatagcagtttaaaaccacaagcaattgttctctccccccatttctgagggtcaggaatttgagacaggctgagctccggctctctcaggtg

SEQ ID NO: 95352 - DNA, 601 bp, Human
atctggacacatgagggttgttcactgccagctcatgctaagaacttgtggagggcctctggatttacgtctggccgctagggtgccttctgggcagaggccacgttacagaaagggtgagacctgggctcagtccatgggaagctcccagcttcttgattctgccgtctcctgtccaagaagcataataagtagatggagaaagcctcgattcccagggcctggcaccatggaggcactccatgcacagcacatagcatgggtgggtgagtgaatcattataagactgtgcagtttcgtygtagaacgtgcatttgcagcaggctttcacacactgcctcattcgacccttccaacgggccttgagcatgcctgggcatcctagtacagtgcctggcacatcctaggtgccattattatttggcaaatgaagtgttcttttacaataaggacatggaagggcacaggccttagcatcagtcagaccatctttgggatcccaacttgcctgaaagcagcacatctctttccctctcgcagcctgagctaacttatctgcagagtgggattcctgatgcctaggtggggtcactgtgcatac

SEQ ID NO: 95353 - DNA, 601 bp, Human
cacatgagggttgttcactgccagctcatgctaagaacttgtggagggcctctggatttacgtctggccgctagggtgccttctgggcagaggccacgttacagaaagggtgagacctgggctcagtccatgggaagctcccagcttcttgattctgccgtctcctgtccaagaagcataataagtagatggagaaagcctcgattcccagggcctggcaccatggaggcactccatgcacagcacatagcatgggtgggtgagtgaatcattataagactgtgcagtttcgtcgtagaaygtgcatttgcagcaggctttcacacactgcctcattcgacccttccaacgggccttgagcatgcctgggcatcctagtacagtgcctggcacatcctaggtgccattattatttggcaaatgaagtgttcttttacaataaggacatggaagggcacaggccttagcatcagtcagaccatctttgggatcccaacttgcctgaaagcagcacatctctttccctctcgcagcctgagctaacttatctgcagagtgggattcctgatgcctaggtggggtcactgtgcatacaaacaag

SEQ ID NO: 95354 - DNA, 601 bp, Human
accgtcaaccctgtcgccattcacaagcgcagcaaggtcaagaccgagcctgagggcctgcggccggcctcccctctggcgctgacgcaggtaacctgctgccagccgcaccaccttcctccagctaggaccaggcctgtgggctgccttggggctgtacccttggtggtgaacggatggctggctggctgcctgcatggatgaatgagtgacccagggaggactgggtgggaatgctgagctgtgactttctcaccactgtgttcccagcaccctggacatactacattcccatcacacrtggtgaatgaatgaatgagtgaatgaatgaacttctgcctagccatccctcttgtctcaggctgcatctgtctctctctccccacacctgacctgtgtacagcaccagccacagcctagctgagttgctcacgtccccggaatggcccaggcccttctaggctgctgtcgctcttggaactctaccccaccctggctccttcgctgccacttcagcccttcctgattctcctgggtgataggactgagctccaggcccacacacccagcctagctcaggggtcacttgagggcatgtgct

SEQ ID NO: 95355 - DNA, 601 bp, Human
ccagctaggaccaggcctgtgggctgccttggggctgtacccttggtggtgaacggatggctggctggctgcctgcatggatgaatgagtgacccagggaggactgggtgggaatgctgagctgtgactttctcaccactgtgttcccagcaccctggacatactacattcccatcacacgtggtgaatgaatgaatgagtgaatgaatgaacttctgcctagccatccctcttgtctcaggctgcatctgtctctctctccccacacctgacctgtgtacagcaccagccacagcctagytgagttgctcacgtccccggaatggcccaggcccttctaggctgctgtcgctcttggaactctaccccaccctggctccttcgctgccacttcagcccttcctgattctcctgggtgataggactgagctccaggcccacacacccagcctagctcaggggtcacttgagggcatgtgctgtgtgcacacctgtctccctgtctgcactctaagctttggagaggtggcgctatgggagaagtgcctgactgggttccatgccaccagggtttgtgcaagtgtgcagtcactgacacagt

SEQ ID NO: 95356 - DNA, 601 bp, Human
ttcccatcacacgtggtgaatgaatgaatgagtgaatgaatgaacttctgcctagccatccctcttgtctcaggctgcatctgtctctctctccccacacctgacctgtgtacagcaccagccacagcctagctgagttgctcacgtccccggaatggcccaggcccttctaggctgctgtcgctcttggaactctaccccaccctggctccttcgctgccacttcagcccttcctgattctcctgggtgataggactgagctccaggcccacacacccagcctagctcaggggtcacttsagggcatgtgctgtgtgcacacctgtctccctgtctgcactctaagctttggagaggtggcgctatgggagaagtgcctgactgggttccatgccaccagggtttgtgcaagtgtgcagtcactgacacagtattttccaatgattcaatgcacatttgagtcagtgagtggcgtggtgaggggggaagacaggacaagttcaagcggggagagaagagcggagcagcccacagcccagtgcaggcctaccacgtggcccagaccctgtgctgatccttttggaaactttgccacttatt

SEQ ID NO: 95357 - DNA, 601 bp, Human
tgggacagcctcttttggtggcagagttccacagcagaatgtccagcagaacaatattacaggccacaaatgccagctatccatgtaatttacatttcctaggagtgcatttaaaagtaaaaagaaacaggtgaagttaattttaatattttttatccagcccaatatatctgaaatatcatttagcaggtagtcaatagaaaagaaagttattgagatattgtatattcttttttttccattctaagtctttgaaactggtgtgtagtttgcacttctagcccatcccagctcaggccasccacatttcaagtgtgcaagagccccacatggggcaagtggtcactgcattggacagtgtgggtctagaggttgtgggaggggggctgggaggaagtgaagacgggggaggaaactgagaacagaggaggaaggggaggcctctaagacctgagtgtcctggcctcgccaccaggctggggaagtaaacccagccttacccgagatacgcggcagggttagtcgtgctgcgctggctgtcccaactcacttgcctggggccgttttctcccaggataagcttcacacagtgcccagagcc

SEQ ID NO: 95358 - DNA, 601 bp, Human
cagctcaggccagccacatttcaagtgtgcaagagccccacatggggcaagtggtcactgcattggacagtgtgggtctagaggttgtgggaggggggctgggaggaagtgaagacgggggaggaaactgagaacagaggaggaaggggaggcctctaagacctgagtgtcctggcctcgccaccaggctggggaagtaaacccagccttacccgagatacgcggcagggttagtcgtgctgcgctggctgtcccaactcacttgcctggggccgttttctcccaggataagcttcacacmgtgcccagagcccaccattaaggtcagttctggctccaccacgccgactgccagggccctgtgcaggccactgaactctctgtgcctttgtggaaaggggacaaagccattatctcatgggtcaatgccaaaaatagagataagcatgtgttatttttctactgaaacaaaatatgttatttacaaacctctgaaacaataggggcaagcttaggagaggcttctcatgcacccactacgggcacgtttgcctcgctgcggttagtgcctactgtttgcagcctgggagcgtcatcacac

SEQ ID NO: 95359 - DNA, 601 bp, Human
ctgagtgtcctggcctcgccaccaggctggggaagtaaacccagccttacccgagatacgcggcagggttagtcgtgctgcgctggctgtcccaactcacttgcctggggccgttttctcccaggataagcttcacacagtgcccagagcccaccattaaggtcagttctggctccaccacgccgactgccagggccctgtgcaggccactgaactctctgtgcctttgtggaaaggggacaaagccattatctcatgggtcaatgccaaaaatagagataagcatgtgttatttttctaytgaaacaaaatatgttatttacaaacctctgaaacaataggggcaagcttaggagaggcttctcatgcacccactacgggcacgtttgcctcgctgcggttagtgcctactgtttgcagcctgggagcgtcatcacaccagagcccaggctgcggtgcacaggatggctttgcccaatatagacggtcactttgaggactgattggaaaatgcagggcagataagcggcacgcagtaggccttcatttaagggcagctagtgatgattcatgaggaggcgtggcccggctcgtaggggtg

SEQ ID NO: 95360 - DNA, 601 bp, Human
gcattgtattcactttgaggctattatgaataatgctgctatgaacatgtgcgttcatgtttttatatggacagaacgttttcacttctcttgggtatgtgtaactaggagtggaattggtgagtcgtatggcagttgaggaactgctagtctgttttccaaaaacgctgctccattttacctttccacccacaatgaatgagggttctgatttctccaaatcctcaccaacactggttgttacctgtcttttttattctagccatatcctagtgggtataaagtagtattttattgtgtktttgattagcacttccctaattagtgattaataatgttaaacatcttttcaggtgcttattggccatttgcgtatcttctctggagaactgtctacccaaatattgcccattttgaaacctggttgtctttttgctgttaaattgtaagaatttttcatatatctggttactagacccttgtcagatatatgatttgcaaataattctcccattctctggattttcttttcatttccttgatactttcttttagagcacaaagttcttaattttgaggctgtacaattttttaattgctt

SEQ ID NO: 95361 - DNA, 601 bp, Human
agcagggaagtggcccttctgatctcggagtgtttaacatgcatctgctccctattacttggggctgctgggtgggctctgcctccccatcctctagatgaggaaacgaagactcagagatgaagtgactttccccagtgccagagcagtgatgatccctctgcagctgtgaaaacatcctgggtcactgctccccacccccaaattccctttccaccacaagcaggtgttccactggggagcagctgccccactgcctgagggaagcagagcagtgctgtctgagcttggcgtttgttgrcagccccctggcctgttggcttgggcagccagcagtgacatgctccagctgttagcgctgcctgggcctgccgtggctgtcagccccagcagacggggcacagagcagcctctgtctccctgggtaggcagagcccctatctgggctgagagaaccagggagaaagcagggcaagagccggtggcatcctggcccagccacacaattactgtcgctcaggcttactcggaaatgtatgtttttaaaagcttagacatatcctggaccccaaagggactttgctccaatgcttgtaagaag

SEQ ID NO: 95362 - DNA, 601 bp, Human
gcagggaagtggcccttctgatctcggagtgtttaacatgcatctgctccctattacttggggctgctgggtgggctctgcctccccatcctctagatgaggaaacgaagactcagagatgaagtgactttccccagtgccagagcagtgatgatccctctgcagctgtgaaaacatcctgggtcactgctccccacccccaaattccctttccaccacaagcaggtgttccactggggagcagctgccccactgcctgagggaagcagagcagtgctgtctgagcttggcgtttgttgayagccccctggcctgttggcttgggcagccagcagtgacatgctccagctgttagcgctgcctgggcctgccgtggctgtcagccccagcagacggggcacagagcagcctctgtctccctgggtaggcagagcccctatctgggctgagagaaccagggagaaagcagggcaagagccggtggcatcctggcccagccacacaattactgtcgctcaggcttactcggaaatgtatgtttttaaaagcttagacatatcctggaccccaaagggactttgctccaatgcttgtaagaagt

SEQ ID NO: 95363 - DNA, 601 bp, Human
cgtacccctatccatgacacaggcctgcttctctccccagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagacygagagctccggggtaagcggagctgggcagcccagccacgcaaggcgactccatagccgtgcccagggccaccccttgccacggttgcgggctctgccctaaggcccccctctaggggcacagcgatatccctcctctctccaacttggctttcccccttcaccaccttgggcctcacatggaacctatcttgtccaggtcccattctgctctgaccaggctcctgctgggtgtgtggcagcacgctgggtgacagggatgccgccctgtacggtgggcctgcacagggcgggggtggcc

SEQ ID NO: 95364 - DNA, 601 bp, Human
caatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggtgagtaaaggcctggggtttgcagatggggcagragagagtctggggcagcaccaactaggctggcacccaccaagcaccagtgctatctcaccggattcctacaggatcttaccagcccagtacagaaaaggaaactgaggctcagagaggtgaaatgccttacccaaatcaatggcaggggtgagattagccaaaggccatgctctttcaactgcaccattctgagtccttataaccccccaaaacaagcagaccctgcgcacatcatcctcttcctcacccattcattccttcactgatgaggcacttgctgtgggcaccatggcaaaggc

SEQ ID NO: 95365 - DNA, 601 bp, Human
gagcagggaggacttcatggcggaggcagcactgtgctcagtctcaagaggtgttggccaggctctgagatggaaggcgtctttaacgagcatgtcttgggtactgactctgtgcctaggattgtgccgggctgcccactgtggtcaacactgatgtaccacctgctctcacttgaagggaggatttgttgtcccaacttgtggggactactggcaaatggccttgaactctcagccccctacagggatgtcctgggttgcagacagatgccccacccaaggtcaccccttcccagcagcyccgcatgcaatgactggtcactgcaggagtgtaaaggcccagccatcaagatgaggctcagagaggtgcccaactcagggcagcactgaagagccattgggggtcctgggctccctgtgagatcatcctgggctcacgtctcctctgcccactcttgcagcctgtctttccttccatgggtatggacctcagggtactccctgtaataacctgctccttaaactccatctcagggacgcctaggtggcaccacctccacagactgtgagggtactgtgccaggagaccaacctgggcctt

SEQ ID NO: 95366 - DNA, 601 bp, Human
ccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagackccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagcc

SEQ ID NO: 95367 - DNA, 601 bp, Human; identical to SEQ ID NO: 95189

SEQ ID NO: 95368 - DNA, 601 bp, Human; identical to SEQ ID NO: 95190

SEQ ID NO: 95369 - DNA, 601 bp, Human; identical to SEQ ID NO: 95191

SEQ ID NO: 95370 - DNA, 601 bp, Human; identical to SEQ ID NO: 95192

SEQ ID NO: 95371 - DNA, 601 bp, Human; identical to SEQ ID NO: 95193

SEQ ID NO: 95372 - DNA, 601 bp, Human; identical to SEQ ID NO: 95194

SEQ ID NO: 95373 - DNA, 601 bp, Human; identical to SEQ ID NO: 95195

SEQ ID NO: 95374 - DNA, 601 bp, Human; identical to SEQ ID NO: 95196

SEQ ID NO: 95375 - DNA, 601 bp, Human; identical to SEQ ID NO: 95197

SEQ ID NO: 95376 - DNA, 601 bp, Human; identical to SEQ ID NO: 95198

SEQ ID NO: 95377 - DNA, 601 bp, Human; identical to SEQ ID NO: 95199

SEQ ID NO: 95378 - DNA, 601 bp, Human; identical to SEQ ID NO: 95200

SEQ ID NO: 95379 - DNA, 601 bp, Human; identical to SEQ ID NO: 95201

SEQ ID NO: 95380 - DNA, 601 bp, Human; identical to SEQ ID NO: 95202

SEQ ID NO: 95381 - DNA, 601 bp, Human; identical to SEQ ID NO: 95203

SEQ ID NO: 95382 - DNA, 601 bp, Human; identical to SEQ ID NO: 95204

SEQ ID NO: 95383 - DNA, 601 bp, Human; identical to SEQ ID NO: 95205

SEQ ID NO: 95384 - DNA, 601 bp, Human; identical to SEQ ID NO: 95206

SEQ ID NO: 95385 - DNA, 601 bp, Human; identical to SEQ ID NO: 95207

SEQ ID NO: 95386 - DNA, 601 bp, Human; identical to SEQ ID NO: 95208

SEQ ID NO: 95387 - DNA, 601 bp, Human; identical to SEQ ID NO: 95209

SEQ ID NO: 95388 - DNA, 601 bp, Human; identical to SEQ ID NO: 95210

SEQ ID NO: 95389 - DNA, 601 bp, Human; identical to SEQ ID NO: 95211

SEQ ID NO: 95390 - DNA, 601 bp, Human; identical to SEQ ID NO: 95212

SEQ ID NO: 95391 - DNA, 601 bp, Human; identical to SEQ ID NO: 95213

SEQ ID NO: 95392 - DNA, 601 bp, Human; identical to SEQ ID NO: 95214

SEQ ID NO: 95393 - DNA, 601 bp, Human; identical to SEQ ID NO: 95215

SEQ ID NO: 95394 - DNA, 601 bp, Human; identical to SEQ ID NO: 95216

SEQ ID NO: 95395 - DNA, 601 bp, Human; identical to SEQ ID NO: 95217

SEQ ID NO: 95396 - DNA, 601 bp, Human; identical to SEQ ID NO: 95218

SEQ ID NO: 95397 - DNA, 601 bp, Human; identical to SEQ ID NO: 95219

SEQ ID NO: 95398 - DNA, 601 bp, Human; identical to SEQ ID NO: 95220

SEQ ID NO: 95399 - DNA, 601 bp, Human; identical to SEQ ID NO: 95221

SEQ ID NO: 95400 - DNA, 601 bp, Human; identical to SEQ ID NO: 95222

SEQ ID NO: 95401 - DNA, 601 bp, Human; identical to SEQ ID NO: 95223

SEQ ID NO: 95402 - DNA, 601 bp, Human; identical to SEQ ID NO: 95224

SEQ ID NO: 95403 - DNA, 601 bp, Human; identical to SEQ ID NO: 95225

SEQ ID NO: 95404 - DNA, 601 bp, Human; identical to SEQ ID NO: 95226

SEQ ID NO: 95405 - DNA, 601 bp, Human; identical to SEQ ID NO: 95227

SEQ ID NO: 95406 - DNA, 601 bp, Human; identical to SEQ ID NO: 95228

SEQ ID NO: 95407 - DNA, 601 bp, Human; identical to SEQ ID NO: 95229

SEQ ID NO: 95408 - DNA, 601 bp, Human; identical to SEQ ID NO: 95230

SEQ ID NO: 95409 - DNA, 601 bp, Human; identical to SEQ ID NO: 95231

SEQ ID NO: 95410 - DNA, 601 bp, Human; identical to SEQ ID NO: 95232

SEQ ID NO: 95411 - DNA, 601 bp, Human; identical to SEQ ID NO: 95233

SEQ ID NO: 95412 - DNA, 601 bp, Human; identical to SEQ ID NO: 95234

SEQ ID NO: 95413 - DNA, 601 bp, Human; identical to SEQ ID NO: 95235

SEQ ID NO: 95414 - DNA, 601 bp, Human; identical to SEQ ID NO: 95236

SEQ ID NO: 95415 - DNA, 601 bp, Human; identical to SEQ ID NO: 95237

SEQ ID NO: 95416 - DNA, 601 bp, Human; identical to SEQ ID NO: 95238

SEQ ID NO: 95417 - DNA, 601 bp, Human; identical to SEQ ID NO: 95239

SEQ ID NO: 95418 - DNA, 601 bp, Human; identical to SEQ ID NO: 95240

SEQ ID NO: 95419 - DNA, 601 bp, Human; identical to SEQ ID NO: 95241

SEQ ID NO: 95420 - DNA, 601 bp, Human; identical to SEQ ID NO: 95242

SEQ ID NO: 95421 - DNA, 601 bp, Human; identical to SEQ ID NO: 95243

SEQ ID NO: 95422 - DNA, 601 bp, Human; identical to SEQ ID NO: 95244

SEQ ID NO: 95423 - DNA, 601 bp, Human; identical to SEQ ID NO: 95245

SEQ ID NO: 95424 - DNA, 601 bp, Human; identical to SEQ ID NO: 95246

SEQ ID NO: 95425 - DNA, 601 bp, Human; identical to SEQ ID NO: 95247

SEQ ID NO: 95426 - DNA, 601 bp, Human; identical to SEQ ID NO: 95248

SEQ ID NO: 95427 - DNA, 601 bp, Human; identical to SEQ ID NO: 95249

SEQ ID NO: 95428 - DNA, 601 bp, Human; identical to SEQ ID NO: 95250

SEQ ID NO: 95429 - DNA, 601 bp, Human; identical to SEQ ID NO: 95251

SEQ ID NO: 95430 - DNA, 601 bp, Human; identical to SEQ ID NO: 95252

SEQ ID NO: 95431 - DNA, 601 bp, Human; identical to SEQ ID NO: 95253

SEQ ID NO: 95432 - DNA, 601 bp, Human; identical to SEQ ID NO: 95254

SEQ ID NO: 95433 - DNA, 601 bp, Human; identical to SEQ ID NO: 95255

SEQ ID NO: 95434 - DNA, 601 bp, Human; identical to SEQ ID NO: 95256

SEQ ID NO: 95435 - DNA, 601 bp, Human; identical to SEQ ID NO: 95257

SEQ ID NO: 95436 - DNA, 601 bp, Human; identical to SEQ ID NO: 95258

SEQ ID NO: 95437 - DNA, 601 bp, Human; identical to SEQ ID NO: 95259

SEQ ID NO: 95438 - DNA, 601 bp, Human; identical to SEQ ID NO: 95260

SEQ ID NO: 95439 - DNA, 601 bp, Human; identical to SEQ ID NO: 95261

SEQ ID NO: 95440 - DNA, 601 bp, Human; identical to SEQ ID NO: 95262

SEQ ID NO: 95441 - DNA, 601 bp, Human; identical to SEQ ID NO: 95263

SEQ ID NO: 95442 - DNA, 601 bp, Human; identical to SEQ ID NO: 95264

SEQ ID NO: 95443 - DNA, 601 bp, Human; identical to SEQ ID NO: 95265

SEQ ID NO: 95444 - DNA, 601 bp, Human; identical to SEQ ID NO: 95266

SEQ ID NO: 95445 - DNA, 601 bp, Human; identical to SEQ ID NO: 95267

SEQ ID NO: 95446 - DNA, 601 bp, Human; identical to SEQ ID NO: 95268

SEQ ID NO: 95447 - DNA, 601 bp, Human; identical to SEQ ID NO: 95269

SEQ ID NO: 95448 - DNA, 601 bp, Human; identical to SEQ ID NO: 95270

SEQ ID NO: 95449 - DNA, 601 bp, Human; identical to SEQ ID NO: 95271

SEQ ID NO: 95450 - DNA, 601 bp, Human; identical to SEQ ID NO: 95272

SEQ ID NO: 95451 - DNA, 601 bp, Human; identical to SEQ ID NO: 95273

SEQ ID NO: 95452 - DNA, 601 bp, Human; identical to SEQ ID NO: 95274

SEQ ID NO: 95453 - DNA, 601 bp, Human; identical to SEQ ID NO: 95275

SEQ ID NO: 95454 - DNA, 601 bp, Human; identical to SEQ ID NO: 95276

SEQ ID NO: 95455 - DNA, 601 bp, Human; identical to SEQ ID NO: 95277

SEQ ID NO: 95456 - DNA, 601 bp, Human; identical to SEQ ID NO: 95278

SEQ ID NO: 95457 - DNA, 601 bp, Human; identical to SEQ ID NO: 95279

SEQ ID NO: 95458 - DNA, 601 bp, Human; identical to SEQ ID NO: 95280

SEQ ID NO: 95459 - DNA, 601 bp, Human; identical to SEQ ID NO: 95281

SEQ ID NO: 95460 - DNA, 601 bp, Human; identical to SEQ ID NO: 95282

SEQ ID NO: 95461 - DNA, 601 bp, Human; identical to SEQ ID NO: 95283

SEQ ID NO: 95462 - DNA, 601 bp, Human; identical to SEQ ID NO: 95284

SEQ ID NO: 95463 - DNA, 601 bp, Human; identical to SEQ ID NO: 95285

SEQ ID NO: 95464 - DNA, 601 bp, Human; identical to SEQ ID NO: 95286

SEQ ID NO: 95465 - DNA, 601 bp, Human; identical to SEQ ID NO: 95287

SEQ ID NO: 95466 - DNA, 601 bp, Human; identical to SEQ ID NO: 95288

SEQ ID NO: 95467 - DNA, 601 bp, Human; identical to SEQ ID NO: 95289

SEQ ID NO: 95468 - DNA, 601 bp, Human; identical to SEQ ID NO: 95290

SEQ ID NO: 95469 - DNA, 601 bp, Human; identical to SEQ ID NO: 95291

SEQ ID NO: 95470 - DNA, 601 bp, Human; identical to SEQ ID NO: 95292

SEQ ID NO: 95471 - DNA, 601 bp, Human; identical to SEQ ID NO: 95293

SEQ ID NO: 95472 - DNA, 601 bp, Human; identical to SEQ ID NO: 95294

SEQ ID NO: 95473 - DNA, 601 bp, Human; identical to SEQ ID NO: 95295

SEQ ID NO: 95474 - DNA, 601 bp, Human; identical to SEQ ID NO: 95296

SEQ ID NO: 95475 - DNA, 601 bp, Human; identical to SEQ ID NO: 95297

SEQ ID NO: 95476 - DNA, 601 bp, Human; identical to SEQ ID NO: 95298

SEQ ID NO: 95477 - DNA, 601 bp, Human; identical to SEQ ID NO: 95299

SEQ ID NO: 95478 - DNA, 601 bp, Human; identical to SEQ ID NO: 95300

SEQ ID NO: 95479 - DNA, 601 bp, Human; identical to SEQ ID NO: 95301

SEQ ID NO: 95480 - DNA, 601 bp, Human; identical to SEQ ID NO: 95302

SEQ ID NO: 95481 - DNA, 601 bp, Human; identical to SEQ ID NO: 95303

SEQ ID NO: 95482 - DNA, 601 bp, Human; identical to SEQ ID NO: 95304

SEQ ID NO: 95483 - DNA, 601 bp, Human; identical to SEQ ID NO: 95305

SEQ ID NO: 95484 - DNA, 601 bp, Human; identical to SEQ ID NO: 95306

SEQ ID NO: 95485 - DNA, 601 bp, Human; identical to SEQ ID NO: 95307

SEQ ID NO: 95486 - DNA, 601 bp, Human; identical to SEQ ID NO: 95308

SEQ ID NO: 95487 - DNA, 601 bp, Human; identical to SEQ ID NO: 95309

SEQ ID NO: 95488 - DNA, 601 bp, Human; identical to SEQ ID NO: 95310

SEQ ID NO: 95489 - DNA, 601 bp, Human; identical to SEQ ID NO: 95311

SEQ ID NO: 95490 - DNA, 601 bp, Human; identical to SEQ ID NO: 95312

SEQ ID NO: 95491 - DNA, 601 bp, Human; identical to SEQ ID NO: 95313

SEQ ID NO: 95492 - DNA, 601 bp, Human; identical to SEQ ID NO: 95314

SEQ ID NO: 95493 - DNA, 601 bp, Human; identical to SEQ ID NO: 95315

SEQ ID NO: 95494 - DNA, 601 bp, Human; identical to SEQ ID NO: 95316

SEQ ID NO: 95495 - DNA, 601 bp, Human; identical to SEQ ID NO: 95317

SEQ ID NO: 95496 - DNA, 601 bp, Human; identical to SEQ ID NO: 95318

SEQ ID NO: 95497 - DNA, 601 bp, Human; identical to SEQ ID NO: 95319

SEQ ID NO: 95498 - DNA, 601 bp, Human; identical to SEQ ID NO: 95320

SEQ ID NO: 95499 - DNA, 601 bp, Human; identical to SEQ ID NO: 95321

SEQ ID NO: 95500 - DNA, 601 bp, Human; identical to SEQ ID NO: 95322

SEQ ID NO: 95501 - DNA, 601 bp, Human; identical to SEQ ID NO: 95323

SEQ ID NO: 95502 - DNA, 601 bp, Human; identical to SEQ ID NO: 95324

SEQ ID NO: 95503 - DNA, 601 bp, Human; identical to SEQ ID NO: 95325

SEQ ID NO: 95504 - DNA, 601 bp, Human; identical to SEQ ID NO: 95326

SEQ ID NO: 95505 - DNA, 601 bp, Human; identical to SEQ ID NO: 95327

SEQ ID NO: 95506 - DNA, 601 bp, Human; identical to SEQ ID NO: 95328

SEQ ID NO: 95507 - DNA, 601 bp, Human; identical to SEQ ID NO: 95329

SEQ ID NO: 95508 - DNA, 601 bp, Human; identical to SEQ ID NO: 95330

SEQ ID NO: 95509 - DNA, 601 bp, Human; identical to SEQ ID NO: 95331

SEQ ID NO: 95510 - DNA, 601 bp, Human; identical to SEQ ID NO: 95332

SEQ ID NO: 95511 - DNA, 601 bp, Human; identical to SEQ ID NO: 95333

SEQ ID NO: 95512 - DNA, 601 bp, Human; identical to SEQ ID NO: 95334

SEQ ID NO: 95513 - DNA, 601 bp, Human; identical to SEQ ID NO: 95335

SEQ ID NO: 95514 - DNA, 601 bp, Human; identical to SEQ ID NO: 95336

SEQ ID NO: 95515 - DNA, 601 bp, Human; identical to SEQ ID NO: 95337

SEQ ID NO: 95516 - DNA, 601 bp, Human; identical to SEQ ID NO: 95338

SEQ ID NO: 95517 - DNA, 601 bp, Human; identical to SEQ ID NO: 95339

SEQ ID NO: 95518 - DNA, 601 bp, Human; identical to SEQ ID NO: 95340

SEQ ID NO: 95519 - DNA, 601 bp, Human; identical to SEQ ID NO: 95341

SEQ ID NO: 95520 - DNA, 601 bp, Human; identical to SEQ ID NO: 95342

SEQ ID NO: 95521 - DNA, 601 bp, Human; identical to SEQ ID NO: 95343

SEQ ID NO: 95522 - DNA, 601 bp, Human; identical to SEQ ID NO: 95344

SEQ ID NO: 95523 - DNA, 601 bp, Human; identical to SEQ ID NO: 95345

SEQ ID NO: 95524 - DNA, 601 bp, Human; identical to SEQ ID NO: 95346

SEQ ID NO: 95525 - DNA, 601 bp, Human; identical to SEQ ID NO: 95347

SEQ ID NO: 95526 - DNA, 601 bp, Human; identical to SEQ ID NO: 95348

SEQ ID NO: 95527 - DNA, 601 bp, Human; identical to SEQ ID NO: 95349

SEQ ID NO: 95528 - DNA, 601 bp, Human; identical to SEQ ID NO: 95350

SEQ ID NO: 95529 - DNA, 601 bp, Human; identical to SEQ ID NO: 95351

SEQ ID NO: 95530 - DNA, 601 bp, Human; identical to SEQ ID NO: 95352

SEQ ID NO: 95531 - DNA, 601 bp, Human; identical to SEQ ID NO: 95353

SEQ ID NO: 95532 - DNA, 601 bp, Human; identical to SEQ ID NO: 95354

SEQ ID NO: 95533 - DNA, 601 bp, Human; identical to SEQ ID NO: 95355

SEQ ID NO: 95534 - DNA, 601 bp, Human; identical to SEQ ID NO: 95356

SEQ ID NO: 95535 - DNA, 601 bp, Human; identical to SEQ ID NO: 95357

SEQ ID NO: 95536 - DNA, 601 bp, Human; identical to SEQ ID NO: 95358

SEQ ID NO: 95537 - DNA, 601 bp, Human; identical to SEQ ID NO: 95359

SEQ ID NO: 95538 - DNA, 601 bp, Human; identical to SEQ ID NO: 95360

SEQ ID NO: 95539 - DNA, 601 bp, Human; identical to SEQ ID NO: 95361

SEQ ID NO: 95540 - DNA, 601 bp, Human; identical to SEQ ID NO: 95362

SEQ ID NO: 95541 - DNA, 601 bp, Human; identical to SEQ ID NO: 95363

SEQ ID NO: 95542 - DNA, 601 bp, Human; identical to SEQ ID NO: 95364

SEQ ID NO: 95543 - DNA, 601 bp, Human; identical to SEQ ID NO: 95365

SEQ ID NO: 95544 - DNA, 601 bp, Human; identical to SEQ ID NO: 95366

SEQ ID NO: 95545 - DNA, 601 bp, Human; identical to SEQ ID NO: 95189

SEQ ID NO: 95546 - DNA, 601 bp, Human; identical to SEQ ID NO: 95190

SEQ ID NO: 95547 - DNA, 601 bp, Human; identical to SEQ ID NO: 95191

SEQ ID NO: 95548 - DNA, 601 bp, Human; identical to SEQ ID NO: 95192

SEQ ID NO: 95549 - DNA, 601 bp, Human; identical to SEQ ID NO: 95193

SEQ ID NO: 95550 - DNA, 601 bp, Human; identical to SEQ ID NO: 95194

SEQ ID NO: 95551 - DNA, 601 bp, Human; identical to SEQ ID NO: 95195

SEQ ID NO: 95552 - DNA, 601 bp, Human; identical to SEQ ID NO: 95196

SEQ ID NO: 95553 - DNA, 601 bp, Human; identical to SEQ ID NO: 95197

SEQ ID NO: 95554 - DNA, 601 bp, Human; identical to SEQ ID NO: 95198

SEQ ID NO: 95555 - DNA, 601 bp, Human; identical to SEQ ID NO: 95199

SEQ ID NO: 95556 - DNA, 601 bp, Human; identical to SEQ ID NO: 95200

SEQ ID NO: 95557 - DNA, 601 bp, Human; identical to SEQ ID NO: 95201

SEQ ID NO: 95558 - DNA, 601 bp, Human; identical to SEQ ID NO: 95202

SEQ ID NO: 95559 - DNA, 601 bp, Human; identical to SEQ ID NO: 95203

SEQ ID NO: 95560 - DNA, 601 bp, Human; identical to SEQ ID NO: 95204

SEQ ID NO: 95561 - DNA, 601 bp, Human; identical to SEQ ID NO: 95205

SEQ ID NO: 95562 - DNA, 601 bp, Human; identical to SEQ ID NO: 95206

SEQ ID NO: 95563 - DNA, 601 bp, Human; identical to SEQ ID NO: 95207

SEQ ID NO: 95564 - DNA, 601 bp, Human; identical to SEQ ID NO: 95208

SEQ ID NO: 95565 - DNA, 601 bp, Human; identical to SEQ ID NO: 95209

SEQ ID NO: 95566 - DNA, 601 bp, Human; identical to SEQ ID NO: 95210

SEQ ID NO: 95567 - DNA, 601 bp, Human; identical to SEQ ID NO: 95211

SEQ ID NO: 95568 - DNA, 601 bp, Human; identical to SEQ ID NO: 95212

SEQ ID NO: 95569 - DNA, 601 bp, Human; identical to SEQ ID NO: 95213

SEQ ID NO: 95570 - DNA, 601 bp, Human; identical to SEQ ID NO: 95214

SEQ ID NO: 95571 - DNA, 601 bp, Human; identical to SEQ ID NO: 95215

SEQ ID NO: 95572 - DNA, 601 bp, Human; identical to SEQ ID NO: 95216

SEQ ID NO: 95573 - DNA, 601 bp, Human; identical to SEQ ID NO: 95217

SEQ ID NO: 95574 - DNA, 601 bp, Human; identical to SEQ ID NO: 95218

SEQ ID NO: 95575 - DNA, 601 bp, Human; identical to SEQ ID NO: 95219

SEQ ID NO: 95576 - DNA, 601 bp, Human; identical to SEQ ID NO: 95220

SEQ ID NO: 95577 - DNA, 601 bp, Human; identical to SEQ ID NO: 95221

SEQ ID NO: 95578 - DNA, 601 bp, Human; identical to SEQ ID NO: 95222

SEQ ID NO: 95579 - DNA, 601 bp, Human; identical to SEQ ID NO: 95223

SEQ ID NO: 95580 - DNA, 601 bp, Human; identical to SEQ ID NO: 95224

SEQ ID NO: 95581 - DNA, 601 bp, Human; identical to SEQ ID NO: 95225

SEQ ID NO: 95582 - DNA, 601 bp, Human; identical to SEQ ID NO: 95226

SEQ ID NO: 95583 - DNA, 601 bp, Human; identical to SEQ ID NO: 95227

SEQ ID NO: 95584 - DNA, 601 bp, Human; identical to SEQ ID NO: 95228

SEQ ID NO: 95585 - DNA, 601 bp, Human; identical to SEQ ID NO: 95229

SEQ ID NO: 95586 - DNA, 601 bp, Human; identical to SEQ ID NO: 95230

SEQ ID NO: 95587 - DNA, 601 bp, Human; identical to SEQ ID NO: 95231

SEQ ID NO: 95588 - DNA, 601 bp, Human; identical to SEQ ID NO: 95232

SEQ ID NO: 95589 - DNA, 601 bp, Human; identical to SEQ ID NO: 95233

SEQ ID NO: 95590 - DNA, 601 bp, Human; identical to SEQ ID NO: 95234

SEQ ID NO: 95591 - DNA, 601 bp, Human; identical to SEQ ID NO: 95235

SEQ ID NO: 95592 - DNA, 601 bp, Human; identical to SEQ ID NO: 95236

SEQ ID NO: 95593 - DNA, 601 bp, Human; identical to SEQ ID NO: 95237

SEQ ID NO: 95594 - DNA, 601 bp, Human; identical to SEQ ID NO: 95238

SEQ ID NO: 95595 - DNA, 601 bp, Human; identical to SEQ ID NO: 95239

SEQ ID NO: 95596 - DNA, 601 bp, Human; identical to SEQ ID NO: 95240

SEQ ID NO: 95597 - DNA, 601 bp, Human; identical to SEQ ID NO: 95241

SEQ ID NO: 95598 - DNA, 601 bp, Human; identical to SEQ ID NO: 95242

SEQ ID NO: 95599 - DNA, 601 bp, Human; identical to SEQ ID NO: 95243

SEQ ID NO: 95600 - DNA, 601 bp, Human; identical to SEQ ID NO: 95244

SEQ ID NO: 95601 - DNA, 601 bp, Human; identical to SEQ ID NO: 95245

SEQ ID NO: 95602 - DNA, 601 bp, Human; identical to SEQ ID NO: 95246

SEQ ID NO: 95603 - DNA, 601 bp, Human; identical to SEQ ID NO: 95247

SEQ ID NO: 95604 - DNA, 601 bp, Human; identical to SEQ ID NO: 95248

SEQ ID NO: 95605 - DNA, 601 bp, Human; identical to SEQ ID NO: 95249

SEQ ID NO: 95606 - DNA, 601 bp, Human; identical to SEQ ID NO: 95250

SEQ ID NO: 95607 - DNA, 601 bp, Human; identical to SEQ ID NO: 95251

SEQ ID NO: 95608 - DNA, 601 bp, Human; identical to SEQ ID NO: 95252

SEQ ID NO: 95609 - DNA, 601 bp, Human; identical to SEQ ID NO: 95253

SEQ ID NO: 95610 - DNA, 601 bp, Human; identical to SEQ ID NO: 95254

SEQ ID NO: 95611 - DNA, 601 bp, Human; identical to SEQ ID NO: 95255

SEQ ID NO: 95612 - DNA, 601 bp, Human; identical to SEQ ID NO: 95256

SEQ ID NO: 95613 - DNA, 601 bp, Human; identical to SEQ ID NO: 95257

SEQ ID NO: 95614 - DNA, 601 bp, Human; identical to SEQ ID NO: 95258

SEQ ID NO: 95615 - DNA, 601 bp, Human; identical to SEQ ID NO: 95259

SEQ ID NO: 95616 - DNA, 601 bp, Human; identical to SEQ ID NO: 95260

SEQ ID NO: 95617 - DNA, 601 bp, Human; identical to SEQ ID NO: 95261

SEQ ID NO: 95618 - DNA, 601 bp, Human; identical to SEQ ID NO: 95262

SEQ ID NO: 95619 - DNA, 601 bp, Human; identical to SEQ ID NO: 95263

SEQ ID NO: 95620 - DNA, 601 bp, Human; identical to SEQ ID NO: 95264

SEQ ID NO: 95621 - DNA, 601 bp, Human; identical to SEQ ID NO: 95265

SEQ ID NO: 95622 - DNA, 601 bp, Human; identical to SEQ ID NO: 95266

SEQ ID NO: 95623 - DNA, 601 bp, Human; identical to SEQ ID NO: 95267

SEQ ID NO: 95624 - DNA, 601 bp, Human; identical to SEQ ID NO: 95268

SEQ ID NO: 95625 - DNA, 601 bp, Human; identical to SEQ ID NO: 95269

SEQ ID NO: 95626 - DNA, 601 bp, Human; identical to SEQ ID NO: 95270

SEQ ID NO: 95627 - DNA, 601 bp, Human; identical to SEQ ID NO: 95271

SEQ ID NO: 95628 - DNA, 601 bp, Human; identical to SEQ ID NO: 95272

SEQ ID NO: 95629 - DNA, 601 bp, Human; identical to SEQ ID NO: 95273

SEQ ID NO: 95630 - DNA, 601 bp, Human; identical to SEQ ID NO: 95274

SEQ ID NO: 95631 - DNA, 601 bp, Human; identical to SEQ ID NO: 95275

SEQ ID NO: 95632 - DNA, 601 bp, Human; identical to SEQ ID NO: 95276

SEQ ID NO: 95633 - DNA, 601 bp, Human; identical to SEQ ID NO: 95277

SEQ ID NO: 95634 - DNA, 601 bp, Human; identical to SEQ ID NO: 95278

SEQ ID NO: 95635 - DNA, 601 bp, Human; identical to SEQ ID NO: 95279

SEQ ID NO: 95636 - DNA, 601 bp, Human; identical to SEQ ID NO: 95280

SEQ ID NO: 95637 - DNA, 601 bp, Human; identical to SEQ ID NO: 95281

SEQ ID NO: 95638 - DNA, 601 bp, Human; identical to SEQ ID NO: 95282

SEQ ID NO: 95639 - DNA, 601 bp, Human; identical to SEQ ID NO: 95283

SEQ ID NO: 95640 - DNA, 601 bp, Human; identical to SEQ ID NO: 95284

SEQ ID NO: 95641 - DNA, 601 bp, Human; identical to SEQ ID NO: 95285

SEQ ID NO: 95642 - DNA, 601 bp, Human; identical to SEQ ID NO: 95286

SEQ ID NO: 95643 - DNA, 601 bp, Human; identical to SEQ ID NO: 95287

SEQ ID NO: 95644 - DNA, 601 bp, Human; identical to SEQ ID NO: 95288

SEQ ID NO: 95645 - DNA, 601 bp, Human; identical to SEQ ID NO: 95289

SEQ ID NO: 95646 - DNA, 601 bp, Human; identical to SEQ ID NO: 95290

SEQ ID NO: 95647 - DNA, 601 bp, Human; identical to SEQ ID NO: 95291

SEQ ID NO: 95648 - DNA, 601 bp, Human; identical to SEQ ID NO: 95292

SEQ ID NO: 95649 - DNA, 601 bp, Human; identical to SEQ ID NO: 95293

SEQ ID NO: 95650 - DNA, 601 bp, Human; identical to SEQ ID NO: 95294

SEQ ID NO: 95651 - DNA, 601 bp, Human; identical to SEQ ID NO: 95295

SEQ ID NO: 95652 - DNA, 601 bp, Human; identical to SEQ ID NO: 95296

SEQ ID NO: 95653 - DNA, 601 bp, Human; identical to SEQ ID NO: 95297

SEQ ID NO: 95654 - DNA, 601 bp, Human; identical to SEQ ID NO: 95298

SEQ ID NO: 95655 - DNA, 601 bp, Human; identical to SEQ ID NO: 95299

SEQ ID NO: 95656 - DNA, 601 bp, Human; identical to SEQ ID NO: 95300

SEQ ID NO: 95657 - DNA, 601 bp, Human; identical to SEQ ID NO: 95301

SEQ ID NO: 95658 - DNA, 601 bp, Human; identical to SEQ ID NO: 95302

SEQ ID NO: 95659 - DNA, 601 bp, Human; identical to SEQ ID NO: 95303

SEQ ID NO: 95660 - DNA, 601 bp, Human; identical to SEQ ID NO: 95304

SEQ ID NO: 95661 - DNA, 601 bp, Human; identical to SEQ ID NO: 95305

SEQ ID NO: 95662 - DNA, 601 bp, Human; identical to SEQ ID NO: 95306

SEQ ID NO: 95663 - DNA, 601 bp, Human; identical to SEQ ID NO: 95307

SEQ ID NO: 95664 - DNA, 601 bp, Human; identical to SEQ ID NO: 95308

SEQ ID NO: 95665 - DNA, 601 bp, Human; identical to SEQ ID NO: 95309

SEQ ID NO: 95666 - DNA, 601 bp, Human; identical to SEQ ID NO: 95310

SEQ ID NO: 95667 - DNA, 601 bp, Human; identical to SEQ ID NO: 95311

SEQ ID NO: 95668 - DNA, 601 bp, Human; identical to SEQ ID NO: 95312

SEQ ID NO: 95669 - DNA, 601 bp, Human; identical to SEQ ID NO: 95313

SEQ ID NO: 95670 - DNA, 601 bp, Human; identical to SEQ ID NO: 95314

SEQ ID NO: 95671 - DNA, 601 bp, Human; identical to SEQ ID NO: 95315

SEQ ID NO: 95672 - DNA, 601 bp, Human; identical to SEQ ID NO: 95316

SEQ ID NO: 95673 - DNA, 601 bp, Human; identical to SEQ ID NO: 95317

SEQ ID NO: 95674 - DNA, 601 bp, Human; identical to SEQ ID NO: 95318

SEQ ID NO: 95675 - DNA, 601 bp, Human; identical to SEQ ID NO: 95319

SEQ ID NO: 95676 - DNA, 601 bp, Human; identical to SEQ ID NO: 95320

SEQ ID NO: 95677 - DNA, 601 bp, Human; identical to SEQ ID NO: 95321

SEQ ID NO: 95678 - DNA, 601 bp, Human; identical to SEQ ID NO: 95322

SEQ ID NO: 95679 - DNA, 601 bp, Human; identical to SEQ ID NO: 95323

SEQ ID NO: 95680 - DNA, 601 bp, Human; identical to SEQ ID NO: 95324

SEQ ID NO: 95681 - DNA, 601 bp, Human; identical to SEQ ID NO: 95325

SEQ ID NO: 95682 - DNA, 601 bp, Human; identical to SEQ ID NO: 95326

SEQ ID NO: 95683 - DNA, 601 bp, Human; identical to SEQ ID NO: 95327

SEQ ID NO: 95684 - DNA, 601 bp, Human; identical to SEQ ID NO: 95328

SEQ ID NO: 95685 - DNA, 601 bp, Human; identical to SEQ ID NO: 95329

SEQ ID NO: 95686 - DNA, 601 bp, Human; identical to SEQ ID NO: 95330

SEQ ID NO: 95687 - DNA, 601 bp, Human; identical to SEQ ID NO: 95331

SEQ ID NO: 95688 - DNA, 601 bp, Human; identical to SEQ ID NO: 95332

SEQ ID NO: 95689 - DNA, 601 bp, Human; identical to SEQ ID NO: 95333

SEQ ID NO: 95690 - DNA, 601 bp, Human; identical to SEQ ID NO: 95334

SEQ ID NO: 95691 - DNA, 601 bp, Human; identical to SEQ ID NO: 95335

SEQ ID NO: 95692 - DNA, 601 bp, Human; identical to SEQ ID NO: 95336

SEQ ID NO: 95693 - DNA, 601 bp, Human; identical to SEQ ID NO: 95337

SEQ ID NO: 95694 - DNA, 601 bp, Human; identical to SEQ ID NO: 95338

SEQ ID NO: 95695 - DNA, 601 bp, Human; identical to SEQ ID NO: 95339

SEQ ID NO: 95696 - DNA, 601 bp, Human; identical to SEQ ID NO: 95340

SEQ ID NO: 95697 - DNA, 601 bp, Human; identical to SEQ ID NO: 95341

SEQ ID NO: 95698 - DNA, 601 bp, Human; identical to SEQ ID NO: 95342

SEQ ID NO: 95699 - DNA, 601 bp, Human; identical to SEQ ID NO: 95343

SEQ ID NO: 95700 - DNA, 601 bp, Human; identical to SEQ ID NO: 95344

SEQ ID NO: 95701 - DNA, 601 bp, Human; identical to SEQ ID NO: 95345

SEQ ID NO: 95702 - DNA, 601 bp, Human; identical to SEQ ID NO: 95346

SEQ ID NO: 95703 - DNA, 601 bp, Human; identical to SEQ ID NO: 95347

SEQ ID NO: 95704 - DNA, 601 bp, Human; identical to SEQ ID NO: 95348

SEQ ID NO: 95705 - DNA, 601 bp, Human; identical to SEQ ID NO: 95349

SEQ ID NO: 95706 - DNA, 601 bp, Human; identical to SEQ ID NO: 95350

SEQ ID NO: 95707 - DNA, 601 bp, Human; identical to SEQ ID NO: 95351

SEQ ID NO: 95708 - DNA, 601 bp, Human; identical to SEQ ID NO: 95352

SEQ ID NO: 95709 - DNA, 601 bp, Human; identical to SEQ ID NO: 95353

SEQ ID NO: 95710 - DNA, 601 bp, Human; identical to SEQ ID NO: 95354

SEQ ID NO: 95711 - DNA, 601 bp, Human; identical to SEQ ID NO: 95355

SEQ ID NO: 95712 - DNA, 601 bp, Human; identical to SEQ ID NO: 95356

SEQ ID NO: 95713 - DNA, 601 bp, Human; identical to SEQ ID NO: 95357

SEQ ID NO: 95714 - DNA, 601 bp, Human; identical to SEQ ID NO: 95358

SEQ ID NO: 95715 - DNA, 601 bp, Human; identical to SEQ ID NO: 95359

SEQ ID NO: 95716 - DNA, 601 bp, Human; identical to SEQ ID NO: 95360

SEQ ID NO: 95717 - DNA, 601 bp, Human; identical to SEQ ID NO: 95361

SEQ ID NO: 95718 - DNA, 601 bp, Human; identical to SEQ ID NO: 95362

SEQ ID NO: 95719 - DNA, 601 bp, Human; identical to SEQ ID NO: 95363

SEQ ID NO: 95720 - DNA, 601 bp, Human; identical to SEQ ID NO: 95364

SEQ ID NO: 95721 - DNA, 601 bp, Human; identical to SEQ ID NO: 95365

SEQ ID NO: 95722 - DNA, 601 bp, Human; identical to SEQ ID NO: 95366

SEQ ID NO: 95723 - DNA, 601 bp, Human; identical to SEQ ID NO: 95189

SEQ ID NO: 95724 - DNA, 601 bp, Human; identical to SEQ ID NO: 95190

SEQ ID NO: 95725 - DNA, 601 bp, Human; identical to SEQ ID NO: 95191

SEQ ID NO: 95726 - DNA, 601 bp, Human; identical to SEQ ID NO: 95192

SEQ ID NO: 95727 - DNA, 601 bp, Human; identical to SEQ ID NO: 95193

SEQ ID NO: 95728 - DNA, 601 bp, Human; identical to SEQ ID NO: 95194

SEQ ID NO: 95729 - DNA, 601 bp, Human; identical to SEQ ID NO: 95195

SEQ ID NO: 95730 - DNA, 601 bp, Human; identical to SEQ ID NO: 95196

SEQ ID NO: 95731 - DNA, 601 bp, Human; identical to SEQ ID NO: 95197

SEQ ID NO: 95732 - DNA, 601 bp, Human; identical to SEQ ID NO: 95198

SEQ ID NO: 95733 - DNA, 601 bp, Human; identical to SEQ ID NO: 95199

SEQ ID NO: 95734 - DNA, 601 bp, Human; identical to SEQ ID NO: 95200

SEQ ID NO: 95735 - DNA, 601 bp, Human; identical to SEQ ID NO: 95201

SEQ ID NO: 95736 - DNA, 601 bp, Human; identical to SEQ ID NO: 95202

SEQ ID NO: 95737 - DNA, 601 bp, Human; identical to SEQ ID NO: 95203

SEQ ID NO: 95738 - DNA, 601 bp, Human; identical to SEQ ID NO: 95204

SEQ ID NO: 95739 - DNA, 601 bp, Human; identical to SEQ ID NO: 95205

SEQ ID NO: 95740 - DNA, 601 bp, Human; identical to SEQ ID NO: 95206

SEQ ID NO: 95741 - DNA, 601 bp, Human; identical to SEQ ID NO: 95207

SEQ ID NO: 95742 - DNA, 601 bp, Human; identical to SEQ ID NO: 95208

SEQ ID NO: 95743 - DNA, 601 bp, Human; identical to SEQ ID NO: 95209

SEQ ID NO: 95744 - DNA, 601 bp, Human; identical to SEQ ID NO: 95210

SEQ ID NO: 95745 - DNA, 601 bp, Human; identical to SEQ ID NO: 95211

SEQ ID NO: 95746 - DNA, 601 bp, Human; identical to SEQ ID NO: 95212

SEQ ID NO: 95747 - DNA, 601 bp, Human; identical to SEQ ID NO: 95213

SEQ ID NO: 95748 - DNA, 601 bp, Human; identical to SEQ ID NO: 95214

SEQ ID NO: 95749 - DNA, 601 bp, Human; identical to SEQ ID NO: 95215

SEQ ID NO: 95750 - DNA, 601 bp, Human; identical to SEQ ID NO: 95216

SEQ ID NO: 95751 - DNA, 601 bp, Human; identical to SEQ ID NO: 95217

SEQ ID NO: 95752 - DNA, 601 bp, Human; identical to SEQ ID NO: 95218

SEQ ID NO: 95753 - DNA, 601 bp, Human; identical to SEQ ID NO: 95219

SEQ ID NO: 95754 - DNA, 601 bp, Human; identical to SEQ ID NO: 95220

SEQ ID NO: 95755 - DNA, 601 bp, Human; identical to SEQ ID NO: 95221

SEQ ID NO: 95756 - DNA, 601 bp, Human; identical to SEQ ID NO: 95222

SEQ ID NO: 95757 - DNA, 601 bp, Human; identical to SEQ ID NO: 95223

SEQ ID NO: 95758 - DNA, 601 bp, Human; identical to SEQ ID NO: 95224

SEQ ID NO: 95759 - DNA, 601 bp, Human; identical to SEQ ID NO: 95225

SEQ ID NO: 95760 - DNA, 601 bp, Human; identical to SEQ ID NO: 95226

SEQ ID NO: 95761 - DNA, 601 bp, Human; identical to SEQ ID NO: 95227

SEQ ID NO: 95762 - DNA, 601 bp, Human; identical to SEQ ID NO: 95228

SEQ ID NO: 95763 - DNA, 601 bp, Human; identical to SEQ ID NO: 95229

SEQ ID NO: 95764 - DNA, 601 bp, Human; identical to SEQ ID NO: 95230

SEQ ID NO: 95765 - DNA, 601 bp, Human; identical to SEQ ID NO: 95231

SEQ ID NO: 95766 - DNA, 601 bp, Human; identical to SEQ ID NO: 95232

SEQ ID NO: 95767 - DNA, 601 bp, Human; identical to SEQ ID NO: 95233

SEQ ID NO: 95768 - DNA, 601 bp, Human; identical to SEQ ID NO: 95234

SEQ ID NO: 95769 - DNA, 601 bp, Human; identical to SEQ ID NO: 95235

SEQ ID NO: 95770 - DNA, 601 bp, Human; identical to SEQ ID NO: 95236

SEQ ID NO: 95771 - DNA, 601 bp, Human; identical to SEQ ID NO: 95237

SEQ ID NO: 95772 - DNA, 601 bp, Human; identical to SEQ ID NO: 95238

SEQ ID NO: 95773 - DNA, 601 bp, Human; identical to SEQ ID NO: 95239

SEQ ID NO: 95774 - DNA, 601 bp, Human; identical to SEQ ID NO: 95240

SEQ ID NO: 95775 - DNA, 601 bp, Human; identical to SEQ ID NO: 95241

SEQ ID NO: 95776 - DNA, 601 bp, Human; identical to SEQ ID NO: 95242

SEQ ID NO: 95777 - DNA, 601 bp, Human; identical to SEQ ID NO: 95243

SEQ ID NO: 95778 - DNA, 601 bp, Human; identical to SEQ ID NO: 95244

SEQ ID NO: 95779 - DNA, 601 bp, Human; identical to SEQ ID NO: 95245

SEQ ID NO: 95780 - DNA, 601 bp, Human; identical to SEQ ID NO: 95246

SEQ ID NO: 95781 - DNA, 601 bp, Human; identical to SEQ ID NO: 95247

SEQ ID NO: 95782 - DNA, 601 bp, Human; identical to SEQ ID NO: 95248

SEQ ID NO: 95783 - DNA, 601 bp, Human; identical to SEQ ID NO: 95249

SEQ ID NO: 95784 - DNA, 601 bp, Human; identical to SEQ ID NO: 95250

SEQ ID NO: 95785 - DNA, 601 bp, Human; identical to SEQ ID NO: 95251

SEQ ID NO: 95786 - DNA, 601 bp, Human; identical to SEQ ID NO: 95252

SEQ ID NO: 95787 - DNA, 601 bp, Human; identical to SEQ ID NO: 95253

SEQ ID NO: 95788 - DNA, 601 bp, Human; identical to SEQ ID NO: 95254

SEQ ID NO: 95789 - DNA, 601 bp, Human; identical to SEQ ID NO: 95255

SEQ ID NO: 95790 - DNA, 601 bp, Human; identical to SEQ ID NO: 95256

SEQ ID NO: 95791 - DNA, 601 bp, Human; identical to SEQ ID NO: 95257

SEQ ID NO: 95792 - DNA, 601 bp, Human; identical to SEQ ID NO: 95258

SEQ ID NO: 95793 - DNA, 601 bp, Human; identical to SEQ ID NO: 95259

SEQ ID NO: 95794 - DNA, 601 bp, Human; identical to SEQ ID NO: 95260

SEQ ID NO: 95795 - DNA, 601 bp, Human; identical to SEQ ID NO: 95261

SEQ ID NO: 95796 - DNA, 601 bp, Human; identical to SEQ ID NO: 95262

SEQ ID NO: 95797 - DNA, 601 bp, Human; identical to SEQ ID NO: 95263

SEQ ID NO: 95798 - DNA, 601 bp, Human; identical to SEQ ID NO: 95264

SEQ ID NO: 95799 - DNA, 601 bp, Human; identical to SEQ ID NO: 95265

SEQ ID NO: 95800 - DNA, 601 bp, Human; identical to SEQ ID NO: 95266

SEQ ID NO: 95801 - DNA, 601 bp, Human; identical to SEQ ID NO: 95267

SEQ ID NO: 95802 - DNA, 601 bp, Human; identical to SEQ ID NO: 95268

SEQ ID NO: 95803 - DNA, 601 bp, Human; identical to SEQ ID NO: 95269

SEQ ID NO: 95804 - DNA, 601 bp, Human; identical to SEQ ID NO: 95270

SEQ ID NO: 95805 - DNA, 601 bp, Human; identical to SEQ ID NO: 95271

SEQ ID NO: 95806 - DNA, 601 bp, Human; identical to SEQ ID NO: 95272

SEQ ID NO: 95807 - DNA, 601 bp, Human; identical to SEQ ID NO: 95273

SEQ ID NO: 95808 - DNA, 601 bp, Human; identical to SEQ ID NO: 95274

SEQ ID NO: 95809 - DNA, 601 bp, Human; identical to SEQ ID NO: 95275

SEQ ID NO: 95810 - DNA, 601 bp, Human; identical to SEQ ID NO: 95276

SEQ ID NO: 95811 - DNA, 601 bp, Human; identical to SEQ ID NO: 95277

SEQ ID NO: 95812 - DNA, 601 bp, Human; identical to SEQ ID NO: 95278

SEQ ID NO: 95813 - DNA, 601 bp, Human; identical to SEQ ID NO: 95279

SEQ ID NO: 95814 - DNA, 601 bp, Human; identical to SEQ ID NO: 95280

SEQ ID NO: 95815 - DNA, 601 bp, Human; identical to SEQ ID NO: 95281

SEQ ID NO: 95816 - DNA, 601 bp, Human; identical to SEQ ID NO: 95282

SEQ ID NO: 95817 - DNA, 601 bp, Human; identical to SEQ ID NO: 95283

SEQ ID NO: 95818 - DNA, 601 bp, Human; identical to SEQ ID NO: 95284

SEQ ID NO: 95819 - DNA, 601 bp, Human; identical to SEQ ID NO: 95285

SEQ ID NO: 95820 - DNA, 601 bp, Human; identical to SEQ ID NO: 95286

SEQ ID NO: 95821 - DNA, 601 bp, Human; identical to SEQ ID NO: 95287

SEQ ID NO: 95822 - DNA, 601 bp, Human; identical to SEQ ID NO: 95288

SEQ ID NO: 95823 - DNA, 601 bp, Human; identical to SEQ ID NO: 95289

SEQ ID NO: 95824 - DNA, 601 bp, Human; identical to SEQ ID NO: 95290

SEQ ID NO: 95825 - DNA, 601 bp, Human; identical to SEQ ID NO: 95291

SEQ ID NO: 95826 - DNA, 601 bp, Human; identical to SEQ ID NO: 95292

SEQ ID NO: 95827 - DNA, 601 bp, Human; identical to SEQ ID NO: 95293

SEQ ID NO: 95828 - DNA, 601 bp, Human; identical to SEQ ID NO: 95294

SEQ ID NO: 95829 - DNA, 601 bp, Human; identical to SEQ ID NO: 95295

SEQ ID NO: 95830 - DNA, 601 bp, Human; identical to SEQ ID NO: 95296

SEQ ID NO: 95831 - DNA, 601 bp, Human; identical to SEQ ID NO: 95297

SEQ ID NO: 95832 - DNA, 601 bp, Human; identical to SEQ ID NO: 95298

SEQ ID NO: 95833 - DNA, 601 bp, Human; identical to SEQ ID NO: 95299

SEQ ID NO: 95834 - DNA, 601 bp, Human; identical to SEQ ID NO: 95300

SEQ ID NO: 95835 - DNA, 601 bp, Human; identical to SEQ ID NO: 95301

SEQ ID NO: 95836 - DNA, 601 bp, Human; identical to SEQ ID NO: 95302

SEQ ID NO: 95837 - DNA, 601 bp, Human; identical to SEQ ID NO: 95303

SEQ ID NO: 95838 - DNA, 601 bp, Human; identical to SEQ ID NO: 95304

SEQ ID NO: 95839 - DNA, 601 bp, Human; identical to SEQ ID NO: 95305

SEQ ID NO: 95840 - DNA, 601 bp, Human; identical to SEQ ID NO: 95306

SEQ ID NO: 95841 - DNA, 601 bp, Human; identical to SEQ ID NO: 95307

SEQ ID NO: 95842 - DNA, 601 bp, Human; identical to SEQ ID NO: 95308

SEQ ID NO: 95843 - DNA, 601 bp, Human; identical to SEQ ID NO: 95309

SEQ ID NO: 95844 - DNA, 601 bp, Human; identical to SEQ ID NO: 95310

SEQ ID NO: 95845 - DNA, 601 bp, Human; identical to SEQ ID NO: 95311

SEQ ID NO: 95846 - DNA, 601 bp, Human; identical to SEQ ID NO: 95312

SEQ ID NO: 95847 - DNA, 601 bp, Human; identical to SEQ ID NO: 95313

SEQ ID NO: 95848 - DNA, 601 bp, Human; identical to SEQ ID NO: 95314

SEQ ID NO: 95849 - DNA, 601 bp, Human; identical to SEQ ID NO: 95315

SEQ ID NO: 95850 - DNA, 601 bp, Human; identical to SEQ ID NO: 95316

SEQ ID NO: 95851 - DNA, 601 bp, Human; identical to SEQ ID NO: 95317

SEQ ID NO: 95852 - DNA, 601 bp, Human; identical to SEQ ID NO: 95318

SEQ ID NO: 95853 - DNA, 601 bp, Human; identical to SEQ ID NO: 95319

SEQ ID NO: 95854 - DNA, 601 bp, Human; identical to SEQ ID NO: 95320

SEQ ID NO: 95855 - DNA, 601 bp, Human; identical to SEQ ID NO: 95321

SEQ ID NO: 95856 - DNA, 601 bp, Human; identical to SEQ ID NO: 95322

SEQ ID NO: 95857 - DNA, 601 bp, Human; identical to SEQ ID NO: 95323

SEQ ID NO: 95858 - DNA, 601 bp, Human; identical to SEQ ID NO: 95324

SEQ ID NO: 95859 - DNA, 601 bp, Human; identical to SEQ ID NO: 95325

SEQ ID NO: 95860 - DNA, 601 bp, Human; identical to SEQ ID NO: 95326

SEQ ID NO: 95861 - DNA, 601 bp, Human; identical to SEQ ID NO: 95327

SEQ ID NO: 95862 - DNA, 601 bp, Human; identical to SEQ ID NO: 95328

SEQ ID NO: 95863 - DNA, 601 bp, Human; identical to SEQ ID NO: 95329

SEQ ID NO: 95864 - DNA, 601 bp, Human; identical to SEQ ID NO: 95330

SEQ ID NO: 95865 - DNA, 601 bp, Human; identical to SEQ ID NO: 95331

SEQ ID NO: 95866 - DNA, 601 bp, Human; identical to SEQ ID NO: 95332

SEQ ID NO: 95867 - DNA, 601 bp, Human; identical to SEQ ID NO: 95333

SEQ ID NO: 95868 - DNA, 601 bp, Human; identical to SEQ ID NO: 95334

SEQ ID NO: 95869 - DNA, 601 bp, Human; identical to SEQ ID NO: 95335

SEQ ID NO: 95870 - DNA, 601 bp, Human; identical to SEQ ID NO: 95336

SEQ ID NO: 95871 - DNA, 601 bp, Human; identical to SEQ ID NO: 95337

SEQ ID NO: 95872 - DNA, 601 bp, Human; identical to SEQ ID NO: 95338

SEQ ID NO: 95873 - DNA, 601 bp, Human; identical to SEQ ID NO: 95339

SEQ ID NO: 95874 - DNA, 601 bp, Human; identical to SEQ ID NO: 95340

SEQ ID NO: 95875 - DNA, 601 bp, Human; identical to SEQ ID NO: 95341

SEQ ID NO: 95876 - DNA, 601 bp, Human; identical to SEQ ID NO: 95342

SEQ ID NO: 95877 - DNA, 601 bp, Human; identical to SEQ ID NO: 95343

SEQ ID NO: 95878 - DNA, 601 bp, Human; identical to SEQ ID NO: 95344

SEQ ID NO: 95879 - DNA, 601 bp, Human; identical to SEQ ID NO: 95345

SEQ ID NO: 95880 - DNA, 601 bp, Human; identical to SEQ ID NO: 95346

SEQ ID NO: 95881 - DNA, 601 bp, Human; identical to SEQ ID NO: 95347

SEQ ID NO: 95882 - DNA, 601 bp, Human; identical to SEQ ID NO: 95348

SEQ ID NO: 95883 - DNA, 601 bp, Human; identical to SEQ ID NO: 95349

SEQ ID NO: 95884 - DNA, 601 bp, Human; identical to SEQ ID NO: 95350

SEQ ID NO: 95885 - DNA, 601 bp, Human; identical to SEQ ID NO: 95351

SEQ ID NO: 95886 - DNA, 601 bp, Human; identical to SEQ ID NO: 95352

SEQ ID NO: 95887 - DNA, 601 bp, Human; identical to SEQ ID NO: 95353

SEQ ID NO: 95888 - DNA, 601 bp, Human; identical to SEQ ID NO: 95354

SEQ ID NO: 95889 - DNA, 601 bp, Human; identical to SEQ ID NO: 95355

SEQ ID NO: 95890 - DNA, 601 bp, Human; identical to SEQ ID NO: 95356

SEQ ID NO: 95891 - DNA, 601 bp, Human; identical to SEQ ID NO: 95357

SEQ ID NO: 95892 - DNA, 601 bp, Human; identical to SEQ ID NO: 95358

SEQ ID NO: 95893 - DNA, 601 bp, Human; identical to SEQ ID NO: 95359

SEQ ID NO: 95894 - DNA, 601 bp, Human; identical to SEQ ID NO: 95360

SEQ ID NO: 95895 - DNA, 601 bp, Human; identical to SEQ ID NO: 95361

SEQ ID NO: 95896 - DNA, 601 bp, Human; identical to SEQ ID NO: 95362

SEQ ID NO: 95897 - DNA, 601 bp, Human; identical to SEQ ID NO: 95363

SEQ ID NO: 95898 - DNA, 601 bp, Human; identical to SEQ ID NO: 95364

SEQ ID NO: 95899 - DNA, 601 bp, Human; identical to SEQ ID NO: 95365

SEQ ID NO: 95900 - DNA, 601 bp, Human; identical to SEQ ID NO: 95366

SEQ ID NO: 95901 - DNA, 601 bp, Human
tctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacrtgggcatttttcttacttttgtaattattggggggtgtggggaagagtggtcttgagggggtaataaacctccttcgggacacacttcggcatctgagtcactgggcctctgccccgctccccggcacgtcaggagagcaggccctgtccgctgccccacgccgggcccgccgtctgctggcctagagatacctgcttgggccactcagggacgtggggctctctgcactcacttgacatctttttctggggtgccctgtggggtctgtgggttagggatgagttggtcctgggcctgac

SEQ ID NO: 95902 - DNA, 601 bp, Human
tcagagcccccgggcagcacagccaatgcccgtccttcccctgcagaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcgccaggggtccccaatcctggagccccactgactttgagagctgtgttagagaaacactgctgccctctttttagcagwcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaa

SEQ ID NO: 95903 - DNA, 601 bp, Human; identical to SEQ ID NO: 95902

SEQ ID NO: 95904 - DNA, 601 bp, Human; identical to SEQ ID NO: 95902

SEQ ID NO: 95905 - DNA, 601 bp, Human; identical to SEQ ID NO: 95902

SEQ ID NO: 95906 - DNA, 601 bp, Human; identical to SEQ ID NO: 95902

SEQ ID NO: 95907 - DNA, 601 bp, Human; identical to SEQ ID NO: 95902

SEQ ID NO: 95908 - DNA, 601 bp, Human; identical to SEQ ID NO: 95902

SEQ ID NO: 95909 - DNA, 601 bp, Human; identical to SEQ ID NO: 95902

SEQ ID NO: 95910 - DNA, 601 bp, Human; identical to SEQ ID NO: 95902

SEQ ID NO: 95911 - DNA, 601 bp, Human; identical to SEQ ID NO: 95902

SEQ ID NO: 95912 - DNA, 601 bp, Human; identical to SEQ ID NO: 95902

SEQ ID NO: 95913 - DNA, 601 bp, Human; identical to SEQ ID NO: 95902

SEQ ID NO: 95914 - DNA, 601 bp, Human; identical to SEQ ID NO: 95902

SEQ ID NO: 95915 - DNA, 601 bp, Human; identical to SEQ ID NO: 95902

SEQ ID NO: 95916 - DNA, 601 bp, Human; identical to SEQ ID NO: 95902

SEQ ID NO: 95917 - DNA, 601 bp, Human; identical to SEQ ID NO: 95902

SEQ ID NO: 95918 - DNA, 601 bp, Human; identical to SEQ ID NO: 95902

SEQ ID NO: 95919 - DNA, 601 bp, Human; identical to SEQ ID NO: 95902

SEQ ID NO: 95920 - DNA, 601 bp, Human; identical to SEQ ID NO: 95902

SEQ ID NO: 95921 - DNA, 601 bp, Human; identical to SEQ ID NO: 95902

SEQ ID NO: 95922 - DNA, 601 bp, Human
gtgggtgtcagctgcacgtggtgatgggctcaggagcctgtggccccagttcctctcctgcctggagagcatcaggctgagctgggcatgaggagcaaaccagagttagcaaccaggaccgtggaagaactaggctcaggaggaagagaggctgagggcggtgcctgggggtcgggaggggagaggctgtcccaaccggaccctggaagatgcaagatccaaatgtggtcccctcctctgggaggtgaaagatcctccgggctgtgactttcttcctgtctctctttaaaaaaaaaaaaaraaagagagacagggtgtccctatgttgcccaggctggtctcaaactcctggacccaagcgatcctcctgtcttggcctctcaaaatactgagatttccctgtccctcctgtctcattcagatgcctgctcaaagccaccctgagggtcaaaggcagaaagggggctgggggcagggcttccggtacccccaccccatatctgtctcccaagtactggggacagggaggaccgaggggtcttgaagctgctgtcatggaaggaggaagtagctccgggaacatagagggcatgcaggggtg

SEQ ID NO: 95923 - DNA, 601 bp, Human; identical to SEQ ID NO: 95922

SEQ ID NO: 95924 - DNA, 601 bp, Human
ataaatacaaattttatgggaacacttatgtcttaaattgtatataaatcatatatatgtatgtgtgttttacataccctagtaggaaaggaaaaacaaatttaaggtctccatttaaaaatatcataaagcagaaatgcttcaaattactttttaagtttaagtaagcattagtgtaatattttaagtaagcattagtgtaatattttaagttcatcatggtctccatccttgaaaactttgtaatttttgctggataagatatcggccatcatgttacatgaccatagctatttatagmggtgtgagtaacaactgttaactagtggggcctttggtatagcagagaacagtttccacatgcaaaatttaagagaaatctctttttgctcccccaatatacagatctggcagcctctcagctcctaaatccacttctcagatcctgtatagaatcattgaccaaggcaattaccttaaagcaacattttaaatggacacatcgacagttaatgtggctgtcgatttgcatattttttttccttacttgatactatcggaaaatggtagcaataccttcagcagtgatctcagtcatggt

SEQ ID NO: 95925 - DNA, 601 bp, Human
taactccagaaggtcttccaaggcccttttaaacccccgcagagcaaaggcagaaacaaaagctctatttcataatcaagaattttcctgtaaaaagtcttttgaatcaaatgcaagttctacaaaacataatccacaagcaagcccaagatggtttagtcaactgacctcctgaatcacctgggagcccaaaccctgaacagaggtagagaaacagaagattaagacgctcgtagctatcttaataacttgtgcagagctaaacaagaagtttttatacatagctttctttaaggcaaaytaaaagcaacatgacacagaatatctaaggaataggaaaaatgctatttatatttagttagcaaattctgaactaaaattggtaaagagtaaacctgatatcctctcacagaaaagaaaacacacacacacacacacacacacacacaaacaagatttaaaggggctgggtttaaatgttggtaatgctggtcttgagcaagtcacataacattttagttacagttcctttttctgccaaactgagataataatgcctacttaattgaattgtgtcagttttaaataagtaaacacacat

SEQ ID NO: 95926 - DNA, 601 bp, Human
tagcctgtaccaaggcactgtacaaaggtataccttttataaaagactggaggaagacaattgtagctagggcacaaaaggtgagaattgcaaagataacatgaaactgtgtagtaacaaagtgtgaaaaaactttggatatcatcaaagaatgactgtgcttccttaaaagatgagttcatttgagttggcagtctaattttcatttgagaaatattattaataaatcattccagaaaacaaaaaaaaatgcataattgatgttcagataacatagatcctatgaactgttaaggcccgraagtggaaaatgaccatcacccaagaattagatggtatttctactttttaattttattactaatgtaattatttttatgggtaactccagaaggtcttccaaggcccttttaaacccccgcagagcaaaggcagaaacaaaagctctatttcataatcaagaattttcctgtaaaaagtcttttgaatcaaatgcaagttctacaaaacataatccacaagcaagcccaagatggtttagtcaactgacctcctgaatcacctgggagcccaaaccctgaacagaggtagagaaacagaa

SEQ ID NO: 95927 - DNA, 601 bp, Human
gctcagaaaatagcctgtaccaaggcactgtacaaaggtataccttttataaaagactggaggaagacaattgtagctagggcacaaaaggtgagaattgcaaagataacatgaaactgtgtagtaacaaagtgtgaaaaaactttggatatcatcaaagaatgactgtgcttccttaaaagatgagttcatttgagttggcagtctaattttcatttgagaaatattattaataaatcattccagaaaacaaaaaaaaatgcataattgatgttcagataacatagatcctatgaactgytaaggcccggaagtggaaaatgaccatcacccaagaattagatggtatttctactttttaattttattactaatgtaattatttttatgggtaactccagaaggtcttccaaggcccttttaaacccccgcagagcaaaggcagaaacaaaagctctatttcataatcaagaattttcctgtaaaaagtcttttgaatcaaatgcaagttctacaaaacataatccacaagcaagcccaagatggtttagtcaactgacctcctgaatcacctgggagcccaaaccctgaacagaggtag

SEQ ID NO: 95928 - DNA, 601 bp, Human
aaatggttgaaaaaaatatagcagatgagataaaataagactatttcaggctcagaaaatagcctgtaccaaggcactgtacaaaggtataccttttataaaagactggaggaagacaattgtagctagggcacaaaaggtgagaattgcaaagataacatgaaactgtgtagtaacaaagtgtgaaaaaactttggatatcatcaaagaatgactgtgcttccttaaaagatgagttcatttgagttggcagtctaattttcatttgagaaatattattaataaatcattccagaaaacaaaaaaaaatgcataattgatgttcagataacatagatcctatgaactgttaaggcccggaagtggaaaatgaccatcacccaagaattagatggtatttctactttttaattttattactaatgtaattatttttatgggtaactccagaaggtcttccaaggcccttttaaacccccgcagagcaaaggcagaaacaaaagctctatttcataatcaagaattttcctgtaaaaagtcttttgaatcaaatgcaagttctacaaaacataatccacaagcaagcccaagatggtttagt

SEQ ID NO: 95929 - DNA, 601 bp, Human
aagataaaggactgtttatagccctaaacctgtgtgctgtttgagtgtaatccagtctgggcctgattcaacctacctaaatgtaacatggtcctagtgtaggctccaataacaacctaattgaccaacctaacagtctcacacagtaagaagacatatccaatatgactctgtggtcaggcatgggtatgaatcctagctatatcacatacagttgtgtgaattctagcacattctttaaactctctcaacttcagcttcctattctctaaacagcaataatattagcctttattctcayttggtggccctgaagattaaatgaatatttatcaagcttaatacagtgcttgacatcttatgtcttcagaataaatatgttatcattgctgttataattatctttattaatttattttgccagaatcaaaggtgttattaccctaaaatcctttggagttcaactttgtcctatttctaatttatctattactctgtacctgaaacacaattctgtatttagcattatttcctttcttccactggatgaagtaagccagcttggaacctgcagtggaaattgatgtgagcaactaggtga

SEQ ID NO: 95930 - DNA, 601 bp, Human
aagtaaaactccatgcacttactactctatcacactctcttttcttaatgcttctttctcccagctctgcactatattttctctctgattttcagtgaactatactctcctggttttcacaatctgcttttttttttttttctattttcctaaagtgaacttgagcagtaaagaataacaagaagtttcagagtcagactaatcaggtttatgtgatacctgcctttcacagtttttgtgatatttcaaagagatagtcatacaaaagcttcatacttaataccctgtcaataaatgcaaygttccaagccatagcactttttagaactattttttcttgcatcatgttgacttcttaggctttcaaattgttctcaggttttcccatgacctatctcaaaaacaaactatttctaattaatgtctctaattaatgttaccaataatatgaaactaacctccagattcccatattataatagatattaaaaatgattacttccttgtctgcttttacaaacataagtatatttccagactactctgcttaatatgagcatatttggttttcatttcagtaacaacagacactgttcaattt

SEQ ID NO: 95931 - DNA, 601 bp, Human
aataaaaactacaagaaaaagcttcttaacggaacctaacaagggctgacactacacagctatattttctgctcattgtcactgcaaattttgtatcatggatgatttgaacaatttaaaaaacataaacttaatttgccaaatagcatgatcttgtaaaatttttaaaaattcctctggccatattatttttaattaaccaagttcatgacccttcttttgaggccccatcctccccagaccaagagtggttgagtagtggagatagtgcctgaaccccaatttctgacttaagtaaaastccatgcacttactactctatcacactctcttttcttaatgcttctttctcccagctctgcactatattttctctctgattttcagtgaactatactctcctggttttcacaatctgcttttttttttttttctattttcctaaagtgaacttgagcagtaaagaataacaagaagtttcagagtcagactaatcaggtttatgtgatacctgcctttcacagtttttgtgatatttcaaagagatagtcatacaaaagcttcatacttaataccctgtcaataaatgcaatgttccaag

SEQ ID NO: 95932 - DNA, 601 bp, Human
ggggagaaaaatagttcctattacaaataataataaaaactacaagaaaaagcttcttaacggaacctaacaagggctgacactacacagctatattttctgctcattgtcactgcaaattttgtatcatggatgatttgaacaatttaaaaaacataaacttaatttgccaaatagcatgatcttgtaaaatttttaaaaattcctctggccatattatttttaattaaccaagttcatgacccttcttttgaggccccatcctccccagaccaagagtggttgagtagtggagatagtrcctgaaccccaatttctgacttaagtaaaactccatgcacttactactctatcacactctcttttcttaatgcttctttctcccagctctgcactatattttctctctgattttcagtgaactatactctcctggttttcacaatctgcttttttttttttttctattttcctaaagtgaacttgagcagtaaagaataacaagaagtttcagagtcagactaatcaggtttatgtgatacctgcctttcacagtttttgtgatatttcaaagagatagtcatacaaaagcttcatactt

SEQ ID NO: 95933 - DNA, 601 bp, Human
ttcccctagtcaataatatataggttaaatcagaataaccatgggcaaaaataatagctccagcagtgaatgtcagagaagtgccacttcatatctcttatttttgtcttgacattatattaaatgtcttcctcaaacagaaaattcccctaatcacatgataattttattttcaaaggcaacagacaattttccaaggaaagtttgctaaatatgtattttgaacgtctgtataaatggaaactgaatctctcacatccacgagctcactaatgccctagaccatattaaaactaagttkgaaatactaagagtttttccttcttttgtttttctcaacacttcagtaacctgtgtcagggaggggagaatgatgcagcaaatgcgtagcaaagataaaactggtttgtcacaatgagttccagcttcatgctgtctaaatgaaaccaagtttcccctataaagaacaggttgctccatttaaattatctttgttcttataggtcaaaatatcatgtctttaacttgtttgggtgaaaaccacatgccctagcttctggcacagataacaaattagaaaatatctaaaccacatatattt

SEQ ID NO: 95934 - DNA, 601 bp, Human
atttctgcagatttaaattcacaaacttggcattttactatactgtagtaactttcagattttacagtacgctttttcccctagtcaataatatataggttaaatcagaataaccatgggcaaaaataatagctccagcagtgaatgtcagagaagtgccacttcatatctcttatttttgtcttgacattatattaaatgtcttcctcaaacagaaaattcccctaatcacatgataattttattttcaaaggcaacagacaattttccaaggaaagtttgctaaatatgtattttgaaygtctgtataaatggaaactgaatctctcacatccacgagctcactaatgccctagaccatattaaaactaagtttgaaatactaagagtttttccttcttttgtttttctcaacacttcagtaacctgtgtcagggaggggagaatgatgcagcaaatgcgtagcaaagataaaactggtttgtcacaatgagttccagcttcatgctgtctaaatgaaaccaagtttcccctataaagaacaggttgctccatttaaattatctttgttcttataggtcaaaatatcatgtctttaact

SEQ ID NO: 95935 - DNA, 601 bp, Human
atttcagatggaggtaacttgcctttttctaaatgcaatgcctaatatttctgcagatttaaattcacaaacttggcattttactatactgtagtaactttcagattttacagtacgctttttcccctagtcaataatatataggttaaatcagaataaccatgggcaaaaataatagctccagcagtgaatgtcagagaagtgccacttcatatctcttatttttgtcttgacattatattaaatgtcttcctcaaacagaaaattcccctaatcacatgataattttattttcaaaggyaacagacaattttccaaggaaagtttgctaaatatgtattttgaacgtctgtataaatggaaactgaatctctcacatccacgagctcactaatgccctagaccatattaaaactaagtttgaaatactaagagtttttccttcttttgtttttctcaacacttcagtaacctgtgtcagggaggggagaatgatgcagcaaatgcgtagcaaagataaaactggtttgtcacaatgagttccagcttcatgctgtctaaatgaaaccaagtttcccctataaagaacaggttgctccat

SEQ ID NO: 95936 - DNA, 601 bp, Human
catttttgtgtccacattgtcaggcattcaatttggtacgtaataggtattaaaatattgaataaaaccaaacctctggcatgacatactgcttcataaatctacatctaggatgataattaataccatagaatctaaaattttgttatatttcagatggaggtaacttgcctttttctaaatgcaatgcctaatatttctgcagatttaaattcacaaacttggcattttactatactgtagtaactttcagattttacagtacgctttttcccctagtcaataatatataggttaaatmagaataaccatgggcaaaaataatagctccagcagtgaatgtcagagaagtgccacttcatatctcttatttttgtcttgacattatattaaatgtcttcctcaaacagaaaattcccctaatcacatgataattttattttcaaaggcaacagacaattttccaaggaaagtttgctaaatatgtattttgaacgtctgtataaatggaaactgaatctctcacatccacgagctcactaatgccctagaccatattaaaactaagtttgaaatactaagagtttttccttcttttgtt

SEQ ID NO: 95937 - DNA, 601 bp, Human
gtgcctgccaccacgcccagctgattttttgtatttttagtacaggcagggtttcaccacattggccaggctggtcttgaactcctgacctcaggtgatccacccaccttggcctccaaattgctgggattataggcatgagccaccgagcctggcccacaaaatgtatttcttaaaaaatgtcttgaaaatcaaaattacttcttgagccatgagctgcaaaaatgatcttctgttaggcacgaaaacaacattaatctttttgtatatcaccatcagagctcttgggtgaccaggtgcrttgtcaataagcagaaatactttggaagaattttttttttgagtagtaaatctcaacagtgggcttaaaatattcagtaaactatgttgtaaacagatgtgctgtcatgcaggctttattatctcattgatagagcacaggcaaagtaaatttattgtaattctttagagccctggaattgtcataatggtaaaccagcattggcttcaacttgaagtcaccagctgcattattccctaacaagagtcagcctaaactttgaagctttggagccaggcattgacttctcctatctagctc

SEQ ID NO: 95938 - DNA, 601 bp, Human
cactgatgtcttgagcccctcaaagtcatcatgagggttggaatcaactttttacataatggtgatattttgacctcctgccatgaatcaaaaatattttttattgttcaattccccatgtaccctagaacttaaagtataataataacaataaaaataaaaaaatttgtaatgtaaaaattatattttttaatggcatctagaatggtgaattcttgagaaagttgtcaatatagtttgcttggatccataagaggtatttctccctatgtcacctatagccttataaaatgtttttttwaattttttattattttattttattttattttattttattttttgagacagagttttgctcttgttccccaggctggagtgcagtggcacgatctcggctcactgcagcctccaccacccgggttcaagtaattctcctgcctcagcctcccaagtaactgggattacaggtgcctgccaccacgcccagctgattttttgtatttttagtacaggcagggtttcaccacattggccaggctggtcttgaactcctgacctcaggtgatccacccaccttggcctccaaattgctgggatt

SEQ ID NO: 95939 - DNA, 601 bp, Human
catcgatggactccacatttcatgaaagatgtctctgtagtatgtgacattcactgtttgataggattttacccataggagaatttcttttgaaatcagagttaatcctcttaaacccagccattgctttatcttctactctatgttatattctaaatcctttgtagtcatttcaacaaagttcacagcatctccattaagagtagagtagcttccatctcaagaaaccactctctttgctcattcatagaaagcacctcctaggccaggcatggtggctcatgcctgtaatcccagcacrttgggaggccaaggtgggtggatcccttgagaccaggagttcaagaccaccttggccaacatggtgaaaccccgtctctacaaaaacatacaaaaattagcctggcagtgtgatgcacacctataatcccactactcagtgggtgaggcacgagaatcacttgaacccaggaggcagaggttgcagtgagccaagactgtgccagtgcatgccgaactagacactggctcaaaagaaaaaaaaacaacaacaaaaaagtcactcttcatccattcaagtttaatcatgagattacagcat

SEQ ID NO: 95940 - DNA, 601 bp, Human
agataaaatactatgtctcaaagcacctgggtattgagagctcacgtccctcaaaaacagagacccataccacgatagtatagcacatcattctagccagaccaacaagacacttcaaatcctgagggactgggcagaaactgagcagtgaaatctggtctacttaattcaagaggtagccaaaattttccggaaactgtcagaactattatttctaatataactctcagtcactatgaacaaaggccctagagaattctgctgacttattgccttaatctagtcattactgctaccctamgtactttctgctcacattttcagaggcttggtctatggaccctgtcatgcttttacagcaactcttgacaagaccactggcctgaccactagttctcatagtatttagaacaactctgccaacagatttggttttactgtagcaactgattcttctttgtaagccagaagaaactcgtttaatgattacctttctgacagttggtatttttttttatttcttcatgaactggaaatggtctctatacatacaaagtaagctcaaagtagcgtatgtggggatggaaatcagcaatagagg

SEQ ID NO: 95941 - DNA, 601 bp, Human
ctgattggagaagcaaaatgaccttctcaccaatccaaatcccctctattgacataaaaagaatcttatatataaaattgaaagataactaagcttagagtttctcatagttgaggatttcaatcccatctcctttgaagctaccactagcatctatactcatctttatgttcttgttaactgtggtgtagtttatcatctctgataggaaaattttgggggtgtttatggagtcaaaattatggtgagaggtgctactgggtactaattattttgcaatctttagggaagatcgttgcarcaaatttttccaccctgaatgccaataaagtgtgtctccttcagcttggttcactgaacccaagatcaccatatttattaatttagtttaagaaatcaaatacttgtttctaaaatgaattaacctggaatttttaggatctagggatgttgttaaaaacttaattctttgctctttcttctgtgttcctgtcctttaatttagaaacattcttcaaatgttaacataagttctcctcctttatgtcagtccctgaccaaccaaatccatccattctcctagcttcttagattttcccaa

SEQ ID NO: 95942 - DNA, 601 bp, Human
caaataactgattggagaagcaaaatgaccttctcaccaatccaaatcccctctattgacataaaaagaatcttatatataaaattgaaagataactaagcttagagtttctcatagttgaggatttcaatcccatctcctttgaagctaccactagcatctatactcatctttatgttcttgttaactgtggtgtagtttatcatctctgataggaaaattttgggggtgtttatggagtcaaaattatggtgagaggtgctactgggtactaattattttgcaatctttagggaagatygttgcaacaaatttttccaccctgaatgccaataaagtgtgtctccttcagcttggttcactgaacccaagatcaccatatttattaatttagtttaagaaatcaaatacttgtttctaaaatgaattaacctggaatttttaggatctagggatgttgttaaaaacttaattctttgctctttcttctgtgttcctgtcctttaatttagaaacattcttcaaatgttaacataagttctcctcctttatgtcagtccctgaccaaccaaatccatccattctcctagcttcttagatt

SEQ ID NO: 95943 - DNA, 601 bp, Human
gactctcaagtaaaagaaatgtaatccaccttgaggtttgctatttagcttgtgtaaaactctatcgggcaattttgcaaagcactctctttcactttacccatcagaactgcttccacctgtgcctctcctcaaattatgctgtcactttgcaactcattagttagctcaaggacacagaaaataagtcatcacctttcactgatttttctcaagagggaagtatgtcattccatttagtttgtgaatctttttgccctgtatttccctgaggttattgtctttttttttccctttctaytatagaattataagtagcaaattgaggcaaacaaataactgattggagaagcaaaatgaccttctcaccaatccaaatcccctctattgacataaaaagaatcttatatataaaattgaaagataactaagcttagagtttctcatagttgaggatttcaatcccatctcctttgaagctaccactagcatctatactcatctttatgttcttgttaactgtggtgtagtttatcatctctgataggaaaattttgggggtgtttatggagtcaaaattatggtgagaggtgctactggg

SEQ ID NO: 95944 - DNA, 601 bp, Human
atctttttaaatgaaagttatagtgcatatgcctggctctctggcctccccttccaactccttaacctcttctgcttctgccaccactgggacagcaaaccaatccttcctctttttcctcctcctcagtctactcaatgtgaagatgatgaaattgaaggtctttatgatgatccagttccactaaatggatactaaatatattttatcttctttatgattttcttaaaaaacattttcctttccctagcttacttcattgtaattatctctctctctctatatatatatacagacacasacacacacacacacacacacacaggcacacgcacacacatataacatacaaaatatgtgttaatcaacaatgtttttggtaaagcctctggtcaacagtaggctattaataaagttttgggaggagtcaaagttatatgtgaattttcgactggtaagtcggtgtccttacccttgtgttgttcaagagtcaaccgcatatgtgagttatgaaactttcagagtctgtattttactaaaatgaatttttaagaaaaatattttaaaaattatgatgactcatagtatgtttttaaacact

SEQ ID NO: 95945 - DNA, 601 bp, Human
tacgtgagaatctttttaaatgaaagttatagtgcatatgcctggctctctggcctccccttccaactccttaacctcttctgcttctgccaccactgggacagcaaaccaatccttcctctttttcctcctcctcagtctactcaatgtgaagatgatgaaattgaaggtctttatgatgatccagttccactaaatggatactaaatatattttatcttctttatgattttcttaaaaaacattttcctttccctagcttacttcattgtaattatctctctctctctatatatatatacagacacacacacacacacacacacacacacaggcacacgcacacacatataacatacaaaatatgtgttaatcaacaatgtttttggtaaagcctctggtcaacagtaggctattaataaagttttgggaggagtcaaagttatatgtgaattttcgactggtaagtcggtgtccttacccttgtgttgttcaagagtcaaccgcatatgtgagttatgaaactttcagagtctgtattttactaaaatgaatttttaagaaaaatattttaaaaattatgatgactcatagtatgttt

SEQ ID NO: 95946 - DNA, 601 bp, Human
ggtgttggttatgtggatatcaactccattactccttagtaaatgatatataaagacagttgactcttgaacaacatgggttttaactgtgtagttccacttacgtgagaatctttttaaatgaaagttatagtgcatatgcctggctctctggcctccccttccaactccttaacctcttctgcttctgccaccactgggacagcaaaccaatccttcctctttttcctcctcctcagtctactcaatgtgaagatgatgaaattgaaggtctttatgatgatccagttccactaaatgratactaaatatattttatcttctttatgattttcttaaaaaacattttcctttccctagcttacttcattgtaattatctctctctctctatatatatatacagacacacacacacacacacacacacacacaggcacacgcacacacatataacatacaaaatatgtgttaatcaacaatgtttttggtaaagcctctggtcaacagtaggctattaataaagttttgggaggagtcaaagttatatgtgaattttcgactggtaagtcggtgtccttacccttgtgttgttcaagagt

SEQ ID NO: 95947 - DNA, 601 bp, Human
tttccacctcagtaaaacctccttccgttaaattgaatattgaataatttctgagagcttaagctagcaaactaaactaaagtggacaaaattaactgcctgaagttgtcaccttttaaagatgggcaatcttcatctaaaagcaggaagaatagaagtggaaacctaagttttgcctgaatgttaacaatagcaatattctaataaagccagcaagtcaaattaaagatgatgtccattggataaaagtgtaccaaggatcctagaaggaggagcctcaacaagcaaaaactcagttgcyctcaccagtgcccaggacagcaaggtgcagaacctagtgacaatggagattctagtcatggagtgttctgacagaagcaggaaaatagggaccttttttgtccactgctattggtccagctccaagtaaaatgcttggcaatgaggacatgacattcaatcaatattagttgaatgcctcactctacatgtcaatttttacattgctgcccatacagtctcaaaaaggggttgctatacggtgaggattactatctcagagacaaaactctgagaagtccttaggattctattcattttc

SEQ ID NO: 95948 - DNA, 601 bp, Human
gcccaggtgatgttgacactgctggtctggggactacacactgacaaactctgatctgggagaataaaacttattcggaattttctcaaagttgttatgtccatatagctcacatgcattcatacattttgacccaaatcaaaaaacaggaaagaatgcctagtatacccatgctcttcacagagttttacaaatagaatttttttttcgtttttggaggtaatacaatatagataaatggagatagattatcttttaatccttcttttctcacacactgaggcagagttaggctttccayctcagtaaaacctccttccgttaaattgaatattgaataatttctgagagcttaagctagcaaactaaactaaagtggacaaaattaactgcctgaagttgtcaccttttaaagatgggcaatcttcatctaaaagcaggaagaatagaagtggaaacctaagttttgcctgaatgttaacaatagcaatattctaataaagccagcaagtcaaattaaagatgatgtccattggataaaagtgtaccaaggatcctagaaggaggagcctcaacaagcaaaaactcagttgctctcacc

SEQ ID NO: 95949 - DNA, 601 bp, Human
gtgtcagaatgatctaaaaggtttgttagaacacagatcactaggccatactctcctcttacagtttatgatcccaaaagtctgagatgtatcccagtaatgtccctttccaataagtgcccaggtgatgttgacactgctggtctggggactacacactgacaaactctgatctgggagaataaaacttattcggaattttctcaaagttgttatgtccatatagctcacatgcattcatacattttgacccaaatcaaaaaacaggaaagaatgcctagtatacccatgctcttcacaragttttacaaatagaatttttttttcgtttttggaggtaatacaatatagataaatggagatagattatcttttaatccttcttttctcacacactgaggcagagttaggctttccacctcagtaaaacctccttccgttaaattgaatattgaataatttctgagagcttaagctagcaaactaaactaaagtggacaaaattaactgcctgaagttgtcaccttttaaagatgggcaatcttcatctaaaagcaggaagaatagaagtggaaacctaagttttgcctgaatgttaaca

SEQ ID NO: 95950 - DNA, 601 bp, Human
cagaaccctgcaggtccagagaaatagctgattatggggaaaatttcatgagtttcagtgtgcacatgttgggctcttgacctccacacacttttgctctcttccaggcaaatagtttctctctttgatttcttttcctccatctccattcttcagatttccattgcccatgaaaagaatcttcttgtgcatgatcacaaatttatcatgaaaagaatcctctgttattgtgagttttaagccactatactacatgattgatttggatctttatccctaattaattggaattagtagggartttgtttttaaagtctatatgtagttaactagggttgcggctttaaaacttcaacgtgtgtcagaatgatctaaaaggtttgttagaacacagatcactaggccatactctcctcttacagtttatgatcccaaaagtctgagatgtatcccagtaatgtccctttccaataagtgcccaggtgatgttgacactgctggtctggggactacacactgacaaactctgatctgggagaataaaacttattcggaattttctcaaagttgttatgtccatatagctcacatgcattcatac

SEQ ID NO: 95951 - DNA, 601 bp, Human
gagtttaaattagaacaggagttctaatttaaaaaataactgaagtttaaatgagaagaaaaaggaaaaggtgaatacaagaaatgaggactccaaagtttagagactgtgcatacagataaaaaaacagaaccctgcaggtccagagaaatagctgattatggggaaaatttcatgagtttcagtgtgcacatgttgggctcttgacctccacacacttttgctctcttccaggcaaatagtttctctctttgatttcttttcctccatctccattcttcagatttccattgcccatgaraagaatcttcttgtgcatgatcacaaatttatcatgaaaagaatcctctgttattgtgagttttaagccactatactacatgattgatttggatctttatccctaattaattggaattagtagggaatttgtttttaaagtctatatgtagttaactagggttgcggctttaaaacttcaacgtgtgtcagaatgatctaaaaggtttgttagaacacagatcactaggccatactctcctcttacagtttatgatcccaaaagtctgagatgtatcccagtaatgtccctttccaataa

SEQ ID NO: 95952 - DNA, 601 bp, Human
ttgtaatttggttagagttcagcaggtatggcctgcctctgctccacagttgtcacatgtggtggctctactggggactagaggatccattatcaagatgactcattcacattgctggaaagttggtgctggctgttggctggaagcttggctgggtttgcaggtcaaggtcttggtctctttcattatgggcctgcctccaggctgctttaattttttcacagcatagtttcaaaagcaggtatcccaaaccagcaacctggatatgtctggtatttttatgatctaaccttggaagtcrttttcactgtatgttctttgttgaagctgttatacaagtctgtttgtgtttaacgggaggaaaagtagacctcacctctcaagagaagaagagtcaagatcacagtataagaagaacacatgagatgggaaatcttgctgcagccacttttgaaaaatacaatctgtcacatacagacatccatatatgaaataacaggagtttaaattagaacaggagttctaatttaaaaaataactgaagtttaaatgagaagaaaaaggaaaaggtgaatacaagaaatgaggactccaaagttta

SEQ ID NO: 95953 - DNA, 601 bp, Human
gtaagagagagttatagtaatcagatacacactggtatattagttttctactgcaccataacatagtaccacaaatttaacacaaatttatcttacaattctgtacttggaagtccaacatgggtctcaaggagctaaaatcaaagtgtcttcagggctacattcctttctggggcctctagagagaatccatctccttgtactttctaccttctacaggttgccacataacttggctcatagcttcttcctctatcttcaaagccagtgctggctgattgcatctcccgctggccaccarcagaaaaagttctccaattttgaggacttccgtgattttattgggcccacccagataattcagggtcctctctcccgctcgaggttcttaataaaaccacatctgcaaattctcttttccaggtaaggtaacatatttacagattctggggattaggacatgaatattttgggggacaattattctgtataccacaaccaatattctcactactcttcatcagtagacattgtgtgagcactctcttatgcacagtttgtttaggcctgctcagtgaaattaagtattgctcaaaatcca

SEQ ID NO: 95954 - DNA, 601 bp, Human
gatgttggttcactgcaacctctgtctcccgggtcctagtgattctcctgcctcagcctccaagtagctgggatgacaggtgcccgccaacacacccggctaatttttgtatttttagtagagatgggtttcgccatgttggccaggctggtctcaaactcctgacctcaggtgatccgcccatctcggcctcccaaagtgctgtgattacaagaatgagccactgcactgggcccaggaaaaataaatttgccattctcctatgctaattttatatgagccctctaaaaatttgtcttcyagtgagtaagagagagttatagtaatcagatacacactggtatattagttttctactgcaccataacatagtaccacaaatttaacacaaatttatcttacaattctgtacttggaagtccaacatgggtctcaaggagctaaaatcaaagtgtcttcagggctacattcctttctggggcctctagagagaatccatctccttgtactttctaccttctacaggttgccacataacttggctcatagcttcttcctctatcttcaaagccagtgctggctgattgcatctcccgctggc

SEQ ID NO: 95955 - DNA, 601 bp, Human
agggggccgggcgcaatggctcacacctgtaatcccagcactttgggaggctgaggtgggtgtatcgcctgagaggtcacaggagttcgagaccagcctggccaacatggtgaaacccggtctctactaaaaatacagaaaaaaaaaagttatctggggtggggggaggggggagggatagcattaggagatatacctaatgctaaatgatgagttaatgggtgcagcacaccaacatggcacatgtatacatatgtaacaaacctgcactttgtgcacatgtaccctaaaatttaaagtktaataataataaaattttaaaaaaaggaaataagaacagcaatccaaaaaaaaaaattatctgggcatggtggtggcgggcgcctgtaatcccagctactcgggaggctgagtaaggagaatcacttgtgttaaatcttaacaggagagatttaggagaggacatcttttaagtgcagtggctgttcacatgcctgatcatcatgtatcacagctttgaactcctggcctcaagggatccttccacgtcaggctcccaaatagctgggactacaggcacgcaccactgtgcgtcaagatg

SEQ ID NO: 95956 - DNA, 601 bp, Human
atctgccattttcaagttcgaaaatagaagagggggccgggcgcaatggctcacacctgtaatcccagcactttgggaggctgaggtgggtgtatcgcctgagaggtcacaggagttcgagaccagcctggccaacatggtgaaacccggtctctactaaaaatacagaaaaaaaaaagttatctggggtggggggaggggggagggatagcattaggagatatacctaatgctaaatgatgagttaatgggtgcagcacaccaacatggcacatgtatacatatgtaacaaacctgcackttgtgcacatgtaccctaaaatttaaagtgtaataataataaaattttaaaaaaaggaaataagaacagcaatccaaaaaaaaaaattatctgggcatggtggtggcgggcgcctgtaatcccagctactcgggaggctgagtaaggagaatcacttgtgttaaatcttaacaggagagatttaggagaggacatcttttaagtgcagtggctgttcacatgcctgatcatcatgtatcacagctttgaactcctggcctcaagggatccttccacgtcaggctcccaaatagctgggac

SEQ ID NO: 95957 - DNA, 601 bp, Human
ctttaaattctaaatctgataaatgcaaatgcgaatacttttggaataaccaagagaactgaattgagtagaacaaaaattacgctatattcacaagatatgagagggcaaaaaagaacaatgtaacagttgcccacactgtagtctgcttaagttagagggacattataatctttactattatgaataaataaaaatgaaataatttttatgtattatccattttatgtatgtatgattcatgcatacacctatgtagatttataattctttagcgctcccataatgtttgatcaacatragataaaagaaataaattcatatttatgatgtcctattatgtataagacagtgctggtactttcatatatatagtatatgaactgtcattgtaatcgttctatcatagatcaaaaaagctgcatttcagaaagaaaacatggataagtcacattgtgagtacaggattttagatctatgattgtctgactcttcatacaattttttcaccaaatattcttgatacacagagctgatatttagtcagtaagcacaagcacagaatcaaggctggcattccatctaattagtttggtggaga

SEQ ID NO: 95958 - DNA, 601 bp, Human
atgtctaatgatgcctcagtaaatgccagggtattaaaaatgttagagaaaatagagataaaaatgaatataccaaagaacaacatggctcagccatagtaatgcaccattctcactgtgaatttctttcttcccttaaaacaggtcccagcttcaaatcaatgcagcctctattgcttcctgatgcttgataacatcacttatgttgcccaggaagagctttgagttactgatgactctcattccatgtcgctatgtgttcattcactctgcaatgatttactgaatgccttctatgtaycaagcactctgccaggtgcttgggtacaaaaggtaagcaatttttttcatagtcgctgtctttactgggccaagagtaagtgacagagatatctattaaataatcatataaatgaacaattgtatctgtgacaaatgctacaaatgagacatatccatgctatgagagcctataatgtaccttcattttaaacagcgacagttggactatgagtagaagttaatgcaagaccagacaccaaatgcctcctctttttcttttaagtatggggactctctggaaacaaagttaaatgaatgt

SEQ ID NO: 95959 - DNA, 601 bp, Human
caaaggaatgaatcactgagcaaaaatatgatcatttctgtattgtttatactcatgaaaaaaaaatggaagcaggctgggctcggtggctcacacctgtaatctcagcactttgggaagccgaggcaggcagatcacttgaggtcaggaggtcatgaccagcctggccaacatggtgaaaccccgtctctactaaaaatacaaaaattagcagggcatggtggtgtgcgcctgtaatcccagctacttgagagtctgaggcaggagaatcacttgaacccaggaggcggaggttggagtragccgaggttgtgacactgcactccagtctgggtgacagagggagactccatctcaaaaaaacaaaaacaaaaagaatggaagcagtattcaacaaaaaaggatcagctaagtaaacaatataatgaaatacaatatatccatgcatatatatgtggagtaaaacttatatttactgataggaaaaaattcaagaaatttttattagagaactcatcataaaacattagtcagcataaccccatttttgtaaaaatatataattataacatacatgtgaaaagaaattagaggagtataa

SEQ ID NO: 95960 - DNA, 601 bp, Human
aataattgacataacacatcagatgtgtaagatgattcatatgattcaagacggtttagtgatggcagccaacaacaaataaagatgtttttgggccaggcgtggtggctcatgcctgtaactccagcattttgggaggcctagtgttcgagaccagcctgggcaatatggcgaaaccctctctacaaaaaaaaaaaaaaaatattagccaagtgtggttgtatagacttataacccagctactcaggagactgaggcaggagaattgcttgaacctgggaggcggaggttacagtgagcygagattgtgccactgtactctagcctgggtaacaaaacaagactgtctcaaaaacaaaaacaaaagctttttaataataaaagattgcattcctgaagaaattaatatttgtaaaatttataaccatagtttaattaacttttatgcctattaagcctcctattttgtttttgatggttagcatcactgagtaaaattttcaagtttaagtttcagtggcatgggcagagactggcctcattatctctgtgaaagaggaagccaagccaatgatcattattggaaaatcaatcctttcaa

SEQ ID NO: 95961 - DNA, 601 bp, Human
atatatttgtttacaaaataagattttaatttgagaggtaagctgtcatcattgtgactcttgtaacaaagtagccaggtggtatgttgccttctatcctcattttattctaaatgatacattgtcaaaataaatattttaataattatttaataattattatttccatcaaataattatttatatataaatatatatttatatataatacatataaacacacacatatatataaacatatatgtataaaatatacattaactctttctagggctaggcaaaactcctctgaacatattgragagaaataagcagatattttagaagaaagcctgaaataattgacataacacatcagatgtgtaagatgattcatatgattcaagacggtttagtgatggcagccaacaacaaataaagatgtttttgggccaggcgtggtggctcatgcctgtaactccagcattttgggaggcctagtgttcgagaccagcctgggcaatatggcgaaaccctctctacaaaaaaaaaaaaaaaatattagccaagtgtggttgtatagacttataacccagctactcaggagactgaggcaggagaa

SEQ ID NO: 95962 - DNA, 601 bp, Human
tgaggaggacaactaagccagggaaaggggcagcatgtgtaaaagcttaaagaatgaaagaagcctacattcatgacattgcaggtctattcacattgccggaggcaaagacacttgtagcaaaatggagagggaaaaggataaagagataggtaggcagaaaatacatttacaatgcctgcgagtgctgaaatgaagaggctggacttcataacaaacaacacagcaagccagagctaaatattacagaaggatcttaatcatatttgtattttggaaagcttatttaaacagctgggcwcagtagttggggtaagactcagaagctaaattagaagattttgcagaaatctagggtttttgtgataagaggccaaactctcagaatgacacgaagaatagagagaaagagatggaattttaaaatatccaggaaacagtgtctgcaggacttaaattgtttgatgattagagagtgtttgtgttgggaggggtaatgatatgataaatcgagggtggggaaggtcaatgatttgattattagtgttctatttctagaaagtaggtaaataaacagacagtggtgtcattcaccactacg

SEQ ID NO: 95963 - DNA, 601 bp, Human
ctaaatattataaaatgggatcaatttatttacttatttattcaattatccctccaacattcatgcatttattctttcatacattcatttatcagatgtttactaagcacttactatgttccagacattgtttcatgttatgataatgaaaaagacggacctagactctatactccttaatttttaaagatttgagattctttatactttgcttactgccattgtccatgttccatagattctgaaccctttgctgataatgacaactggaaattcccttggatatctactttgcaatcayttcgtaaaagttagatctttccagaaatttttacctcacagcatgcatttctgaagatatcattgggcataaactgaaattagcaattcacatgcatctaataatctacttttctcaaatgcatcagttccaataatgtactcacccctactgatattttcctatatgttgtttagaaaatgtaattagagttaatatttttatcaaaaggaataacattatacctatctggaataaatagatgagttaccgaaagattgctacaactaactcaactactgaatttgtccccttttatca

SEQ ID NO: 95964 - DNA, 601 bp, Human
tccaggagttaccctatctcaatgtatttccttccatgtgaagggtactgctgacaacacagagaaactgaactccatgaaaatcatactacttaggataaacttccctctccctgcacttatggtggaaagagcaccttttaaaaggaagctcttgttatttccatatgtcagtggactagcactcacagcccaggacaaaatctcaaaccagcaacaaagtaaaaacaacttaattactgtgttattcatacacatcaacgacttcatgctattacttcagccaaaggacagttatttwaaaaaaaatcagtatgtgatttagatttatgagattatgcagcagcactaaactgaattttaatgttggatgtattatttaatctaacattagttctcacttaaatttcagatattcagaactcagacctttgttattccaaggactaatgtataacaaatggataaatcaaagaactactgaaatccagtcacaaccataatagtatttatttttacttttttctgtgtacacataatctaaactaagatcacagacacacaattagaactagaaatgaacaggctgatttagtcttag

SEQ ID NO: 95965 - DNA, 601 bp, Human
tattagctggaactaaggtatcaagaataattgtaaatacctaatgaatggtaactatatgtcaggcaccattctaaacactggcaatatagtccctgctctcatgacgtttacattctagtgaggagaagttgcatttgaatctgttttttaaaaaataagtttgaataaaaatatataaccaacctaaatgcccatcaaccaacaaatgataaaatgtggcatacataccccatggaataccactcagccataaaacagaatcacgtaatggccattccagcaacttggatggagctgkgggcattattctaagtgaagtaacacaagaatggaaaaccaaatatcatatgttctcacttataagtgagagctaagctatgaaaatgcaaaggcattagaatgatacaatggactttgaggacacagagggaagggttgtaggggggaacgagggataaaagactacatattgggtacagtgtaccctgctcaggtgatgagttcaccaaaatctcaaaaacaactactaaagaacttatctgtgcaaccaaaaaccacctgtaccccaacaattattgaaataaaactaaaaaatgag

SEQ ID NO: 95966 - DNA, 601 bp, Human
gttacacaattcacatacatcatatcaactgatctacttgaggttggttggcagctagtctcattctcactttagaaagaggaaactgaggctcagaaacattatgtgataagtactggaaaatggtggtatcaagactagaactcagagagctagactttatcaattctattagctggaactaaggtatcaagaataattgtaaatacctaatgaatggtaactatatgtcaggcaccattctaaacactggcaatatagtccctgctctcatgacgtttacattctagtgaggagaagytgcatttgaatctgttttttaaaaaataagtttgaataaaaatatataaccaacctaaatgcccatcaaccaacaaatgataaaatgtggcatacataccccatggaataccactcagccataaaacagaatcacgtaatggccattccagcaacttggatggagctgggggcattattctaagtgaagtaacacaagaatggaaaaccaaatatcatatgttctcacttataagtgagagctaagctatgaaaatgcaaaggcattagaatgatacaatggactttgaggacacagagg

SEQ ID NO: 95967 - DNA, 601 bp, Human
tacatttgtgcaacacttcagtttgttacacaattcacatacatcatatcaactgatctacttgaggttggttggcagctagtctcattctcactttagaaagaggaaactgaggctcagaaacattatgtgataagtactggaaaatggtggtatcaagactagaactcagagagctagactttatcaattctattagctggaactaaggtatcaagaataattgtaaatacctaatgaatggtaactatatgtcaggcaccattctaaacactggcaatatagtccctgctctcatgaygtttacattctagtgaggagaagttgcatttgaatctgttttttaaaaaataagtttgaataaaaatatataaccaacctaaatgcccatcaaccaacaaatgataaaatgtggcatacataccccatggaataccactcagccataaaacagaatcacgtaatggccattccagcaacttggatggagctgggggcattattctaagtgaagtaacacaagaatggaaaaccaaatatcatatgttctcacttataagtgagagctaagctatgaaaatgcaaaggcattagaatgata

SEQ ID NO: 95968 - DNA, 601 bp, Human
gaggaccaaaatttatcaactttctatgaacagcataatgctttaccttacaacaggttaaagaaactcagagtgatatgttgtcatcaacaccttttgttcacccctgtggtatgcatacccataggatttaagaaggacaaagttgcagccctttctgtacattgaatagcaggtttcatcataacagggactatattttttaacactaaatcgaatataatggagaatcaatggtgatctttgccatggctccagttactccacatgccccattggtgctaattggtaaaaggagttscctcctctaagcagtcagggctgctacaccagagctcagtgtttcttgcagagagaacatgtcagatttgcacacattctcacttctttgtccaggcatccttctgcaacctgtggcaatcccagttttgatctacatgaactggggaactctaagctggcaggtaacaaaagaccacttcaaaagtttttacttgtttgttaggttaacaatattatattaatacatttgtgcaacacttcagtttgttacacaattcacatacatcatatcaactgatctacttgaggttggttggca

SEQ ID NO: 95969 - DNA, 601 bp, Human
gtattagaaatgaacccctttgtgcccttttgtgttaccgttcccaggcatttattccaggagcatgttttgtatctgaacctgtatcaccagatcctcacggtatctgaagacttattaatgtgaataagcagagtgctctcccttcccttaagctaagcccccagagggtctgcatgtagaacaccattgaatcttagccactgcaatagaatctccaggagtaggagctgagaaaggaggaatgccctcctcagaatggaacccgggttgggtgtgtaaaggggaaagatttagcttyggacaatgatgatggcgctgtgcagtggacaatggagaaaatgggtggagtcctggcagtgggggcctgaaaaaagggcaggaagctttattatgggaaagggatggggacataatctgagggaacagaaatagtggtagctgttctcagtttttctgggccctgaagttttgttctggtagagacacacggggatatgaagtgcattcagttttgtgtccaaaaatattgaccgctctggttatacagcagttggagaggcagtagaacattcatcattcaaaatcacaaataactata

SEQ ID NO: 95970 - DNA, 601 bp, Human
taactattaattgataacaatgataaatattcttacatataaatatggctttctacaatgtctctctgaggggaaattacttcagctctatccatttattctttgctctgtacatgaaattctaaaattctgagattaaactgctttttcgtggatatgatcattggggttatataactgagaatataagccctggaggcttagagtttcatttatttgaagagcctttacattgcaaagtacacaactgatgctaaactcattcataactaccattgcaataaagccatgagatgtaaayaattcagaaatttatttcttcaaccaatgttcagaatgcataataggtaaaactatgcattttcattcatgtaaaaatcatactgtttttaatgcattcactaccaattgcaaaaaagcacattattgccatttttttgttaatccctttcataatttggtgctattttttttttctaaataagcattatgtcctgaaagatttctgtaaggtggttatttggagcacaaatgtatttccccattttgattaaagaatgtatgagggttggttatggtctcagtatcaaaacctttttaa

SEQ ID NO: 95971 - DNA, 601 bp, Human
atttaccattctgacaaacccaaggctctgaagaattatactaaatctaccttgtctatgctctatcagtggaacaacagttttttaatctatcagtggaatgacaaatcctgcatgacagcacgtctgtttactgaatatttcgagcccaatgttgagacctattactcagaaaaaatatatgtatatatttctttcaaaatatttctgcttattgagaatgtacttggtcactcaagagctctgatagagatgtttaaggagattaatgttgtttttgatgccccctaacacaaaaatmttttctgtggcccatggatcaaagagtaatttttatttctagagttattttttaagaaatacgtttttgtaaagctatagctagcgactcttttcttggatctaaatgaagcaaatttacaatcttctggaggattcaccattctatatgccatcaaaaacatttgggattcaaagtaggaggtcaaaatatcaacattatcaggatttccttaacagttgattccaaccctcatgatcactttaaggggttcaagacttccgtggaggaaacaactgcagatgtaatagaaataggaag

SEQ ID NO: 95972 - DNA, 601 bp, Human
cactaaacaacaaactttcaatgtggatgaaacagccttatattgaaagaagatgccatttaggatttttataaatcaattgactcctagagagaagtcaatgcttggcttcaaagcttcaaaggacaggctaactctatcattaggagctaatgcagctggtgactttaagttgaatccaatgctcatttaccattctgacaaacccaaggctctgaagaattatactaaatctaccttgtctatgctctatcagtggaacaacagttttttaatctatcagtggaatgacaaatcctgmatgacagcacgtctgtttactgaatatttcgagcccaatgttgagacctattactcagaaaaaatatatgtatatatttctttcaaaatatttctgcttattgagaatgtacttggtcactcaagagctctgatagagatgtttaaggagattaatgttgtttttgatgccccctaacacaaaaatcttttctgtggcccatggatcaaagagtaatttttatttctagagttattttttaagaaatacgtttttgtaaagctatagctagcgactcttttcttggatctaaatgaagca

SEQ ID NO: 95973 - DNA, 601 bp, Human
ttttgcaccaaacagctaagttgtgagtgcaaaggaaaagttattgaaagaaattaaaaagtgctaccctggtgaggacataaatgataaaaaagcaaaacagccttaatgctgatctgaagaaaattcaagtgttctgaatagatcaaaccaaccaaaacactcccttcagccaaagcctaatccagaccaaggcactaactctcttcaattctgtgaaggcttagagaagtaaggaagctgcagaagaaaagttggaaggtagcagaggttggtttatgagatttagtgaaataagccrtctccataagatagaagtgcaaggtgaagcaacaaatgctaatgtagaggatatatgctgcaaggtgtccagaagatctagctaagatgatggatgaaaatggctacactaaacaacaaactttcaatgtggatgaaacagccttatattgaaagaagatgccatttaggatttttataaatcaattgactcctagagagaagtcaatgcttggcttcaaagcttcaaaggacaggctaactctatcattaggagctaatgcagctggtgactttaagttgaatccaatgctcatttacc

SEQ ID NO: 95974 - DNA, 601 bp, Human
agctgagctaggccaaaagctaggccttttgcaccaaacagctaagttgtgagtgcaaaggaaaagttattgaaagaaattaaaaagtgctaccctggtgaggacataaatgataaaaaagcaaaacagccttaatgctgatctgaagaaaattcaagtgttctgaatagatcaaaccaaccaaaacactcccttcagccaaagcctaatccagaccaaggcactaactctcttcaattctgtgaaggcttagagaagtaaggaagctgcagaagaaaagttggaaggtagcagaggttgktttatgagatttagtgaaataagccatctccataagatagaagtgcaaggtgaagcaacaaatgctaatgtagaggatatatgctgcaaggtgtccagaagatctagctaagatgatggatgaaaatggctacactaaacaacaaactttcaatgtggatgaaacagccttatattgaaagaagatgccatttaggatttttataaatcaattgactcctagagagaagtcaatgcttggcttcaaagcttcaaaggacaggctaactctatcattaggagctaatgcagctggtgactt

SEQ ID NO: 95975 - DNA, 601 bp, Human
accctgcgtccagcaagtccattggcatcatttttcccatagcatgtgcttgcttcatgcctctgtgtcacattttggtaattctcacaatatttcaaactactccattattattacatctgttacagtgatctgtgatcagtgatttctgacgttactgttgtatttgtttgcacccattaattgtttacaggctccatgaatcccacccattcaagaaggtgaacttgattgataaatgttgtgtgtgttctgactgttccattaactggccatctctactctctctccctctcctcagacgtccctattccctgagacacaatcaaaattaggccagttaataaccctacaatggcctctaaatgttcaaatgggaggaagagttacacatctcttcttttaaatcaaaagctacaatgattaagcttagtgaggaagccatgttcaaagctgagctaggccaaaagctaggccttttgcaccaaacagctaagttgtgagtgcaaaggaaaagttattgaaagaaattaaaaagtgctaccctggtgaggacataaatgataaaaaagcaaaacagccttaatgctgatctgaagaa

SEQ ID NO: 95976 - DNA, 601 bp, Human
actagttactaagtgaacttaccataaagagatttggaaatcgaagtgagaaattaaaagcatacaagtaaaggcatactaccttttattgtgcttcactttatcacattgcagatcctgcacttttacaaattgagggttgtagcaaccctgcgtccagcaagtccattggcatcatttttcccatagcatgtgcttgcttcatgcctctgtgtcacattttggtaattctcacaatatttcaaactactccattattattacatctgttacagtgatctgtgatcagtgatttctgacrttactgttgtatttgtttgcacccattaattgtttacaggctccatgaatcccacccattcaagaaggtgaacttgattgataaatgttgtgtgtgttctgactgttccattaactggccatctctactctctctccctctcctcagacgtccctattccctgagacacaatcaaaattaggccagttaataaccctacaatggcctctaaatgttcaaatgggaggaagagttacacatctcttcttttaaatcaaaagctacaatgattaagcttagtgaggaagccatgttcaaagc

SEQ ID NO: 95977 - DNA, 601 bp, Human
aatttatcaattaatcctgagaaattctaagttgtgaaaggatcaaaccccattctctagcaagaaggcctgatatttgaaacgaaaagcaaacaagcaagtgaaaaaaaaaaattctagaacatggctccacccagaatatgcctctgtggtatgcaaatagcgttaagttgtgccatcttgagactcacagttccttatacagaaaataatgaacatttttgagtctttggaattcataataatgttaaaatgtgtgttatagcaaaatagcaacatttcctggtgtcctgcaaattayttctcatgaaatttaaactgagaataatctataacatctaagtcttaattatgtaaagcagaacattttaatgaaatcacttattaatttattccattgttcatttgtacttctcatagttcttttgaataaaagtcttttacaaacctcatcattctagtagtgttccctatgaaacaggattttattattttttatatgacactttctgcagtcatatccttctcagactgtacgatctaaagcaagctcttggtaaatgggacaaagccaatttgccctgcagtggatcctgatgaa

SEQ ID NO: 95978 - DNA, 601 bp, Human
tataatgtttgttaaatgattctacaataatttattcaacaaaatccactaccctcagaacctaaaatacagggatcattttaggattaataaacaactgaaaatttatagtatgaaatgccaaaaaaatgcattttaatatatttttagtattatttaggtagcatgactttagttttaaaacatcaagcttattaaatttatcaattaatcctgagaaattctaagttgtgaaaggatcaaaccccattctctagcaagaaggcctgatatttgaaacgaaaagcaaacaagcaagtgaaaaaaaaaaattctagaacatggctccacccagaatatgcctctgtggtatgcaaatagcgttaagttgtgccatcttgagactcacagttccttatacagaaaataatgaacatttttgagtctttggaattcataataatgttaaaatgtgtgttatagcaaaatagcaacatttcctggtgtcctgcaaattatttctcatgaaatttaaactgagaataatctataacatctaagtcttaattatgtaaagcagaacattttaatgaaatcacttattaatttattccattgttca

SEQ ID NO: 95979 - DNA, 601 bp, Human
ccacacagttctggaggaagcggaagtctgaaatcaaagtattgatagggttctttctgaggcctgtgagggaagaatctgtttaagcttctctctttggcttgtagatggctggcttcatgttaacatggcattcttcctctatgtgtttctgtctccaaatttcccctttccataaggataccagttataatggattggatcacaccttaatgacctaattttaacttgattacctctgtaaagacactatgaccaattaagatcatactctgagtttctgggaattagaacttcaacrtaaggttgtgggaagatacaattcaacctatgacaaatgttatatggtctcctcaccatacaataaaattatcttttaaaagtttaagttaaatgtacacctaaggcattactattaatgagttgtgtaaaataaaattttgattaaattgtagaggaaattgattccttctcaaattccagatgtagctgaaaactgaaatcatccaagggatggcttctggtcataattaggttagctggattaaaaaatatttgcatgtagaaaagtgtatattttaaaagatgtatgcatgtgtgc

SEQ ID NO: 95980 - DNA, 601 bp, Human
ccaggctggtctcgaactcctgacctcagatgatccacctgtctcagcctctcaaagtgctgggattataggcatgagccaccatgcccagtcccaaatctttattaagttatttaaaaggtttagaacagatcatgatagttttgcccaaacctctatctttctggattgagtatacacatctcacgaaggaaatacacgtattttaggaagaaaatgcagcctgaaaatttagagagataaggtttcctatgtgttttgtttttatcatttaatctatgaagaaaaaaaccagcagctycctgtgcctttcgaaggacttttaaatgagcttgaagctcctttatgtgcttctgaaaagaacattaaggtattcatgcccatatttcaaaagagcaagcaattaggtaaacacaaataatactttatacaacacctttcttctaaaaagctcacacagttttagaaacaggccgataaagctgcacccacctagagagtggggacaagtattcttttcctctttgatatgaaaggaaactgaaaaagaagagttaaaaagaaccaattttctgaagtctactcattatcagagttttca

SEQ ID NO: 95981 - DNA, 601 bp, Human
tttcaggaaatttatggaagtgcaagaactaagacccaagtttcttttttaaattttacttttttcagtattcaggcaaatgtgatgaagcaacctgttttttaaaaatatatttaaatataaatgatagtagtcctatattttctacttataaggaaatttccatccatttgttggaaaagtagtgataatttaacaattacaatttttaatatgtatgtgtatatgactagagatatgttacagctggagtccccaacccccaggccacggacccattaggaaccaggtcacacagcasgaggtgagcagcgggtgggcaggcaacactttatctgtatttacagccactctccagggcttgcattaccgcctgagctccatctcctgtcagatcagcagcggcattagattctcataggatcatgaaccctatagtgaattgtgcatgggaggaatctaggttgttggttccttatgagaatctaatgcctgatgatctgtcactgtctccaatcgcccccaggtgggactgtccagttacagggaacacacttcagagtttctaccaattctacattatggtgagttgtataattat

SEQ ID NO: 95982 - DNA, 601 bp, Human
tcttcctctcatgaacccaggaagtctcatgcagtaagataagccattccaggatttgcccaactttgtgaattagaagtttgcggaaagaatctgcagaaaatctcccaaattatgtgggttcaatctcacggatatagtagcaaggctctggttcttagcaaatatcatttgaataagataaacataagatccatgaactatactcagttcatttgggaaattaattttctagtattttatgtttgtgctgacacattttcttcctgggccaaatttgcacaaataaaactttacctagccccagcattcctcctactaaattgtcccattgtcattgaattgcaaacccactgaaacagaaaagccttgagtaatgacatgccatttcaatttggaaaaaaatactaagctgaatgcttcagaatcatgagcttttcatgatttgttgactctaatgtgcgttttttactttctctttcctaaagatattttcatggaaatcagctcttccttaagaattaatcatttcctgctgctttaccccacatggagtcataatcacactattgtgtcacagtagattctattttattacctg

SEQ ID NO: 95983 - DNA, 601 bp, Human
tatatctccttttgaaaagtgtcttttcatgtcctttgcccacttcttaatggagttgtttgttgtcctcttgtaaatttaagttatttatagatgctggatattggacctttgtcagatacatagtttgcaaaaattttcttccattctgtatgttgtctgttcattctggtgatagtttcctttgccgtgcagaagctctaaagtttaattagatcttgtttgtcaatttttacctttgttgctattgcttttggtatctttgtcatgaaatctttgcccattcctatgtccaggatgrtattgcctaggttgttttccagattttttgtagttttgggttttacatttaagtctttaatccatcttgagttgatttttgtataaggtgtaaggaagttgtccagtttcaatcttctgcatatggctagccagttatcccagcatcatttattgagtagggagtcatgtgacatgagtttacatataacttccccattgcttgtttttgtcagctttgtcgaagatcagagggtcgtaggtatggggccttatttttgtgccctatattctgttccattggtctatgtgactgtttttg

SEQ ID NO: 95984 - DNA, 601 bp, Human
acagtgtataagtgttcccttttctttgcggcctcacatctgttattttttgactttttaatgatagccattctgactggtgtgagatagtatctcattgtagttttcatttgcatttctctaaagatcagtgatattgagctttcttcatgtgcttgttggctgcatgtatatctccttttgaaaagtgtcttttcatgtcctttgcccacttcttaatggagttgtttgttgtcctcttgtaaatttaagttatttatagatgctggatattggacctttgtcagatacatagtttgcaaaaattttcttccattctgtatgttgtctgttcattctggtgatagtttcctttgccgtgcagaagctctaaagtttaattagatcttgtttgtcaatttttacctttgttgctattgcttttggtatctttgtcatgaaatctttgcccattcctatgtccaggatgatattgcctaggttgttttccagattttttgtagttttgggttttacatttaagtctttaatccatcttgagttgatttttgtataaggtgtaaggaagttgtccagtttcaatcttctgcatatggctagc

SEQ ID NO: 95985 - DNA, 601 bp, Human
cttctggtttctttagtcataaaataatactatccttctctttacaaaaatgagataaataacatgaaattctatgactaatcaggaaagaaaatcaaatgcattcaagagcacatactaacaggtggtaaccaaacaaaattagttttttagttattttttagataacagtgataaatttagccccatattttcaaaaaattcaaaagctgataaggaacatcggagcaaaataatttaattaagatgtttaaatggctttaggtagaaattaacaatagtgacaacaaatctcttttcrgaaaaaaaactgtggaatacatatccgaagttcttgaacttaacttagtgaaaatgatagcaagataaaaaaaatacttctaaaacccagatttcacaaactgcacttgaggtggtgctcaagaaggaaaattttaaaaggactcatataatatcttctcattgattattgtgccaaattcacatcactcctaatggtagttctgaaaatggatgaatgataggagtgctttgaaatgcaatttaagacccaagtggggctacaagtgaatcaaacctttggaataatgatttgcagcaa

SEQ ID NO: 95986 - DNA, 601 bp, Human
tgcaggcatttgtttccatttaataagcacatacattaggctaagatattttcagggactcaaaaaaggattctctgacttccttggtatcctttccaatcaattaattgactgcttgtaatacaggcaaagaggaacatacagtataatttatccgtacaagtagaggctgttttatcccattagcaaaattagaaaagatgatctatggcaaatagagttatttcatcatggtacaaacattatcactataactgaattccttaaattagaaaaataatatttgaacccttcaaacagmtatgtacacaggatgcttgtagtataagtgcagtttataagataatttttaagtattggagaaagaaataacactgccagcaaaattaaatactttagttaataaagtcttactcttctggtttctttagtcataaaataatactatccttctctttacaaaaatgagataaataacatgaaattctatgactaatcaggaaagaaaatcaaatgcattcaagagcacatactaacaggtggtaaccaaacaaaattagttttttagttattttttagataacagtgataaatttagccc

SEQ ID NO: 95987 - DNA, 601 bp, Human
tagaaagcctcctggatggagagaaaacatgtctcattatctgggctacacttgactcgtagaaagttaaatctagaagtaactgagagatcatctggaacaactatttcatgttacatttaagaacaattgcagacctactagaaaattaaaatcatgttcatagcactttaaatcccaaattatacagatgtgaagtaagtaattgaatacttaagggaaaataaaactctaccaatccaaatatttttgccacaagcaaagttaaaaaacatttttgtgtattaaaatacagaccatrttgtctataataatttaagaattacatgccaagaaagaaaactttgattcaatataaaatacatgattacattgtttcaattttactatttatctcaaaattgcaacatctctatgtgatggatacataagaaaatctaaattctcaaatttctttaacatttttcacaaagtcagttttacccaactggaaagagtagctgtagtttcttttagaatgtgtccaataataattgaaagattttagcctttgtgctctttgaagacagggtggaattaaagtgcttctttccatcagtct

SEQ ID NO: 95988 - DNA, 601 bp, Human
ggtgtaactcattcttcttctataaaattgatactactgtatggctagaaagcctcctggatggagagaaaacatgtctcattatctgggctacacttgactcgtagaaagttaaatctagaagtaactgagagatcatctggaacaactatttcatgttacatttaagaacaattgcagacctactagaaaattaaaatcatgttcatagcactttaaatcccaaattatacagatgtgaagtaagtaattgaatacttaagggaaaataaaactctaccaatccaaatatttttgccamaagcaaagttaaaaaacatttttgtgtattaaaatacagaccatattgtctataataatttaagaattacatgccaagaaagaaaactttgattcaatataaaatacatgattacattgtttcaattttactatttatctcaaaattgcaacatctctatgtgatggatacataagaaaatctaaattctcaaatttctttaacatttttcacaaagtcagttttacccaactggaaagagtagctgtagtttcttttagaatgtgtccaataataattgaaagattttagcctttgtgc

SEQ ID NO: 95989 - DNA, 601 bp, Human
cgtttttccttggtatttcttttcttgtggatttttcctccatttttctgtaaacctccttttggtggtttataaaattgcatacatacacacatatgtaagataataacactttaacctttatgttgcctttttttggtgactctttaccttttcttttaatgctattttaatatacagaacgtacatctaacaatggtgtaactcattcttcttctataaaattgatactactgtatggctagaaagcctcctggatggagagaaaacatgtctcattatctgggctacacttgactcrtagaaagttaaatctagaagtaactgagagatcatctggaacaactatttcatgttacatttaagaacaattgcagacctactagaaaattaaaatcatgttcatagcactttaaatcccaaattatacagatgtgaagtaagtaattgaatacttaagggaaaataaaactctaccaatccaaatatttttgccacaagcaaagttaaaaaacatttttgtgtattaaaatacagaccatattgtctataataatttaagaattacatgccaagaaagaaaactttgattcaatataaa

SEQ ID NO: 95990 - DNA, 601 bp, Human
gaaagtcctaaatatagaattcctgggacaaataacataatcacttttatagctttgagaatacatgcacgtatttgaaagttagtatcttttaaaaattgtgcatgccagtagttttgttaccttatccttgacaatactatcagtgatgtttaaaatttttgcaataagagaagatttgaattttatttgcaatatttgattactagaaatgagctgtttgtatgttcgtttttccttggtatttcttttcttgtggatttttcctccatttttctgtaaacctccttttggtggtttmtaaaattgcatacatacacacatatgtaagataataacactttaacctttatgttgcctttttttggtgactctttaccttttcttttaatgctattttaatatacagaacgtacatctaacaatggtgtaactcattcttcttctataaaattgatactactgtatggctagaaagcctcctggatggagagaaaacatgtctcattatctgggctacacttgactcgtagaaagttaaatctagaagtaactgagagatcatctggaacaactatttcatgttacatttaagaacaat

SEQ ID NO: 95991 - DNA, 601 bp, Human
taattttaaagccaaattttatggaacttacctgaaaagtttttgtaatccactaaatcaaacataacgatggcaacagctgaccacgtgattatcagggcaatgaccagaagccaggctgcaggggagctgaacgtcgtcactatgtcttctgtgactgtcctcttcagcacttttccgggggatttgggcacagatccatttttgctgtctatcacagttgtggttgtagatgcatttcctaatcaaacattcagaaaggaaaatataatttagagattcatggtaaatattgatgatragaaacactgactatatgagtgctgaacctgtttatactgctttctagagcagcacaactccttagtggcaggacaaagcctccctgcccactaacacattatcttttcctcagcatttactattctccctaaaactcgtgcgctcatataatcagtgtttctcatctcctaagtcctctgagggagaatcaacacaagtgataaaatggttcaaatggataaaacttcttctgaatattttaacttaattgtataattgacccatctagtgaggtcatctaatgaggtcattcatgttt

SEQ ID NO: 95992 - DNA, 601 bp, Human
ttatattgccaagtgtaaaacctacaaattattccttattaatgcttgataaagtaccagttccaaacgaaatcttcacccaagctttttaactattatctttatgaactgcaacattcaggctttgttcagctcttgcaaataaggatatcaatttcattggaaatcaataagtaccaccaacaaagaaagagaataggaggaaaaagggaagaatgaaacagatttcagtgatcctcaagcacatttgtggggtgtttcttcctcacactaagatgaaacagaaaccaagcaggaactrgaggggacactgtttctttccatttgaattaattttaattttaaagccaaattttatggaacttacctgaaaagtttttgtaatccactaaatcaaacataacgatggcaacagctgaccacgtgattatcagggcaatgaccagaagccaggctgcaggggagctgaacgtcgtcactatgtcttctgtgactgtcctcttcagcacttttccgggggatttgggcacagatccatttttgctgtctatcacagttgtggttgtagatgcatttcctaatcaaacattcagaaaggaaa

SEQ ID NO: 95993 - DNA, 601 bp, Human
gctacctataattagatttttagattagattacttaaaataaggcatacttatagttcacagtagagcttccattggagagctgcaattaatttctatgggcaatgcctatgttactggcatttcatctgatagggaaatacttcagtcaatgcaagctcaagggaaatgaaattttgtagagtaaggtaaccaagtgtcttttacttaaaactctaggtcataatttacattatagacattacaactgtgtatattttaaaagcctctattatacaataaactatgtattgcctatttasattagacatttatgactctggataaatagcccttttgctttctttgatatcacgggacttttctctacttgttagatgagaatctaactcattggtagtccagctaccaatggtatgctggcagagtcaactcaatcacaccttgtattaggttgttccggcattgctataaagaaatacctgagactgggtcatttataaagaaaagaagttcatttggctcacacttctgcagtctgtacagaagcatggtgctggcatctactcagcttctggtaaggcttcagggtgtttacaatc

SEQ ID NO: 95994 - DNA, 601 bp, Human
aaagtttgaattgtgtctatcaaaattaacattaaatatgtgagtataatttacattttgaaactgttattgaagccataatttatatagttctttcatttttataatacacatatttcaagaattgcatataaatcaaatatttgtaaagttaacaatgtacaagtgtactacagaaattatcattgaaaggaatttgttcttattttataaaatgcacagctacctataattagatttttagattagattacttaaaataaggcatacttatagttcacagtagagcttccattggagmgctgcaattaatttctatgggcaatgcctatgttactggcatttcatctgatagggaaatacttcagtcaatgcaagctcaagggaaatgaaattttgtagagtaaggtaaccaagtgtcttttacttaaaactctaggtcataatttacattatagacattacaactgtgtatattttaaaagcctctattatacaataaactatgtattgcctatttacattagacatttatgactctggataaatagcccttttgctttctttgatatcacgggacttttctctacttgttagatga

SEQ ID NO: 95995 - DNA, 601 bp, Human
atataataaacccttattctatgtaattcagagttgctttcagctattgtgtcaaacattgacagataggcatagtattgtttgaatattatttggatgttacattaagtaagaagtgtggtgtaggtgaaatatcttttccagtctgtttatttggtgccttaaaatttgtctcatttgataagaagaatcaaagtcaaaaattttgcagaatagaaagcaagatgttatccccatttcacagacaagaaaagataagttcctagtcatgttagcttgtaggttcatagagctgaataaygaacccaaatcatctaaatgaaccacaaataaaagccaattctgcatgtccccaactagtagcaaatatatgcataaatcagacagaattctgaaaatagggggaattgtaaaggttgcccagaagagaattattcttctcaatccagtacagtatgagcttataaaaacagattttcatttctctatgaacaaccttttcatggcttcacggcatttacctacttttctaaacttccagagagtaactgacagttgccctgactttctggccttccaaatcatttccagtttatttctt

SEQ ID NO: 95996 - DNA, 601 bp, Human
ttacatagattattgtatttaattcttacaaaattggtttgaaataagtatattttgtggaatgcttgcaaaaattaccaagtgtgctttgagacacgctggtacaaccatgtaatgatgttttcctctaatggatgaggatgctaatgaatgatgatccttgttcttaggaaggaaaagagttaccacattctattgctgtacattctgacctagaagaaaatcatcaacatccactaatgccttagtttgtagtcatttctttataaatcctatttgtttgcacttctgattgtttagygagaaagttgtcacttcataaataaagcaaaagaaatttgtaagaaatttcaaccaaagcctacaaattctggccccaaaagatcagaatacataatcaaggcaccccttcattttctgagagggaggtctttctggctgagtctgcagaagcttgaagggaagatctccggcagcctttctaagcctctagcctcaattactaagagagcaacgtttctctgtcctcccatcccccacttagggtttccaaaatcattcttctttgaggagagaactaaagtcaatgtggataacagag

SEQ ID NO: 95997 - DNA, 601 bp, Human
gacaggaatgtcagacctctgagcccaagctaagccatcatatcccctgtgacctgcatgtacacatccagatagccagttcctgccttaactgatgacattccaccacaaaagaagtgaaaatgtccggtccctgccttaactgatgacattaccttgtgaaattccttctcctggctcatcctggctcaaaagctcccccactgagcacctcgtgacccctgcccctgcccgccagagaataacccccctttgactgtaattttcctttacctacccgaatcttataaaatggccgcayccctatctcccttcgctgactctcttttcagactcagcccgcctgcacccaggtgaaataaacagccttgttgctcacacaaagcatgtttggtggtctcttcacatggacatgagtaaaatgtgaaagatagtatttggagttgtggcctttggaggcaattaggtcctgagggcagagccctcacaaacagaattagtgcccttataaaagaggcctaagagagttcaccccttccatgatgtgagaacacagcaagaagcctatgagctacagagtaggttctcacagataccaaaa

SEQ ID NO: 95998 - DNA, 601 bp, Human
acagggtacagcccatttgagctcctgcatggacactcctttttattaggccccagtctcattccagacaccagcccaacttgaactgcaccccaaaaacttggatagagcctaaaagctcaccaaccaagcaagtaattatgctcaacccccttgagcactctctaattggatgtcctgggtcctcccaattttcagtcctttaatacctgtttttctccttctcttattccatttagtttttcaattcatacaaaaccgtatccaggccatcaccaataattctatatgacaaatgttkcttctaacaaccccacaatatcaccccttaccacaggatcttccttcagcttaatctctcccactctaggttcccatgccgccccaatccctctcgaagcagccctgtgaaacatcgctcattatctttccataccaccccccaaaaaattttcgtcgccccaacactttaccactatgttatttttcttattaatataagaagacaggaatgtcagacctctgagcccaagctaagccatcatatcccctgtgacctgcatgtacacatccagatagccagttcctgccttaactgatg

SEQ ID NO: 95999 - DNA, 601 bp, Human
catcgtggaaatctatcctcaaggaaataacttctcagtgttccatctgctattctactactcctcagggattgttcaggcctcctccctttcctacacatcaagctcagggatttgcccctgcccaggactggcaaattgactttactcacatgccccgagtcagaaaactaaaataactcttggtctaggtagacactttcactggatgggtagaggcctttcccacagggtctgagaaggccactgtggtcatttcttcccttctgtgagacataattcctcggtttggccttcccayatctatacagtccgatagtggactggtctttattagccaaatcacccaagcagtttttcaggctcttggtattcagtgaaacatttatataccttacaatcctcaatcttcaggaatggtagaacggactaatggtcttttaaaaacacacctcaccaagctcagccaccaacttaaaaaggactggacaatacttttaccacttgcccttctcagcattcaggcgggtctgtcctcggaatgctacagggtacagcccatttgagctcctgcatggacactcctttttattaggcccca

SEQ ID NO: 96000 - DNA, 601 bp, Human
aaagccactttacttccaaaggaagctggagtcattcactgcaaaggccatcaaaaggcatcagatcccatcactcaggacaacgcttatcctgataaggtagctaaaaaagcagccatcaaaagggctcagatcccatcgctcaggacaatgcttatgctgataaggtaattaaaaaagcagctagcattccaacttctatccctcgtgcagattttctccttctcatctggccactctcacccactccctcactgaaacttccatctatcaatctcttcccacacaaggcaaatggttyttggaccaaagaaaatatccccttccagcctcacaggcccattctattctgtcatcatttcataacctcttccatgtaggttacaagccactagtccgccttttagaacctctcatttcctttccatcgtggaaatctatcctcaaggaaataacttctcagtgttccatctgctattctactactcctcagggattgttcaggcctcctccctttcctacacatcaagctcagggatttgcccctgcccaggactggcaaattgactttactcacatgccccgagtcagaaaactaaaa

SEQ ID NO: 96001 - DNA, 601 bp, Human
aaagagagagggagaaggaaccaagaaagtgtaatgcaccagatatcaggttaatacattgtttttgaggaggacagagtgatcaactggaaaatgctatggataggtcaagaaagttgaagactgagaatggacctttggattggatgacgaggatgtcactcatgaccttcaaagagcaatttcagtggagtgcattcaagacaaaatagaaaaatttggaggcagtgagtatatttttatgcatatgacagagattgagtaatactagaagaggaactaggatcatagtgagtttttctgtttttaccattgttcaaataggaagaatatcccatggtttatactgatgggaagatctcatagagagcggaaaaattatatgaacgagaggatttctggggaaatttttaattttatattccattctgagggattcgtggagcacacagaccattcagtgaccccaggaataaaatgctgctttctgggaagcctgtctccatgattcattgataatgtactttcactctttgcaccccattttactacactccagagagtttcatgtgagcaagaaatggccgtttgaatggtgaga

SEQ ID NO: 96002 - DNA, 601 bp, Human; identical to SEQ ID NO: 33850

SEQ ID NO: 96003 - DNA, 601 bp, Human
aattgtaatttgttttgctgtaagtgaggaatctcttcctctgccattgacatgcatcaagtacaatctcatagaacatcatcctctatattgggtctagcttatccttaaggacaatttcttatttcaaagagaaagtagttagcaagaaaggaaattaaacataatgtagattggcttctggtgttttcctctaaggcaagagataaacctatagcccataaggccaccatggtcctaaaattaaagatcagtttctcctgtccaaaaaactaaatatgcataactctgaatgactacrattattctttcttaactttaaagctagatgtcaggaaaagacattacaaaacctaattccttgttaggagcctattattatcttctaaaattacatattccaaaggatataaatgctgtaattattattcttatatacagatatattatagatggaggtttaagtgagaataaactgtaaaaaggagatagagataggtgtatctgttaagttgcacttaaaagtgttaataccagtattttattagtaaaataaaccagtcataaaccagtattttatttttgaacataaatagagaaa

SEQ ID NO: 96004 - DNA, 601 bp, Human
aagaaagaggatttactaataacatgattaaaaaaaaaaaactatatcaagtcatttcagaagccaactctatttatgccttttaatcacttgaacagaaaaagtgtttttttgtttgcttgtttgtttgtttgagtctcgctctgtcacccagactggagtgcagtggcgccacctgggctcaccgcaggctccgcctcgtggcttcacgccattctcccgcctcagcctccgagtagctgggactacaagcgcccgccacgacgcctggctaattttttgtatttttggtgaagacggkgtttcaccttgttagccaggatggcctccatttcctgacctcgtgatctgcccgcctcggcctcccaaagtgctaggattacaggcatgagccaccgccaatgtgagttggattttggtctctcatgagcaaaagagttctaattaagacatcacttgaatctgacacacaaagttgagaaccattggtaagctttctgttatgctttttttgttgttgtttattttatttttcaacagaccctttctaaatgaaaatctataatttaaaataggtaaaactttaagccatctgcagtca

SEQ ID NO: 96005 - DNA, 601 bp, Human
tggccccaactttctggtcccatactagctgctaggagagaaaagcctgcctgagactgaaacaaatgaaacagaggaaggaaagcaggttccagaagtgaagaaagaggatttactaataacatgattaaaaaaaaaaaactatatcaagtcatttcagaagccaactctatttatgccttttaatcacttgaacagaaaaagtgtttttttgtttgcttgtttgtttgtttgagtctcgctctgtcacccagactggagtgcagtggcgccacctgggctcaccgcaggctccgcctcstggcttcacgccattctcccgcctcagcctccgagtagctgggactacaagcgcccgccacgacgcctggctaattttttgtatttttggtgaagacggggtttcaccttgttagccaggatggcctccatttcctgacctcgtgatctgcccgcctcggcctcccaaagtgctaggattacaggcatgagccaccgccaatgtgagttggattttggtctctcatgagcaaaagagttctaattaagacatcacttgaatctgacacacaaagttgagaaccattggtaagctttctgt

SEQ ID NO: 96006 - DNA, 601 bp, Human
ggattttgttaacagtagatttatatacattagccattgtgtgtaaacaaattatgcagttattcatttatctttgactgtctaactcactggcctcaggatgcataaaattccctatttatagcattactcttttgggttgcaatggctctcactctgattgtgagttagaataccattgtggagatgttacaaattcaactatttaaggcttgacccctacagattgttatttagcaaatcggagatgggaggtaatctagaattctgaattagaaacaaaaattagatgatgtagacrtttgtggcattcctgctagaatccagtattcctgataatattcctcttaattttgggaaccacttttttccccatgctaacccacccttcatttccaagggcgggggcccatttcataggccttgataaagtgcatatttcatctctctgtccaactgattggctccaacagggatatgctactaaatccagattaatgggagtgaaccagatgctttcgcagaggcattgaggaagagaacaggctcttctactgagttgctaaggtaagataattttggccccaactttctggtccca

SEQ ID NO: 96007 - DNA, 601 bp, Human
ctgagagccactgaagtgacttgaccatagctggttaacagcagaaagggaaacaataccaatacctccttgttgcattcattcaagcttatctgtcatgtttaaaattttgatatgttcagatgatgagcatcaactatcaatagttattccaatggcttaggtcaatgcgacagtgatatatatattaacttagtttgcatcctatcattcatgttttgggattttgttaacagtagatttatatacattagccattgtgtgtaaacaaattatgcagttattcatttatctttgactstctaactcactggcctcaggatgcataaaattccctatttatagcattactcttttgggttgcaatggctctcactctgattgtgagttagaataccattgtggagatgttacaaattcaactatttaaggcttgacccctacagattgttatttagcaaatcggagatgggaggtaatctagaattctgaattagaaacaaaaattagatgatgtagacgtttgtggcattcctgctagaatccagtattcctgataatattcctcttaattttgggaaccacttttttccccatgcta

SEQ ID NO: 96008 - DNA, 601 bp, Human
tgcattttgataggaaaatgtagacatagataaaactattaaaagatctatacaaaaatatgtgcatctctgacatccattaaaatacagcttaatgttgaagataattaacacgggagtcaatctgctcaattcaaatctgatttccatacttactagctgtgtgaacttcatttcctcatccataaaataagattaacagtagtgtctaccagataggattatatggggattaaaatatgttaaaatgtaaaacatttagagcatcatttgtgtcaagtaagcatcatgtgaatgccawctattattattatttgtctctctcactaaataactaaatttgatgagggcaagaattatgtctattttgttccacattaaattttcaatgcctaacatgatgactggaatatactagccacttgagaaatgcatactacttgaaaaaatattcaaccatgattatgagttatcaattcttgcatattttagaaggtggtgatggatcatattttacttgttttttatgatacaactttcaaaatactatttaactactaaaatgattatacttgaaaatttgaaaaaatattttatttct

SEQ ID NO: 96009 - DNA, 601 bp, Human
aggtatttttctcatagggaggcaatgcctgatttgttacctttgattgctctttccagctaaggctatatttgtataaattgcaaaatcaaatttaaaagattcgagtcattaaaggtagaaatttattgtccaacaatcttcaaataaaattaagttttctatattatgttaatactagcttctggttatttaataatttgcaaagataggtgaatgtctccacttaatataacatgaaataatgtataatagcataaaattttacttaaacatcatgacaccttttgaggatcacttyacttaaacctgaaccaaacctggatacaagagacttagaagaaaggcaaggcagtcattatttacctccacatatatgtcctttgcaattaggtggatgtccaatgtctctgaaaaggtgttaagtctcagcaccagatgctagttggaatcataagccatatttgtaaccggtaaatcttaaaaattgttttgtgtcttagaaagcacagaggtcaaagtatcttaatccacgtgtgagtctgcccataaattcttaaaggtatgagtttctatttgaattttgagaagggaagaaggg

SEQ ID NO: 96010 - DNA, 601 bp, Human
gaaaggtatttttctcatagggaggcaatgcctgatttgttacctttgattgctctttccagctaaggctatatttgtataaattgcaaaatcaaatttaaaagattcgagtcattaaaggtagaaatttattgtccaacaatcttcaaataaaattaagttttctatattatgttaatactagcttctggttatttaataatttgcaaagataggtgaatgtctccacttaatataacatgaaataatgtataatagcataaaattttacttaaacatcatgacaccttttgaggatcasttcacttaaacctgaaccaaacctggatacaagagacttagaagaaaggcaaggcagtcattatttacctccacatatatgtcctttgcaattaggtggatgtccaatgtctctgaaaaggtgttaagtctcagcaccagatgctagttggaatcataagccatatttgtaaccggtaaatcttaaaaattgttttgtgtcttagaaagcacagaggtcaaagtatcttaatccacgtgtgagtctgcccataaattcttaaaggtatgagtttctatttgaattttgagaagggaagaa

SEQ ID NO: 96011 - DNA, 601 bp, Human
acatgttactaatttagactttggaaaggtatttttctcatagggaggcaatgcctgatttgttacctttgattgctctttccagctaaggctatatttgtataaattgcaaaatcaaatttaaaagattcgagtcattaaaggtagaaatttattgtccaacaatcttcaaataaaattaagttttctatattatgttaatactagcttctggttatttaataatttgcaaagataggtgaatgtctccacttaatataacatgaaataatgtataatagcataaaattttacttaaacmtcatgacaccttttgaggatcacttcacttaaacctgaaccaaacctggatacaagagacttagaagaaaggcaaggcagtcattatttacctccacatatatgtcctttgcaattaggtggatgtccaatgtctctgaaaaggtgttaagtctcagcaccagatgctagttggaatcataagccatatttgtaaccggtaaatcttaaaaattgttttgtgtcttagaaagcacagaggtcaaagtatcttaatccacgtgtgagtctgcccataaattcttaaaggtatgagtttcta

SEQ ID NO: 96012 - DNA, 601 bp, Human
aaattagttttatatttttctttttactattttaaatgtggctactagaaaatcttaaattacatatgtgactcctattatattactactagacaggtctaaggcacgtctaatcccagggggagcaaaggacctttacaaaactttaggtcatccacagagacaaactgatttcaaatgaactgaaaaaacaaacttgatattctctcctgtcaatactgttttgcttgctccctcgtctccaagccaacagatgctgtgaagaagattggtgatttgtttaattcaggtccataaagcaagtaaaatatcaaagatttagactggtctttggacgtactaagggagttgcctttaagagatcattccttactcctagtaggtattaattggaatatagagatggcatgaaatttttaaaattgaaaaattgcatggaatgctacattcaccatgtaatggggaggccttaaaattgtcatttagaataatattttttttagaggtaggggtgtgtgcatatgtgtgtatatatacatgtatgtcttccacagataccagctgaccattcaaaagaataaagaagggattctggagctca

SEQ ID NO: 96013 - DNA, 601 bp, Human
actggttctacttctctgtttaatccctgactgatacattgaattcaataagatatatgattaaaattagttttatatttttctttttactattttaaatgtggctactagaaaatcttaaattacatatgtgactcctattatattactactagacaggtctaaggcacgtctaatcccagggggagcaaaggacctttacaaaactttaggtcatccacagagacaaactgatttcaaatgaactgaaaaaacaaacttgatattctctcctgtcaatactgttttgcttgctccctcstctccaagccaacagatgctgtgaagaagattggtgatttgtttaattcaggtccataaagcaagtaaaatatcaaagatttagactggtctttggacgtactaagggagttgcctttaagagatcattccttactcctagtaggtattaattggaatatagagatggcatgaaatttttaaaattgaaaaattgcatggaatgctacattcaccatgtaatggggaggccttaaaattgtcatttagaataatattttttttagaggtaggggtgtgtgcatatgtgtgtatatataca

SEQ ID NO: 96014 - DNA, 601 bp, Human
caacttgcctgtgatcctcccttcctgacttcctgtcatatgggttcaaaaatgcctggccagttcccacaatcgcataatccaattccttgtaataattttttaaaagtataaaagtatctccataatcttctactggttctacttctctgtttaatccctgactgatacattgaattcaataagatatatgattaaaattagttttatatttttctttttactattttaaatgtggctactagaaaatcttaaattacatatgtgactcctattatattactactagacaggtctaagkcacgtctaatcccagggggagcaaaggacctttacaaaactttaggtcatccacagagacaaactgatttcaaatgaactgaaaaaacaaacttgatattctctcctgtcaatactgttttgcttgctccctcgtctccaagccaacagatgctgtgaagaagattggtgatttgtttaattcaggtccataaagcaagtaaaatatcaaagatttagactggtctttggacgtactaagggagttgcctttaagagatcattccttactcctagtaggtattaattggaatatagagat

SEQ ID NO: 96015 - DNA, 601 bp, Human
aaggctaagaaaatggagttaattctgaatttacagttaatttggatagaagtgaatttgagattagagtttacaaatatgattgctacctttgaaaagtgacttaatcttaaatatagtgttttttcttagaaaaatgctaatgaggtttacttatttatttatcacaactttattccacagatggtctgagatggtgttaattactgtacacattttaaattctccatttgtaaatctgcatttgcatttttgtagtttttccaaaagtctactaaattaagatcaaccatggcaacaycctaaatatcttcagaaaagacagctactagctttcattcacctgttaaggaggtaaccaccattgtgaaggttttcttcctaatttttctcattaatcagttatcttactatttacagggtcactaatctactcttatctcaactgtgactttgaatatggtgatgaagatatgaacaggtaaggcactcattcttgtccctgaaaacaattctccaaaatgtaaggaaatatctccaaatgacataggaaatgcccatcttcctgtctctctcaccattttgtttatttcttctctag

SEQ ID NO: 96016 - DNA, 601 bp, Human
ttaccaaggctaagaaaatggagttaattctgaatttacagttaatttggatagaagtgaatttgagattagagtttacaaatatgattgctacctttgaaaagtgacttaatcttaaatatagtgttttttcttagaaaaatgctaatgaggtttacttatttatttatcacaactttattccacagatggtctgagatggtgttaattactgtacacattttaaattctccatttgtaaatctgcatttgcatttttgtagtttttccaaaagtctactaaattaagatcaaccatggmaacaccctaaatatcttcagaaaagacagctactagctttcattcacctgttaaggaggtaaccaccattgtgaaggttttcttcctaatttttctcattaatcagttatcttactatttacagggtcactaatctactcttatctcaactgtgactttgaatatggtgatgaagatatgaacaggtaaggcactcattcttgtccctgaaaacaattctccaaaatgtaaggaaatatctccaaatgacataggaaatgcccatcttcctgtctctctcaccattttgtttatttcttc

SEQ ID NO: 96017 - DNA, 601 bp, Human
aaaaaaaataaactctgacttgttacactaacttcttaaaagaaaaaaaattatttcctcagtaaatcaatatgtatttgagctactctcttagtaattgtaaataatttaaaaattattacacattttgaagttactttgattccatctattaaatattatttatgttatttatacatttataactgaaattaactgatatacattatataactgagagtaaatttagttatttaatatcaaaaatgttacaaaaacactaaacatgaaattttttctcgcatatgaatacacaaaaatrtatatctaaatgaagaataaacataaaatgaaatgtttacctttagtttgtattttcctttcaggtttctcttgtttttcagtcttatctttgtgtatttctaagaaaaaatagaatttataattttaaaactctgaaaatgtataaaatttaagccatagctatgacctaaactttataaacctaccacaaagtttaaattattatacagttactaacaagtttattggagtctaaaagagtctttgtaacattttgctaaacaaatcacttatttattgaaataagggaaaaattgga

SEQ ID NO: 96018 - DNA, 601 bp, Human
gacagaaggaattcaggttaaaaaaaaataaactctgacttgttacactaacttcttaaaagaaaaaaaattatttcctcagtaaatcaatatgtatttgagctactctcttagtaattgtaaataatttaaaaattattacacattttgaagttactttgattccatctattaaatattatttatgttatttatacatttataactgaaattaactgatatacattatataactgagagtaaatttagttatttaatatcaaaaatgttacaaaaacactaaacatgaaattttttctcrcatatgaatacacaaaaatgtatatctaaatgaagaataaacataaaatgaaatgtttacctttagtttgtattttcctttcaggtttctcttgtttttcagtcttatctttgtgtatttctaagaaaaaatagaatttataattttaaaactctgaaaatgtataaaatttaagccatagctatgacctaaactttataaacctaccacaaagtttaaattattatacagttactaacaagtttattggagtctaaaagagtctttgtaacattttgctaaacaaatcacttatttatt

SEQ ID NO: 96019 - DNA, 601 bp, Human
ggtcatataatgactctgcatttctacaccaaagattgtaaagatattgcatgacagaaggaattcaggttaaaaaaaaataaactctgacttgttacactaacttcttaaaagaaaaaaaattatttcctcagtaaatcaatatgtatttgagctactctcttagtaattgtaaataatttaaaaattattacacattttgaagttactttgattccatctattaaatattatttatgttatttatacatttataactgaaattaactgatatacattatataactgagagtaaatttasttatttaatatcaaaaatgttacaaaaacactaaacatgaaattttttctcgcatatgaatacacaaaaatgtatatctaaatgaagaataaacataaaatgaaatgtttacctttagtttgtattttcctttcaggtttctcttgtttttcagtcttatctttgtgtatttctaagaaaaaatagaatttataattttaaaactctgaaaatgtataaaatttaagccatagctatgacctaaactttataaacctaccacaaagtttaaattattatacagttactaacaagtttatt

SEQ ID NO: 96020 - DNA, 601 bp, Human
tcatcatgctgtcactgtccatctacctcttgaggctgtgcaggagagccgtggggctttcttacatgacctctgccatgaggtcatataatgactctgcatttctacaccaaagattgtaaagatattgcatgacagaaggaattcaggttaaaaaaaaataaactctgacttgttacactaacttcttaaaagaaaaaaaattatttcctcagtaaatcaatatgtatttgagctactctcttagtaattgtaaataatttaaaaattattacacattttgaagttactttgattccawctattaaatattatttatgttatttatacatttataactgaaattaactgatatacattatataactgagagtaaatttagttatttaatatcaaaaatgttacaaaaacactaaacatgaaattttttctcgcatatgaatacacaaaaatgtatatctaaatgaagaataaacataaaatgaaatgtttacctttagtttgtattttcctttcaggtttctcttgtttttcagtcttatctttgtgtatttctaagaaaaaatagaatttataattttaaaactctgaaaatgtataa

SEQ ID NO: 96021 - DNA, 601 bp, Human
ctggctcattcaaaatcatgtgaaactgaccattgggaaaacctgggcacgcttagaagaatatatttttgaatgtcttgcttcctattagtttctttaaagttttatgactatctctgtcacccacagaaaagttattcttataagataagcaagacaatgctggcctttcttaatttgcttctgctgcaagattgccattactggattcagttcagctgaaagtgatattaatcatcatgctgtcactgtccatctacctcttgaggctgtgcaggagagccgtggggctttcttacaygacctctgccatgaggtcatataatgactctgcatttctacaccaaagattgtaaagatattgcatgacagaaggaattcaggttaaaaaaaaataaactctgacttgttacactaacttcttaaaagaaaaaaaattatttcctcagtaaatcaatatgtatttgagctactctcttagtaattgtaaataatttaaaaattattacacattttgaagttactttgattccatctattaaatattatttatgttatttatacatttataactgaaattaactgatatacattatataac

SEQ ID NO: 96022 - DNA, 601 bp, Human
cagataattttgcattagctggtttatgacatagtaaatactggataaaattccatttttatctcagaaataaattatctcattttctgtctgcattatacaaatatagttattatgagatctttatttttgccctggctcattcaaaatcatgtgaaactgaccattgggaaaacctgggcacgcttagaagaatatatttttgaatgtcttgcttcctattagtttctttaaagttttatgactatctctgtcacccacagaaaagttattcttataagataagcaagacaatgctggyctttcttaatttgcttctgctgcaagattgccattactggattcagttcagctgaaagtgatattaatcatcatgctgtcactgtccatctacctcttgaggctgtgcaggagagccgtggggctttcttacatgacctctgccatgaggtcatataatgactctgcatttctacaccaaagattgtaaagatattgcatgacagaaggaattcaggttaaaaaaaaataaactctgacttgttacactaacttcttaaaagaaaaaaaattatttcctcagtaaatcaatatgtatttg

SEQ ID NO: 96023 - DNA, 601 bp, Human
tcctaagtacaaatataaataggtttcaactgagtgagcttcaatgttctgattgttgaagaattggctgaccaatctagaatgaattcaaacattaggattaaagacataatatctgtagaatgatttgagcccttcccaaaaagaaagcacatgaagtatattttaaaaacaacagcaacaacatggcattgtattaatataaattcacgtgctagtataatttaattgatacttttattatttgaaaatttactagctgcaactgtggtatttactacagataattttgcattagctrgtttatgacatagtaaatactggataaaattccatttttatctcagaaataaattatctcattttctgtctgcattatacaaatatagttattatgagatctttatttttgccctggctcattcaaaatcatgtgaaactgaccattgggaaaacctgggcacgcttagaagaatatatttttgaatgtcttgcttcctattagtttctttaaagttttatgactatctctgtcacccacagaaaagttattcttataagataagcaagacaatgctggcctttcttaatttgcttctgc

SEQ ID NO: 96024 - DNA, 601 bp, Human
gtccaacttctgtgatcaaaggaattaagaaccgaaaaaaggaaagagaacagtaaggagacattagtttcctaagtacaaatataaataggtttcaactgagtgagcttcaatgttctgattgttgaagaattggctgaccaatctagaatgaattcaaacattaggattaaagacataatatctgtagaatgatttgagcccttcccaaaaagaaagcacatgaagtatattttaaaaacaacagcaacaacatggcattgtattaatataaattcacgtgctagtataatttaattgrtacttttattatttgaaaatttactagctgcaactgtggtatttactacagataattttgcattagctggtttatgacatagtaaatactggataaaattccatttttatctcagaaataaattatctcattttctgtctgcattatacaaatatagttattatgagatctttatttttgccctggctcattcaaaatcatgtgaaactgaccattgggaaaacctgggcacgcttagaagaatatatttttgaatgtcttgcttcctattagtttctttaaagttttatgactatctct

SEQ ID NO: 96025 - DNA, 601 bp, Human
ttacagacgggaaactaagcaataaagtgaaatcttttgttcatattcacacagaaaaactgtggaaaacataagctctctctgatttccagctcagtgtggagcaactgaagctctactttcactttcttaagaaatagttacttttacaaaacatatttggtctactcaagaaatatattcaggttgataatctccagctcagtctttgagaaatttattttagacttcagccaaattcactgtcttaattatggaagacttgctagtttaataaacctactctacagcccactgctcrgtctttgacatcagaattctaatatagccaggtccaaaatgcaaatggtgccatctacattactaccgccactccagcagcactgttattaaattaatagcacagtctgcaagaaaaaaacagcagggacccaaatggtgtggaaccagttgagtttctgtttaaccttcagcagatagaaacacagagccagttcagtcatggttcgcttagtcaatccgtactcaagagctgtgtccaacttctgtgatcaaaggaattaagaaccgaaaaaaggaaagagaacagtaaggagacatt

SEQ ID NO: 96026 - DNA, 601 bp, Human
tacatattctgtgtgattttttttttgcatccttcttgatgggtcaattatataggtgtagactcccaaggctctcccgatgagttccatgcttctaaaacctttcagaatatcatattgtcccttgaaggggaaaaaaactatagagaaatagaatgtgatctagcttccaccataacgaatatcttttgtcatcccacaaaacacaccagcttgagcataatgaatctttttggtctcagatatttattgactcatttataatcatcacagactactactacctttcaaatactgtatmttttcttctaagggttcaaaatgctttgataataacttaaattcctaactatccatcacatacaaccataactgacatggaacatggcatacagaaaacagtatttatccacatacaagagcagttgtaaagcaaaacatttattttcactgaactatttgagaataaagagcaggcattagtctaccccatttacagacgggaaactaagcaataaagtgaaatcttttgttcatattcacacagaaaaactgtggaaaacataagctctctctgatttccagctcagtgtggagcaac

SEQ ID NO: 96027 - DNA, 601 bp, Human
ttaacttagtttaaggtaaaccttaactaacatgtcagagcttgtgtcctaaaaacataataagtattcattgcctggttatcatttaaaaggcatattctttagctccataaactgctgcattcttccctgaggaaaatatcgaacaaaataaacagagggacaaagtagaaataaaagttagcttgatatgataaagtaaaattatttaatgtggttgcctataaaagtatctaatttcttaagaaaaagagtcagaattgaaactcattatttgacactataaaatcaattagttagmatattaatatagaattgttttagaaatatatatcctgtgggattacatattctgtgtgattttttttttgcatccttcttgatgggtcaattatataggtgtagactcccaaggctctcccgatgagttccatgcttctaaaacctttcagaatatcatattgtcccttgaaggggaaaaaaactatagagaaatagaatgtgatctagcttccaccataacgaatatcttttgtcatcccacaaaacacaccagcttgagcataatgaatctttttggtctcagatatttattgactca

SEQ ID NO: 96028 - DNA, 601 bp, Human
tacagtattctgattatatttataaaataaaataaatttctacctcttttatgggaaaaaatccaaggttaacttagtttaaggtaaaccttaactaacatgtcagagcttgtgtcctaaaaacataataagtattcattgcctggttatcatttaaaaggcatattctttagctccataaactgctgcattcttccctgaggaaaatatcgaacaaaataaacagagggacaaagtagaaataaaagttagcttgatatgataaagtaaaattatttaatgtggttgcctataaaagtayctaatttcttaagaaaaagagtcagaattgaaactcattatttgacactataaaatcaattagttagaatattaatatagaattgttttagaaatatatatcctgtgggattacatattctgtgtgattttttttttgcatccttcttgatgggtcaattatataggtgtagactcccaaggctctcccgatgagttccatgcttctaaaacctttcagaatatcatattgtcccttgaaggggaaaaaaactatagagaaatagaatgtgatctagcttccaccataacgaatatcttt

SEQ ID NO: 96029 - DNA, 601 bp, Human
aggtcacatacagtattctgattatatttataaaataaaataaatttctacctcttttatgggaaaaaatccaaggttaacttagtttaaggtaaaccttaactaacatgtcagagcttgtgtcctaaaaacataataagtattcattgcctggttatcatttaaaaggcatattctttagctccataaactgctgcattcttccctgaggaaaatatcgaacaaaataaacagagggacaaagtagaaataaaagttagcttgatatgataaagtaaaattatttaatgtggttgcctayaaaagtatctaatttcttaagaaaaagagtcagaattgaaactcattatttgacactataaaatcaattagttagaatattaatatagaattgttttagaaatatatatcctgtgggattacatattctgtgtgattttttttttgcatccttcttgatgggtcaattatataggtgtagactcccaaggctctcccgatgagttccatgcttctaaaacctttcagaatatcatattgtcccttgaaggggaaaaaaactatagagaaatagaatgtgatctagcttccaccataacga

SEQ ID NO: 96030 - DNA, 601 bp, Human
ggtactcaaaactactccattgtggttaactcattctgcctgttccccaggggccatttatatgagtcacaatttagttaatgatatgtggtaacccaaaaaatgttaaattatggttggaagttttttctaagcaaatgtaatgttccgctatattactatataaattcagaacaaggtcacatacagtattctgattatatttataaaataaaataaatttctacctcttttatgaggtactgtatgtgaccaatacaaggtcacatacagtattctgattatatttataaaataaaawaaatttctacctcttttatgggaaaaaatccaaggttaacttagtttaaggtaaaccttaactaacatgtcagagcttgtgtcctaaaaacataataagtattcattgcctggttatcatttaaaaggcatattctttagctccataaactgctgcattcttccctgaggaaaatatcgaacaaaataaacagagggacaaagtagaaataaaagttagcttgatatgataaagtaaaattatttaatgtggttgcctataaaagtatctaatttcttaagaaaaagagtcagaattgaa

SEQ ID NO: 96031 - DNA, 601 bp, Human
accatgctttagtttatttattaattagaatatctgagtatttaccacgggtaaaggaaatgttctttaataatcatgacttggaccttttatttatgacaaataacattctctttaattctttgaagttagtctgtatatatctttttatttaaaacatctgtgggcagagttatttatgattacaaaggaaactcagactgttgactgctagagaagactggttaacatttcttatcattcaacatgtggaccatgggtatccattgttggatatagttttaaatatgattatattcckcaagatcattttgacctataaaaactttaatttgaaaccatcaccctaatgtggaatcagcgttcttggaggtaacttgtactagagcactctgcttggtactcaaaactactccattgtggttaactcattctgcctgttccccaggggccatttatatgagtcacaatttagttaatgatatgtggtaacccaaaaaatgttaaattatggttggaagttttttctaagcaaatgtaatgttccgctatattactatataaattcagaacaaggtcacatacagtattctgattatat

SEQ ID NO: 96032 - DNA, 601 bp, Human
tatggtaacatcaccctttatgaaaatcacacaccatgctttagtttatttattaattagaatatctgagtatttaccacgggtaaaggaaatgttctttaataatcatgacttggaccttttatttatgacaaataacattctctttaattctttgaagttagtctgtatatatctttttatttaaaacatctgtgggcagagttatttatgattacaaaggaaactcagactgttgactgctagagaagactggttaacatttcttatcattcaacatgtggaccatgggtatccattkttggatatagttttaaatatgattatattccgcaagatcattttgacctataaaaactttaatttgaaaccatcaccctaatgtggaatcagcgttcttggaggtaacttgtactagagcactctgcttggtactcaaaactactccattgtggttaactcattctgcctgttccccaggggccatttatatgagtcacaatttagttaatgatatgtggtaacccaaaaaatgttaaattatggttggaagttttttctaagcaaatgtaatgttccgctatattactatataaattca

SEQ ID NO: 96033 - DNA, 601 bp, Human
ccatagtagataaacactcatacaatattaaatttttaagaagggaaacacaaatatagaactgacaaggcagtaaaagtagtttagggttgttacaggaacttgggatgacacatcttatatttgttcagcctatgatgagacagatatcaaatgatactaaagatagagaaaaaaggaattcagataagaaaactgtaagggactctcatccagttagaggtggttaagatgattaattaattaactgatagttactgtttaaaattagtcaataattattttaagaattttacaagtrcatttcataattatttaattcttatgacaactctattatccccattttacagatgatgaaataaaggcaaagaaagattaattatcttgcccaaggacacatagccagaagttaccaaatttggattctaacccagataatttaattaaagacctttctaaaagtagaaaaaggttatggtaacatcaccctttatgaaaatcacacaccatgctttagtttatttattaattagaatatctgagtatttaccacgggtaaaggaaatgttctttaataatcatgacttggaccttttat

SEQ ID NO: 96034 - DNA, 601 bp, Human
ggcaaaaatgtggctctacaaattactaaacttgacacaatgattgaatccaggtaaacctacgtattcttagtttaaatggaattatatctactgtgttagattgttctatgaagattaagtgaaatattagacataaaaaattatatacagtatttcatccatagtagataaacactcatacaatattaaatttttaagaagggaaacacaaatatagaactgacaaggcagtaaaagtagtttagggttgttacaggaacttgggatgacacatcttatatttgttcagcctatgatsagacagatatcaaatgatactaaagatagagaaaaaaggaattcagataagaaaactgtaagggactctcatccagttagaggtggttaagatgattaattaattaactgatagttactgtttaaaattagtcaataattattttaagaattttacaagtacatttcataattatttaattcttatgacaactctattatccccattttacagatgatgaaataaaggcaaagaaagattaattatcttgcccaaggacacatagccagaagttaccaaatttggattctaacccagata

SEQ ID NO: 96035 - DNA, 601 bp, Human
ggatatactggaaaagccacatgttcttacgttagagataacaggcaaaaatgtggctctacaaattactaaacttgacacaatgattgaatccaggtaaacctacgtattcttagtttaaatggaattatatctactgtgttagattgttctatgaagattaagtgaaatattagacataaaaaattatatacagtatttcatccatagtagataaacactcatacaatattaaatttttaagaagggaaacacaaatatagaactgacaaggcagtaaaagtagtttagggttgttacrggaacttgggatgacacatcttatatttgttcagcctatgatgagacagatatcaaatgatactaaagatagagaaaaaaggaattcagataagaaaactgtaagggactctcatccagttagaggtggttaagatgattaattaattaactgatagttactgtttaaaattagtcaataattattttaagaattttacaagtacatttcataattatttaattcttatgacaactctattatccccattttacagatgatgaaataaaggcaaagaaagattaattatcttgcccaagg

SEQ ID NO: 96036 - DNA, 601 bp, Human
gcaggcaccaaagaacaaaaagaagaaagaaaattggatataggatatactggaaaagccacatgttcttacgttagagataacaggcaaaaatgtggctctacaaattactaaacttgacacaatgattgaatccaggtaaacctacgtattcttagtttaaatggaattatatctactgtgttagattgttctatgaagattaagtgaaatattagacataaaaaattatatacagtatttcatccatagtagataaacactcatacaatattaaatttttaagaagggaaacacaaakatagaactgacaaggcagtaaaagtagtttagggttgttacaggaacttgggatgacacatcttatatttgttcagcctatgatgagacagatatcaaatgatactaaagatagagaaaaaaggaattcagataagaaaactgtaagggactctcatccagttagaggtggttaagatgattaattaattaactgatagttactgtttaaaattagtcaataattattttaagaattttacaagtacatttcataattatttaattcttatgacaactctattatccccattttacagat

SEQ ID NO: 96037 - DNA, 601 bp, Human
aggaatttatatcttaagggaatgatggcactacattggccatacacaaactgtgtcctattgtcaaggtgactaagctcttcacatatagtaagaaaagcaaaacaaaaacaaaacaaaattttaataccaccaaaaaacaaaagaactcatcttgctgcctaaggaaaaagcaaaaatagtagttattctgatttgttctgatctctcaaataatgaaattttgaaatttcagaaatgttcataaacctgagttccataagcatagtaactttacatcttacttttgctatgctgatayctgaagatatacaaaagtctttgtgataatgctgctatttttctaccatgaactgtaaacttggtaatatttgccattttgtggtttctatctttaaatacttttatctttctattcacaaacatgaaaaattgcttaacatcagtaaccatcagagaaatgcaactcacaaccacattgagatatcatcttacatcattcagaatggttactattaaaaagtcaaaaacaacagatgtcatggatgcataaaatagagaacacttatacactgttaatggagatgtaaattcattcgac

SEQ ID NO: 96038 - DNA, 601 bp, Human
gcactggggcaccaacaaatggatttaagcccgtaagtgactggattagcatggacctgaggggttaatgctgggaaatcagttaagaagtgactgtcacaatttaattgagagatgattgtggagaagatagcagttggagaagagagaaagtagactaaattatagtacggaggagctaagtagggttgagctctactgctgaaagagacaaaaaggtctatggcagggacaagctttggtgttgaaagagaacaagaagtctatggcaggaactaaaattcaaatgccttcatagatkagacaggtaaattaacaggtaccccagtggtgaaagagggagtggtggagactgtcgtaaacagagggtgcaggccccacttaaaggcatccagttactcattatctaaaacactggctcgtcaaaagaaaccactgtgggatatatttgaactctaagccatgagttcaacagacagtgattctaaccctggctactcatttgaatcattagggcagctaggcccaaaccctggcattacttctcaaacattaatggctccaggctggagtacgcacatagatacatatttaaaagcta

SEQ ID NO: 96039 - DNA, 601 bp, Human
aggagccttcttggaaaaagttcacatatttagttatatatttaccactgggttcctgtcttttctgatttgttctgttctacaagtaaattgacatgtctattagttaaatagaagccgaaatcttatctaatatcaccaataaaattcacaattgcaaaaaaataaggcaatatacaataaacaaacaactacatgggggggaaagccagaggaaaattagaaatacattactatttttctccagttaattggattgtgggggtgcggttcctcttttttttttttttttttttttgcmttttccaaatcatccatatttatctgtactattataattttagttgtttcagtgtgggtgttttcagattacatattacagaaagtttttgttttagtatgaaattgtttgttgccactaaccacagacatttgacttaaattacagtggcttaattaaagctaaatggaaagttgtctgtaggaatgtcaaatgcaaagttgtctgtaggaatccagtagagattaacaaaacagaagaatacttcgttcacaaattaaatcgttatttcagtatttattgagtgtgttgggtactgtt

SEQ ID NO: 96040 - DNA, 601 bp, Human
ctaggagccttcttggaaaaagttcacatatttagttatatatttaccactgggttcctgtcttttctgatttgttctgttctacaagtaaattgacatgtctattagttaaatagaagccgaaatcttatctaatatcaccaataaaattcacaattgcaaaaaaataaggcaatatacaataaacaaacaactacatgggggggaaagccagaggaaaattagaaatacattactatttttctccagttaattggattgtgggggtgcggttcctcttttttttttttttttttttttrcattttccaaatcatccatatttatctgtactattataattttagttgtttcagtgtgggtgttttcagattacatattacagaaagtttttgttttagtatgaaattgtttgttgccactaaccacagacatttgacttaaattacagtggcttaattaaagctaaatggaaagttgtctgtaggaatgtcaaatgcaaagttgtctgtaggaatccagtagagattaacaaaacagaagaatacttcgttcacaaattaaatcgttatttcagtatttattgagtgtgttgggtactg

SEQ ID NO: 96041 - DNA, 601 bp, Human
cttctccatttctgaggtcactttttcacccaaccacctgacaatacaggtggatgtagcagaaacctactgttctgccgcctaccgggccatcctattgtctaggagccttcttggaaaaagttcacatatttagttatatatttaccactgggttcctgtcttttctgatttgttctgttctacaagtaaattgacatgtctattagttaaatagaagccgaaatcttatctaatatcaccaataaaattcacaattgcaaaaaaataaggcaatatacaataaacaaacaactacatgggggggaaagccagaggaaaattagaaatacattactatttttctccagttaattggattgtgggggtgcggttcctcttttttttttttttttttttttgcattttccaaatcatccatatttatctgtactattataattttagttgtttcagtgtgggtgttttcagattacatattacagaaagtttttgttttagtatgaaattgtttgttgccactaaccacagacatttgacttaaattacagtggcttaattaaagctaaatggaaagttgtctgtaggaatgtcaaatgca

SEQ ID NO: 96042 - DNA, 601 bp, Human
ggttccttgaggactgatgtcagcttagcttttgtgtcttccctgttaagcttcagagtccacacctgaaccaaaaaccactaattcctctgaggtccttccagaaaactgcagacagacttactcaacaactgaggttgccaaaccccaaactacatctctcctcgaggacatctctgtgaagtacttactacatgtggtataattgtgtatttactttttcaaatttatcattaactggatcttattcatcgtggaatttgtagtgcccagtatggtgtttggcacaaagtaggtactktgaataagtgaatgtgtattatcacctagtggctgtgaccactttttccatttacactatctgcctgccagaatacaccctattcccgctgtctagcccactctgaagctgaccatatgctgtctctccagtatacatttctgttaagtaaacttctccatttctgaggtcactttttcacccaaccacctgacaatacaggtggatgtagcagaaacctactgttctgccgcctaccgggccatcctattgtctaggagccttcttggaaaaagttcacatatttagttatatatttac

SEQ ID NO: 96043 - DNA, 601 bp, Human
acagagggaatgcatatcctgtgaaaagacagagacacagggagagcatcatttgaagatgaaggcaggaattggagaacttcatctacaaggccccaaagcttgcccgcaaacctccagaggccaggagagaggcatggaacagattcttcgtcacagccctcagaaaaaaactcatcctgtggaaaccttgactttggacttccagcctcaataaggtaatattaaggctaatgttaagaataatagtaataattagacttctgttgcagcccttgaaccaagttcccacctggttccytgaggactgatgtcagcttagcttttgtgtcttccctgttaagcttcagagtccacacctgaaccaaaaaccactaattcctctgaggtccttccagaaaactgcagacagacttactcaacaactgaggttgccaaaccccaaactacatctctcctcgaggacatctctgtgaagtacttactacatgtggtataattgtgtatttactttttcaaatttatcattaactggatcttattcatcgtggaatttgtagtgcccagtatggtgtttggcacaaagtaggtactgtgaata

SEQ ID NO: 96044 - DNA, 601 bp, Human
ttgaagtcattagccccagagcctaagaatgtgactttatttggaaataaggtttttacagagacaatccaagtttaagtcatgaggctagtccctaatccaataggactgatgtccttataaaaagagaaatttgggtccagagaaggatatgcacagagggaatgcatatcctgtgaaaagacagagacacagggagagcatcatttgaagatgaaggcaggaattggagaacttcatctacaaggccccaaagcttgcccgcaaacctccagaggccaggagagaggcatggaacagwttcttcgtcacagccctcagaaaaaaactcatcctgtggaaaccttgactttggacttccagcctcaataaggtaatattaaggctaatgttaagaataatagtaataattagacttctgttgcagcccttgaaccaagttcccacctggttccttgaggactgatgtcagcttagcttttgtgtcttccctgttaagcttcagagtccacacctgaaccaaaaaccactaattcctctgaggtccttccagaaaactgcagacagacttactcaacaactgaggttgccaaaccccaaa

SEQ ID NO: 96045 - DNA, 601 bp, Human
ttgttatgggttgaattgtgtctccccaaaaatatatgttgaagtcattagccccagagcctaagaatgtgactttatttggaaataaggtttttacagagacaatccaagtttaagtcatgaggctagtccctaatccaataggactgatgtccttataaaaagagaaatttgggtccagagaaggatatgcacagagggaatgcatatcctgtgaaaagacagagacacagggagagcatcatttgaagatgaaggcaggaattggagaacttcatctacaaggccccaaagcttgccygcaaacctccagaggccaggagagaggcatggaacagattcttcgtcacagccctcagaaaaaaactcatcctgtggaaaccttgactttggacttccagcctcaataaggtaatattaaggctaatgttaagaataatagtaataattagacttctgttgcagcccttgaaccaagttcccacctggttccttgaggactgatgtcagcttagcttttgtgtcttccctgttaagcttcagagtccacacctgaaccaaaaaccactaattcctctgaggtccttccagaaaactgcag

SEQ ID NO: 96046 - DNA, 601 bp, Human
aaagaaaatatattttgtactttaaggagttaatgaagtgcagctaagagaagacaaaaataaaagtttatacagtacaggaagactaaatgaatttgtgggctttaagagcatttttataaagggcttcaggatatttaaatatattttaatgtatttgattgcattttgacttttgagcctcaccatcagctaaatcccttgtcagcctatgactccaatcctgcaattgtttcccaaaaactgaaggagttctagacaaatcagtgttattattctgaatcaccctttttaaaaacawtcctttgttttttgtgcatatgatattgttatgggttgaattgtgtctccccaaaaatatatgttgaagtcattagccccagagcctaagaatgtgactttatttggaaataaggtttttacagagacaatccaagtttaagtcatgaggctagtccctaatccaataggactgatgtccttataaaaagagaaatttgggtccagagaaggatatgcacagagggaatgcatatcctgtgaaaagacagagacacagggagagcatcatttgaagatgaaggcaggaattggagaactt

SEQ ID NO: 96047 - DNA, 601 bp, Human
ttctgtggtaaggcaagatgatctctatgctttttaagagaaaatcatgaacttaatagaaatgcaatattgagttaaaaatcttcttaaatattatattatccatttttcctaaaggaagaatttattattttaactttaatataagcatgcaatttcagagctgataggaatataagaagtaactaccctgaacttctttgtctgtggataagaaaatatgctcataagagtccgtgacagaccaggaaaagaatgtagttatctaattgctaaaccaggactctccttcaaaactacrcagccatgtctgttccaggttctgtgcagactataaacttgttctcataagccaaaatgtgctgaccgaattctccaagcacattatctgtgatctaccttccaataatgcacatacttctttttcataataaaagtactttcatttacctattaaagtgaagatcaggcaaattacccaaagttgtaaagctaatctgatacttacgcgttaaatcacaaaagatattttataattctaaaatattagttttattttcaaattcaatttaaatgtatggacaatttccccttctcctgg

SEQ ID NO: 96048 - DNA, 601 bp, Human
aaatcttggcaaaaacaaagcgtcttttaaagtttctctgagggggaaccaagtttgtgtgagataagctgtgctttcagagccctgattggaaagacccacaggggaacacctaatctgtgtctctgtctctgtaaggaatgaggactcacccaccttggacagctggttgtccattccactaaaggattttcagattgacgtgtgcaaaggcataaatgggagaattaacacaaaatcaaaagagcaaagggactgaattcggactgaaattagcatattaatgcctcattcctgttamcctagggagaaatccagttcctcccagttgaagtgttgatttacagaccctgtactgtatgctagcattttattatccccctcagaaatggcatcacaacacttcttagtgaagcagctggacccttgggccctagggagctgttcataatggcagacagccactgaagctccttggacagaaacttcaaactttggcaagactgtgctcaaataccaagttttgaaatgactttcaacacagcaatgcaacaatcagcaactgccttggtaatcactctaaaataaaaatcacctatag

SEQ ID NO: 96049 - DNA, 601 bp, Human
atgatgtcaataagctaatgactagtggatgctaagcaaataattacaaaggtgggtaactgcagggagtcgaactgctatgaagaaaatatgtaaggtggaatgttgatgtatgaaatgacctaatctaatctgtttgttaggggaagagcccttggcagaaatgacatttaagagtatgagaaatgagaagaaattagcctagtaagagattaggagggaaaaggggaagagaccaatttccagttcagaagttgaagcaggatgtctcttttgggcatattattatacctatcataayattataataccctgacttctcttttgaacctttagattttatatttttatgtctcatattaacctttctaacatgaaaattcgatatcattgactcctctgttacaaatattagtgcctcctcactgcttagtatggtatctgtcacatagtgggtgctatatcaaaataaaaatattttactgctctagtgatctgacattttcttaccaaccccatgtttaccaacccaatgtcatctacaaagaatttctccttgaactttatattctcattataactaaatgctagtagctccaca

SEQ ID NO: 96050 - DNA, 601 bp, Human
taattttctgatcttgaagcaaagaactatcaacttaaacagtatgtgttaatcgtctacagaaacattctacactaaatgttttaaaaaatatactggaataagactataaaataccaaatctttccaacaaaaataaaatttaatttaatatgagcagtgatctcatcaattattacaacaggactaaaatttaagtcataatcttaccccataccttagtcataattcttattcattatccatgctagaaacatgagactcatcccaatttgtctttctcttatatttttccttttcrttcattcaccacgctctttcaatcatgtctttttgatattcctcttcctcattttcttttatccaatattattttccctaactatcatttatttatacaagaatatagaaagaacacttgctatgtgctaaagactctcctcaacaagatagagttcattcctgtcgccatgatgtcaataagctaatgactagtggatgctaagcaaataattacaaaggtgggtaactgcagggagtcgaactgctatgaagaaaatatgtaaggtggaatgttgatgtatgaaatgacctaatctaa

SEQ ID NO: 96051 - DNA, 601 bp, Human
tttttcttttcctttttctttttctttgtgtgtaactgaaaagaaacagataaatagttttcatttaaataacaggaataaatgaggagatgtttgcacggcagtctttgatgtcaaaatttatcttctgtttttagaaatctttctttaactggattcagattttatgtagttagaggtttaaacttcaagataattacagatttatttcctatttctattttatttcatatccaagcacaaactagtacccaaaccaagtctgattgcaaagataagaatacccccgtcagcttttccraatctttaattgaaataattggaaaattttaaaaaattattatgccatatgccaaaggagcccggctttgatattggatgaatgcttgaaatatgaggatgaaaatatagagacataattttctgatcttgaagcaaagaactatcaacttaaacagtatgtgttaatcgtctacagaaacattctacactaaatgttttaaaaaatatactggaataagactataaaataccaaatctttccaacaaaaataaaatttaatttaatatgagcagtgatctcatcaattattacaacagg

SEQ ID NO: 96052 - DNA, 601 bp, Human
taagaaaacatgacaccttcaaaggaacacaataacacgccagtaacaggcctccaaaaaagggaaatctatgaaatgcctttcaaaataataatcttaaggaaactcagagagaaaaaaagagaacacaaataaaaaatacaaaggaaggagaaaaataattcatgatctgaatgtgaaattcagtaaagagatagatatcataagaaagacccaaacagaaatcctagaaatgaagaacttaatgaataaaataaaaattaaattaactttaacaattaactagattatcaggaaaaawtacagtggaagaacattctcatttaaacactatgcagctttttaaagagaatgaggacaatatttagtgatatgagaagatttcaggatatattgttaaattgtaaaagtcagattataggacatactagattttgtgtaaaaatagggaggaaaataacatggattatctggaaaacatacaataaagctctggaaggatgcatgtaaaattcacatgagtggtctactgtatgtgggtttggcatgaaatgggagccagtaggctgggagcaaggtgagaggaaggttttcacaaagt

SEQ ID NO: 96053 - DNA, 601 bp, Human
agaaagaaaaactaagaaaacatgacaccttcaaaggaacacaataacacgccagtaacaggcctccaaaaaagggaaatctatgaaatgcctttcaaaataataatcttaaggaaactcagagagaaaaaaagagaacacaaataaaaaatacaaaggaaggagaaaaataattcatgatctgaatgtgaaattcagtaaagagatagatatcataagaaagacccaaacagaaatcctagaaatgaagaacttaatgaataaaataaaaattaaattaactttaacaattaactagatkatcaggaaaaattacagtggaagaacattctcatttaaacactatgcagctttttaaagagaatgaggacaatatttagtgatatgagaagatttcaggatatattgttaaattgtaaaagtcagattataggacatactagattttgtgtaaaaatagggaggaaaataacatggattatctggaaaacatacaataaagctctggaaggatgcatgtaaaattcacatgagtggtctactgtatgtgggtttggcatgaaatgggagccagtaggctgggagcaaggtgagaggaagg

SEQ ID NO: 96054 - DNA, 601 bp, Human
aagccagaaagaccacaagaaaatgtcagcatatctaaccacctaaaaattcaagaatctaaacatatgcacacatgcatacatacatacatgaactcacacatgtccgttcacaaagacagaaagcataatattaactgtgaaacaaattcagaaaaatatttgaaaataagttatagatgaagggtatacatacccaaaacacacacacacacacacacacacacacacacatatcattaggagaaatgggcagtgagtgtgaacagttacacatgatatatacattgctaaaaaccayatttgaatctttcaacttataaatagtaagcagttaaaaatactttgcagagacatggatgaagctggaagccatcattctcagcaaactaacacaggaacagaaaaccaaacactgcatgttctcactcataagtgggagtgaacaatgagaacacatggactcgggggtaacatcacacactggggcttgtcaggggtttgggggcaaggggagggagagcattaggacaaatacctaatgcacgcaaggcttaaaacctagatgacaggttgataggtgcagcaaaccaccatggca

SEQ ID NO: 96055 - DNA, 601 bp, Human
ggactacattataataacatatctcctaaaaagcaaacatcctttaattggcataaggtaaataaaagagcacttacaatgcagcattttatttctgcttttcaatttgaatacatttttttctgcagcacttataatttaagggcaaaaattcctaactttttttttaacagaaaacatttagctactgtaaagtttggaaaaaaaatcacaagaaatagcagattatttcattgagtcagaatacacagagcctagtgctaataattctgcttaacccaatatcagacaagaaatggtyacctatttctagaacagagaaaggagatggctatattgaagttcatggaaattgaacatgaagaaaataagataagaaaataagaaaataaacatgaagaaaataacaattatttaattgaaattttcttttttttctgtaggttattggggtccaggtggtatttggttacatgagtaagctttttagtggtgattggtgagattttggtattttcaagtgtaaatataccataaaaaatattgaagcatatttcaacttatctgattcctaaatgtcataatgtgttctacctaactg

SEQ ID NO: 96056 - DNA, 601 bp, Human; identical to SEQ ID NO: 33851

SEQ ID NO: 96057 - DNA, 601 bp, Human; identical to SEQ ID NO: 33852

SEQ ID NO: 96058 - DNA, 601 bp, Human; identical to SEQ ID NO: 33853

SEQ ID NO: 96059 - DNA, 601 bp, Human; identical to SEQ ID NO: 33854

SEQ ID NO: 96060 - DNA, 601 bp, Human; identical to SEQ ID NO: 33855

SEQ ID NO: 96061 - DNA, 601 bp, Human; identical to SEQ ID NO: 33856

SEQ ID NO: 96062 - DNA, 601 bp, Human; identical to SEQ ID NO: 33857

SEQ ID NO: 96063 - DNA, 601 bp, Human; identical to SEQ ID NO: 33858

SEQ ID NO: 96064 - DNA, 601 bp, Human; identical to SEQ ID NO: 33859

SEQ ID NO: 96065 - DNA, 601 bp, Human; identical to SEQ ID NO: 33860

SEQ ID NO: 96066 - DNA, 601 bp, Human; identical to SEQ ID NO: 33861

SEQ ID NO: 96067 - DNA, 601 bp, Human; identical to SEQ ID NO: 33862

SEQ ID NO: 96068 - DNA, 601 bp, Human; identical to SEQ ID NO: 33863

SEQ ID NO: 96069 - DNA, 601 bp, Human; identical to SEQ ID NO: 33864

SEQ ID NO: 96070 - DNA, 601 bp, Human; identical to SEQ ID NO: 33865

SEQ ID NO: 96071 - DNA, 601 bp, Human; identical to SEQ ID NO: 33866

SEQ ID NO: 96072 - DNA, 601 bp, Human; identical to SEQ ID NO: 33867

SEQ ID NO: 96073 - DNA, 601 bp, Human; identical to SEQ ID NO: 33868

SEQ ID NO: 96074 - DNA, 601 bp, Human; identical to SEQ ID NO: 33869

SEQ ID NO: 96075 - DNA, 601 bp, Human; identical to SEQ ID NO: 33870

SEQ ID NO: 96076 - DNA, 601 bp, Human; identical to SEQ ID NO: 33871

SEQ ID NO: 96077 - DNA, 601 bp, Human; identical to SEQ ID NO: 33872

SEQ ID NO: 96078 - DNA, 601 bp, Human; identical to SEQ ID NO: 33873

SEQ ID NO: 96079 - DNA, 601 bp, Human; identical to SEQ ID NO: 33874

SEQ ID NO: 96080 - DNA, 601 bp, Human; identical to SEQ ID NO: 33875

SEQ ID NO: 96081 - DNA, 601 bp, Human; identical to SEQ ID NO: 33876

SEQ ID NO: 96082 - DNA, 601 bp, Human
tttaactcaaaatccttccccattgttttgaatattaattccaagattatctatctccaacaatagttctttggagtggctaaaccaagttcatgcataagggagaaaattttaaagttttggaaaacaaagtataaatatttgaaatgtgatgattttaatatgaattgtgttcactactaagaaaagaaagatattttcattgtcgtgggtcttttcttctaagtttaccaagaataaaataagatgattcactgcttcacttcaagacattattaaagattttagcattccttatatrgagagatattagcacatattttacatttcaactgacttcatttgcaataggccatgcagtgactgaaagtaaaattaagaccttaatgccagttattaccgctttttattggttttattctagatctacacatgcattatgcaatttttaaaaaatgaaaatacagttaggtacataaaaagcccacaatcttagaaacaaagactattaaaacagacaagtacaagaattgcttggaatacctggttttaaatccccatggacaaatatgtcaatcatatatcgacagaatgcatactg

SEQ ID NO: 96083 - DNA, 601 bp, Human
ctaatataaatgagctccttccttaacaatactgtcttcttggaaaagttttcccaaacatgaacatagttctgtcagtttttaaatctgcaaaaggcatagtacaagcaatcaagttactcatgcttagttcagatgttagtaaaaaatacctttttatactctgggcaacaattaaagatacaagacaaggtagatatattcctttaactcaaaatccttccccattgttttgaatattaattccaagattatctatctccaacaatagttctttggagtggctaaaccaagttcatgyataagggagaaaattttaaagttttggaaaacaaagtataaatatttgaaatgtgatgattttaatatgaattgtgttcactactaagaaaagaaagatattttcattgtcgtgggtcttttcttctaagtttaccaagaataaaataagatgattcactgcttcacttcaagacattattaaagattttagcattccttatatagagagatattagcacatattttacatttcaactgacttcatttgcaataggccatgcagtgactgaaagtaaaattaagaccttaatgccagtta

SEQ ID NO: 96084 - DNA, 601 bp, Human
aatatagctgtctttaagcaattagcttcatttattctaatataaatgagctccttccttaacaatactgtcttcttggaaaagttttcccaaacatgaacatagttctgtcagtttttaaatctgcaaaaggcatagtacaagcaatcaagttactcatgcttagttcagatgttagtaaaaaatacctttttatactctgggcaacaattaaagatacaagacaaggtagatatattcctttaactcaaaatccttccccattgttttgaatattaattccaagattatctatctccawcaatagttctttggagtggctaaaccaagttcatgcataagggagaaaattttaaagttttggaaaacaaagtataaatatttgaaatgtgatgattttaatatgaattgtgttcactactaagaaaagaaagatattttcattgtcgtgggtcttttcttctaagtttaccaagaataaaataagatgattcactgcttcacttcaagacattattaaagattttagcattccttatatagagagatattagcacatattttacatttcaactgacttcatttgcaataggccatgcag

SEQ ID NO: 96085 - DNA, 601 bp, Human
aacactaaaaatgaggtagagttcaattatttgctcaagacctaatactagaaaaggatggagttaagaattatcactgtatttctgtccaaagccttgtctttccaccatatcacactaccttcctgaaggtttatttccaattatgctatgatactatacacaaacatcgatattattaatatattattaataatatatatcattaatattattaatattaatataatatattaatatataatatatataattattatatataatatatatttataaattataatatatatttagtgaytttccccctcatttaaatttcttactgaaaatgtagaagaaggaaaaggggaggaggaggaaattatttaactagaataaattactgggatcaacaacattttccggagtgcaaaggttctcattgtctagttttctagagcctagatgtgttacctatttgttttagaaatgagatgtctctttgatgacatacacataaattataattatatatttttgaaaggctttcacaaaaatagttaagaaaataaaaatatagctgtctttaagcaattagcttcatttattctaatataaa

SEQ ID NO: 96086 - DNA, 601 bp, Human
gatttgtcaacaatgcaaggttgtgactgtgatctttattttaaatgtaagaacactaaaaatgaggtagagttcaattatttgctcaagacctaatactagaaaaggatggagttaagaattatcactgtatttctgtccaaagccttgtctttccaccatatcacactaccttcctgaaggtttatttccaattatgctatgatactatacacaaacatcgatattattaatatattattaataatatatatcattaatattattaatattaatataatatattaatatataatatatrtaattattatatataatatatatttataaattataatatatatttagtgattttccccctcatttaaatttcttactgaaaatgtagaagaaggaaaaggggaggaggaggaaattatttaactagaataaattactgggatcaacaacattttccggagtgcaaaggttctcattgtctagttttctagagcctagatgtgttacctatttgttttagaaatgagatgtctctttgatgacatacacataaattataattatatatttttgaaaggctttcacaaaaatagttaagaaa

SEQ ID NO: 96087 - DNA, 601 bp, Human
gtttgtagtcactagatgatttgtcaacaatgcaaggttgtgactgtgatctttattttaaatgtaagaacactaaaaatgaggtagagttcaattatttgctcaagacctaatactagaaaaggatggagttaagaattatcactgtatttctgtccaaagccttgtctttccaccatatcacactaccttcctgaaggtttatttccaattatgctatgatactatacacaaacatcgatattattaatatattattaataatatatatcattaatattattaatattaatataatatrttaatatataatatatataattattatatataatatatatttataaattataatatatatttagtgattttccccctcatttaaatttcttactgaaaatgtagaagaaggaaaaggggaggaggaggaaattatttaactagaataaattactgggatcaacaacattttccggagtgcaaaggttctcattgtctagttttctagagcctagatgtgttacctatttgttttagaaatgagatgtctctttgatgacatacacataaattataattatatatttttgaaaggctttca

SEQ ID NO: 96088 - DNA, 601 bp, Human
tttaaatataattttcttcatgtttcaacttaatatagagtaagtcagtacaagagaattttgattcaatacaaccaaatgagcagatctttataatttatactggtttattaagatggtccctataattgaagtgaggattatccctgaccctaggatagtgcatattcaccattcacaacagaaaatcagaaagagcaattcaattaatcttcaggtttatagacgaaatcttagctaaaaattttaagaatatcttagaagcattttatttgatgggataaaaggcaaaacttgggayttatgtcatagtgtcagcacatttcatcagcaagcgttttcaaattagaactgcaatttgggttacttttgagggtgtgacagtacaaaggaaaaactgaatcccagagggaaaaatcaaattatagttttaaaaactcattaccaataattaatagtgaactctagctaaacaatacaggtgttacactaatcccaaacagaaacagatggaagcgcaaatgttttataagtagtggatacatgcagagcaataaacttggcaagaattgtcttattctataattgccagtcagagtca

SEQ ID NO: 96089 - DNA, 601 bp, Human
agtaagtgacaagtagactactttaagccctaggaaaaaaagtggaggttaatcagtttcaagacagctaccataagacgaatcaatctctttctttctgtctcaatctctccccgactctcctctctctgtcttccctaaggcaggttatgagttattaaaacacatcctgtataacgctgaccatcggcacaaccaaagatctcaatatgaagatgttaggtcattaaatggagaaagtatctctggagaggggagatcttcggtgttcataatatacctaaaattacaaaatgtacayacaggtctatgccagttgcccataggaccagtgttgatagcatgcattcacttcctagatttaaatataattttcttcatgtttcaacttaatatagagtaagtcagtacaagagaattttgattcaatacaaccaaatgagcagatctttataatttatactggtttattaagatggtccctataattgaagtgaggattatccctgaccctaggatagtgcatattcaccattcacaacagaaaatcagaaagagcaattcaattaatcttcaggtttatagacgaaatcttagctaa

SEQ ID NO: 96090 - DNA, 601 bp, Human
aaaagaaaaaaacccataaattgtgttttgatgttgcaaataatgtctgtcttgaccagttttaatagttctcttatgagtaagtgacaagtagactactttaagccctaggaaaaaaagtggaggttaatcagtttcaagacagctaccataagacgaatcaatctctttctttctgtctcaatctctccccgactctcctctctctgtcttccctaaggcaggttatgagttattaaaacacatcctgtataacgctgaccatcggcacaaccaaagatctcaatatgaagatgttagktcattaaatggagaaagtatctctggagaggggagatcttcggtgttcataatatacctaaaattacaaaatgtacatacaggtctatgccagttgcccataggaccagtgttgatagcatgcattcacttcctagatttaaatataattttcttcatgtttcaacttaatatagagtaagtcagtacaagagaattttgattcaatacaaccaaatgagcagatctttataatttatactggtttattaagatggtccctataattgaagtgaggattatccctgaccctaggatagtg

SEQ ID NO: 96091 - DNA, 601 bp, Human
gatttttttcagaagtctaaagcaaagctaaatggtacctagtcttgtctaatacaagcagtgagctctgaaatacattaaaccattaaataacagtgactataatgcaattacatttgacctcttctcagcgagatttaaccaaaaatatagttaagcaccactaaagttcaagaaaaggatcttaataaaatgagagtactaacttattccttgaggctctttctagctatggacttaaaacccattgaattggaatgcaggctgccaaagaatgccttattacaatcagagaagattytgataggtgagtaccctcaatttaaagaaaacaaatgacacaaaaagcagaataaattaccgtgacataattcttggctcaagtaaaagtcagacagtagctgaaattttaatagtggaataacttctaagggataaactttaacttgtattaaactttaatcataatagttacagagatgaaagctaaaaaaaattattaaaattactaagcacaagcacactagccctggtacttgtagtggacatttaaattggtttctttatctttagtgaatataaagaggtctgtgaaccatgt

SEQ ID NO: 96092 - DNA, 601 bp, Human
agtgacagaggaagatatttcaaaattattaaatgaatcagaagatgaatgcagaaagacagagagcagtaagctagactctaatgattagggtaaaattgaaattgattatacaagtgaaatctcagactatgagtcttcataagacaatgaattttcttaaactatagaatcaatgagtgaacaatgcatttcaaagagaaaaaaggaaatatactatagtagttccctcttatccataaaaaatgtattccaagatatccagtagatacctgaaacaatgaataatgctgaattctawgtatgctgtgttttcttgatctgaaaaccgagatacctaataagtgtctcacagacaggtagcttagagagcgtggatacatcggacaaagggatgattcacatacttggtggaatagagcgtgataacatgacatgctactcagaatggtgtccaatttaaaacttgtgagttgtttatttcaggaattttccatttgatattttcagactgtggttgactgtgggttactgaaactgcaaatagcaaaatcatggataagaggacacgactgtattctcatctagttagccctttaac

SEQ ID NO: 96093 - DNA, 601 bp, Human
cccttcttcacctctgacctttctccaaaactccacacttgattatctagctgcttacttcagttagaagtgctgtgaattatcattgcactatatagatgtcacagtttgctgtgagaattaatgagataagtatgcaaaaaaatggtaatgacccttggtatttggcagatgctaaacaaatgatatttggactagaatcttcacatacttcccttttgcagctagataccatctgtggcttgaataatatgtggtgagttcaaagtctcccacttctcccggccctgtccagtccagwgagcattgaccccactgtattcctatactcccttcttaaggtatccttttagtttttacagaccaacagcttctaaataatcttttactttcctatcttttgatatctataaatcccatgactctatctctgtgatagctctaaaagtatcttaattttctccatcacatattctatgatcaggctttatttcctttcgttggacttttccttgttgatctttttaatttcattctctccaaacgatcttgtacaacatttccaatcttgttttttttttttttttctagatttcctgag

SEQ ID NO: 96094 - DNA, 601 bp, Human
atctactaggaacttactagtactgttcctagaattcagaagacaaaccacatttgcctaaattctgcagggactacagaatttgtccatatgatcctcataacactacaaattatgtaatattattacccatgttatgcagtagatagtagaacaaaggctaggagacatcagatggctactatgggcaaaatgagtctggtatgttatttgttgatgtggttctgaaaaaatatttttctgtcattatcaaaattctacttgtaatagtcattatatatgtgctcaagcagtaaataaragccaacactcagagagccatgtgctgtaaatgcactttgaccagaaatacaaaaaaaaaggactcagccaaaggaggaaagaaagatatattgctccatttcaggttataaacaggtcaagttctagcagcttccttactgcattatatttttagtggatagtcatgcacatgtcactgttggtcctcctttaagtctagatctcatttaagtatccaccacatatgtgaaataaaattgtcaggatactttgtagaattttgagttgcaacattaatttcttaagtcacacatagtgc

SEQ ID NO: 96095 - DNA, 601 bp, Human
ctagagatataaccaataactcctttaagaaatctttacacaggtctatttgcaatgtttagaaatctgtcatcttttaaaataacaagattatttctacaaatgaataaaaattgctgctctgggatgatcatcaaattttttttcattgaaataaatattctacaccctgaacttaattcaacaaacatatcaggtttctggcaaggtatgaggcagtggagatttaaagacaaatatttattgaaggtatatataagcagcagaaaaagatgttctagggagagaataataatgctaygtgaatattaaatcagaaagctattagaaatgggtagaaaatcacaattctgctatatatgggaaccaccatccacaccaaacacttaaataatgcttattatggttattatagtcaagagggttttatgtgtatgtatatgctcattgcttaaaatatacattaaccctataaagttatctcattttatagatgaggaaagaggctcagaaagttaagtaacttgcccatgttcatttgaagtttttcttatataattaattctttttatgacactaattattctatttaatttttttc

SEQ ID NO: 96096 - DNA, 601 bp, Human
tctgagcttctgtctctagagatataaccaataactcctttaagaaatctttacacaggtctatttgcaatgtttagaaatctgtcatcttttaaaataacaagattatttctacaaatgaataaaaattgctgctctgggatgatcatcaaattttttttcattgaaataaatattctacaccctgaacttaattcaacaaacatatcaggtttctggcaaggtatgaggcagtggagatttaaagacaaatatttattgaaggtatatataagcagcagaaaaagatgttctagggagrgaataataatgctacgtgaatattaaatcagaaagctattagaaatgggtagaaaatcacaattctgctatatatgggaaccaccatccacaccaaacacttaaataatgcttattatggttattatagtcaagagggttttatgtgtatgtatatgctcattgcttaaaatatacattaaccctataaagttatctcattttatagatgaggaaagaggctcagaaagttaagtaacttgcccatgttcatttgaagtttttcttatataattaattctttttatgacactaattattc

SEQ ID NO: 96097 - DNA, 601 bp, Human
aaaagtcatagaattgactaaaaactgttgagcaacgggttgaatagtctataatcagtacaatcagtataatcatcaatgctacaatcagtaacgttaatgttaatattgcaaaattcatttttgtcttcatcttttgcaaatacaaaagcatcctctgcagaaaaaaaaagctatagaaaagagatattgtttatcaaatagctctctctgaaaatagccaattatttatatcaaaattttaggtatgggcatatttattatttccatatttaaaaatatgtccgcttaagaaaagggrtaagaactatgcatttatggaaatggttagaaagagtcctattctctattttgtatccactaggccacacaaataaaccttagaacagcactggaagaatatattcatgtaattttctagagttctttttcaatcttcacttgtgcatataaactaacagataagattattaaaatacatggtgcattaataaataacacataattatttcaataattctttgattaaaccttaattttccttgtttctcatgcagcaattcaaattactctgtattatttcttccttttcagactatat

SEQ ID NO: 96098 - DNA, 601 bp, Human
cacagtacctgacataccattagcactcagtaccacacgtgttacatctacttttattgtcctcatgttgtcatcgtgatcatctctgacaaacaatctccaaaacttcaaaaatccttaaagagtagaagcagaacaatatcttgagaactacctgagttttcctccaattccacttagcacgctaggccaggctctttgtaaatttcctttctcattatccttaaatgcaaggggataatttttaaaagctatcacatggcatgtgaaaaagggttgcttctctgttatttagagatckaattcctagaaaataaaatcaatttggcactttttaatcactctgttaaactatttccatactacttgatatttggcaaaaggaaggaatgttgcaactgtaatacctcccttccgctttgtttccacctgtgggaaaatgtctttcgtttttttctgttttttggctcctacacattcaaatattctgtgttcacaagaaattcaaagagacatgaaaagcgtaaagcagagctatacagccaattaaaaagaaatctggttttggagtttacctcagaaggagaaaaaagaacttgag

SEQ ID NO: 96099 - DNA, 601 bp, Human
cctctgtttttgaaaacatatttgtaatcctccctaagtcctggagaaaatatatagccatttgaaaaaattctataatttcccctggttcaatttcctaatttctgagttgaagaggttataacccacttcacagggctttgtgagaaatacataagatgatccatacctagaacttagcacagtacctgacataccattagcactcagtaccacacgtgttacatctacttttattgtcctcatgttgtcatcgtgatcatctctgacaaacaatctccaaaacttcaaaaatccttaragagtagaagcagaacaatatcttgagaactacctgagttttcctccaattccacttagcacgctaggccaggctctttgtaaatttcctttctcattatccttaaatgcaaggggataatttttaaaagctatcacatggcatgtgaaaaagggttgcttctctgttatttagagatctaattcctagaaaataaaatcaatttggcactttttaatcactctgttaaactatttccatactacttgatatttggcaaaaggaaggaatgttgcaactgtaatacctcccttccgcttt

SEQ ID NO: 96100 - DNA, 601 bp, Human
tattttcaaccatcagttatggtaacgcaatattcaaagttataatgaactcaagtttctgagatatcttttttcaatgtcaaaaatatttaacattttttatcaaaatagagatgcctattctctgaggtgttgaatggtagaagtggctatagaataaatatcattcatttcattagaaatccatttttctttatggcaaatatttaaaatattagatttatgtataaattgtttaggtccataattaaatatcattaaaaatgactgactttcataacagagtgacactccgtttccaaaaaaaaaaaaaaaagaatgactttcaagaaaaaacacaaaactttaagtaaaacttcaagctaaaatctcacgcttaatttatatccctcggcatgcccttcacctctcacatgttaacatactgactcactaataaataaataataactttattcatttaatttaatcgatccctgctatgaatacagaagagatatcagttctcataaggcggttgtttaccaacgaagttttcacaatgcatattcctgaatatgggtacattgaatacgtcatagcctctcaagttaaaatgtaa

SEQ ID NO: 96101 - DNA, 601 bp, Human
gagtgcttggtaaaatgtgaaatagtaccaaagatatacaacaaaactttaacttatatatttgtggtttttttccccaatcatttatagttctagaccaaagtatttattttctttctgggggaagtttactaatttatgagtagaacactaatctttcaaagaaagttatacatttttccatgattagtgggaaaaagtgaactaaagcttcaagatgaagaaagatagcttcattatttaaacagctctactaacatatagcacttgtaatatattctgaatatctataattccccasaagtggaaagactatgtcaattatctattgtgttatctttcagcctaatgaattctgcactcacatattaaacttgaagagtgttttagcgccagcagagttcactgagaacattgaaacacaaacaaaatggatgacttgccaaattcatccaactgacttacaactaggacccaagtatgcggagtcccagtgcagtgctcttatacaacagtatcctgtctttgagcttgcatttgcaggcattttcaaaagagcataggggacagggaatgaacaaaacataagatacaattttag

SEQ ID NO: 96102 - DNA, 601 bp, Human
aaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcaagccaaagcagggggaggcattgcctcagtcgggaagtgcaaggggtcagggagttccccttccgagtcaaagaaagrggtgacggacagcacctggaaaatcgggtcactcccacccgaatactgcgcttttccgacaggcttaaaaaacggcgcaccacaagattatatcccacacctggctcggagggtcctacgcccacggaatctcgctgattgctagcacagcagtctgagatcaaactgtaaggcggcagcaaggctgggggaggggcgcccgccattgcccaggctttcttaggaaaacaaagcagccgggaagctcgaactgggtggagcccaccacagctcaaggaggcctgactgcctctgtaggct

SEQ ID NO: 96103 - DNA, 601 bp, Human
gacttttgaaatcagccattctaataccctaatttttaagatagacaaaaaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcaagccaaagcagggggaggcattgcctcastcgggaagtgcaaggggtcagggagttccccttccgagtcaaagaaaggggtgacggacagcacctggaaaatcgggtcactcccacccgaatactgcgcttttccgacaggcttaaaaaacggcgcaccacaagattatatcccacacctggctcggagggtcctacgcccacggaatctcgctgattgctagcacagcagtctgagatcaaactgtaaggcggcagcaaggctgggggaggggcgcccgccattgcccaggctttcttaggaaaacaaagcagccgggaagctcgaac

SEQ ID NO: 96104 - DNA, 601 bp, Human
tttaagaatgtaaaagacttttgaaatcagccattctaataccctaatttttaagatagacaaaaaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcaagccaaagcagggsgaggcattgcctcagtcgggaagtgcaaggggtcagggagttccccttccgagtcaaagaaaggggtgacggacagcacctggaaaatcgggtcactcccacccgaatactgcgcttttccgacaggcttaaaaaacggcgcaccacaagattatatcccacacctggctcggagggtcctacgcccacggaatctcgctgattgctagcacagcagtctgagatcaaactgtaaggcggcagcaaggctgggggaggggcgcccgccattgcccaggctttcttaggaaaacaaagcag

SEQ ID NO: 96105 - DNA, 601 bp, Human
atcatagagtttaagaatgtaaaagacttttgaaatcagccattctaataccctaatttttaagatagacaaaaaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcaagccraagcagggggaggcattgcctcagtcgggaagtgcaaggggtcagggagttccccttccgagtcaaagaaaggggtgacggacagcacctggaaaatcgggtcactcccacccgaatactgcgcttttccgacaggcttaaaaaacggcgcaccacaagattatatcccacacctggctcggagggtcctacgcccacggaatctcgctgattgctagcacagcagtctgagatcaaactgtaaggcggcagcaaggctgggggaggggcgcccgccattgcccaggctttcttaggaaa

SEQ ID NO: 96106 - DNA, 601 bp, Human
atagaatcatagagtttaagaatgtaaaagacttttgaaatcagccattctaataccctaatttttaagatagacaaaaaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcragccaaagcagggggaggcattgcctcagtcgggaagtgcaaggggtcagggagttccccttccgagtcaaagaaaggggtgacggacagcacctggaaaatcgggtcactcccacccgaatactgcgcttttccgacaggcttaaaaaacggcgcaccacaagattatatcccacacctggctcggagggtcctacgcccacggaatctcgctgattgctagcacagcagtctgagatcaaactgtaaggcggcagcaaggctgggggaggggcgcccgccattgcccaggctttctta

SEQ ID NO: 96107 - DNA, 601 bp, Human
tattacatattttcgtattcactttgatggaaagcaagaatagcagccaaatacatatttcatgcattcttttgattaaaaatgataaaggtaatattagtgtttttttctttctcacctccaatttatgaagtggaaataattttccatggaatggccaactaaagaaaagaaatatgataaattcagatcatatcattgttccatttatccttgtaccctgtctgtgacagaatacctgatgtttgggatataacaaaaatagatgcatagaatcatagagtttaagaatgtaaaagayttttgaaatcagccattctaataccctaatttttaagatagacaaaaaatggtctccggaaggataaatagtctaacaaaggtcatgcattgagaacaaacctaatatgagccaagatggccgaataggaacagctccagtctacagctcccagcgtgagcgacgcagaagacgggtgatttctgcatttccatctgaggtaccgggttcatctcactagggaatgccagacagtgggcgcaggtcagtgggtgcgcgcaccgtgcgcaagccaaagcagggggaggcattgcctcagtc

SEQ ID NO: 96108 - DNA, 601 bp, Human
gtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgtttccactggaacggtttctttgcttcctgattaaaagcttccctaatatatttccacgtgttattacatattttcrtattcactttgatggaaagcaagaatagcagccaaatacatatttcatgcattcttttgattaaaaatgataaaggtaatattagtgtttttttctttctcacctccaatttatgaagtggaaataattttccatggaatggccaactaaagaaaagaaatatgataaattcagatcatatcattgttccatttatccttgtaccctgtctgtgacagaatacctgatgtttgggatataacaaaaatagatgcatagaatcatagagtttaagaatgtaaaagacttttgaaatcagcc

SEQ ID NO: 96109 - DNA, 601 bp, Human
agcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaatttgatgtggcaagtgagaaaaatacatcaaggatgatgacttttataatttgacttgagtatctgggaacaaacaagtacagtgccataataagggcagaaaattttccattcacycagcaacttatgaactcatttgcttagtctttattgcctcttgcattatgtagttttcactttgctggagtacttgtatagaagatcaccagtgaagaagccagagatggtttatttggtcatcccaataatacatcttattgttaattaactctcaagggttttttttcacaattttagaaaaggtttaagcaaatgaattatttaacatgaattggctatgtgaccctactataaggtgtttaaaacaccaacagcttaaacttcttagatcaaaggacatcctccaggccaaaatgt

SEQ ID NO: 96110 - DNA, 601 bp, Human
aaggaagagcaggaccccactaaactatatggagttttgtgcaaatcacatgaacacacgtagaacattttaggctgctcatgtgactttggatttgtcctaagggcaatagtaagcctttgaactgctttagcatgataggattttaaaagatcactggctgctgtgtgaacaaaaataatgttgtaaagaaaaggatattagctgtatcagatcagctggagactactgaaataacccaagctggcttggactacataggagtagtgtaaactcattcattcatgcaagaaatacttaytgagtgcctactcagtaccagacccttttctaggacatggagttatagcagtgaacaatatagaaaaaaatccccgaattcatggagactccagtgagcagagacaaaaaaatagcaactaaataagttaaaaggaattgagtaccctataaaagtttatcagggaaatgttataaggaatgactttcggagtaatgggtagtgatcttaaatgtatggtcaatgaaaatcagaagttgtagagaagtggataaattcacagtacgttttaaagtagacctaataagacttaatgaattt

SEQ ID NO: 96111 - DNA, 601 bp, Human
ccttccaggggcttctcaaccccaaggcaaccataaagtcctatacaaagaaagatacagcagtgtgaaagaggcctggatgaaaaaacaaagacagagccagtgagccagagccagagccagaggacaagagagaaaggcagagaatggaaaacacagacagagaaggcagatgcgtagagagacagagattcaatgagaaaataaggaaggaagaaagaaagaaaacaaaaacgttctcagcactacaacttctgccttgttctgttccagaacagtatgagctcagtactttttcagactctcaattttctacaactaataatttgctctttcagttagtggcaaaggcttaacgacaaaggttcatctttaatattagagaggcacttttaaaatttatgatgctaagccttttgttctggatatggtatgttgcacaggtctagggactgggatttcagatgtctattccgtacccttattcttttatttattaaatcttttagtgtgtatttttttctattttctcttcttttattagtatgtatttcttgagtcattaacatacaacatatataggacttcctctgaggataca

SEQ ID NO: 96112 - DNA, 601 bp, Human
attgaacatgacagaaatagcagaactcatttgtagaaaagaggcttataattttattaggaatatattcttttggaattcctgaagattgttattctctgaaggaaagatttaggctgttgaaatttacattcgaactctaaaggtgcccttcattttacaagctattacctgaaaatccctctgacattcaaacacagtaagttggcttcatttctgttccttgagtgatttgggctggcttatttccataatacctgaatggtaggttggcaaattgctaatactttattgttctgarttcttttccatacaagtcaatttggttgtttttgatttagtcaaattcttttggggctagtgtacagtgtgcattcattctaatgatctaagttactgatgttttctttactttcctagaaatgatgaatgagattactaaaaatcttgtcaaggtaggaggctatgagctgaattatgattgcatgatggaaaaaagcaattcactacactgaagtttaatctatctagtttctttatgaacgagattccctgattgaaaaccatttctgaacaactgaagcctactccctctgtcttg

SEQ ID NO: 96113 - DNA, 601 bp, Human
ttataatacagctctacaacaaaatcagagttgtttagtataaagactgcatgcttaggagtcacatgggtattaagcgatagcttcagatctgtcacttagaagctgtgtacatttgaaaatctcataacatctccaagcttcagttaaggtgtttataaaatgtggatagttgtaggggtgttatagagattaagtgatgaagcacccagtgcatggcagatactcaaaatattaattcttttcccgataatgtatttacaatttaaatcccatctaatttcacaagaagatttgaagytgacttttgaagaaaaacaaaaacaaagaaaattgaacatgacagaaatagcagaactcatttgtagaaaagaggcttataattttattaggaatatattcttttggaattcctgaagattgttattctctgaaggaaagatttaggctgttgaaatttacattcgaactctaaaggtgcccttcattttacaagctattacctgaaaatccctctgacattcaaacacagtaagttggcttcatttctgttccttgagtgatttgggctggcttatttccataatacctgaatggtagg

SEQ ID NO: 96114 - DNA, 601 bp, Human
taggaccacaagcaaaaaaaaattaaaaaaagaaaggagaagccagctggctgcctgtctccatggtgacagtgatactagccctggcagggaattactaactcaggacaagtttttgttgtgatagggtgcaccaaaacaaatcagatgggtcatacttgaacatgacacacgactttggtcctgactcatataatcagtaatgtcagagaatcttattgaaatcacaaatcgttttgttaggtgaatgaatacattatataacatatataataatacataatgaattatattaaatgtratattatatttataatacagctctacaacaaaatcagagttgtttagtataaagactgcatgcttaggagtcacatgggtattaagcgatagcttcagatctgtcacttagaagctgtgtacatttgaaaatctcataacatctccaagcttcagttaaggtgtttataaaatgtggatagttgtaggggtgttatagagattaagtgatgaagcacccagtgcatggcagatactcaaaatattaattcttttcccgataatgtatttacaatttaaatcccatctaatttcacaagaa

SEQ ID NO: 96115 - DNA, 601 bp, Human
gagggattccaggtggaaggtatgtggtaaattaaaaaaaaaaaaaagcctggatgccaatatatatatatttattagaacacacaaactggtgcttctgcggcataaagtgcaatatgcagttgatatcagaaattctgcacaactataatgctctttttattctgctctctaacatggctgatggcatggttgtaaggcagtggacacaatgggtaacaatgggaaagtaggaccacaagcaaaaaaaaattaaaaaaagaaaggagaagccagctggctgcctgtctccatggtgacrgtgatactagccctggcagggaattactaactcaggacaagtttttgttgtgatagggtgcaccaaaacaaatcagatgggtcatacttgaacatgacacacgactttggtcctgactcatataatcagtaatgtcagagaatcttattgaaatcacaaatcgttttgttaggtgaatgaatacattatataacatatataataatacataatgaattatattaaatgtgatattatatttataatacagctctacaacaaaatcagagttgtttagtataaagactgcatgcttaggag

SEQ ID NO: 96116 - DNA, 601 bp, Human
gaaggagtcagttaaatgaccaaacttttaaaatatgagtgtccataaatatacatcaattgtttctaaatactaagatagatcgatatcttcatagaatggtgcctgttgagtctcagctgctttctaccctgtcatatacctcggtgaatagtagtgggtgtataattatagtcttttatagtcttgagttattgaggaacttattatactatatataaaattatttccctgtaaatttcacataatttacactattacctatatttagatttatctgaaggaaatataaagttattaytttatttaaaacaactttattgcatacttattatataccagcaccgaagaattattaaaccccaaccctgccttcaagaagttcccaacatactggctgaaacagacctctagacagatcattacatgatagtgtgttgaaggaaaatcgtatatacaaaggatatactgcagaaagagtcttgaaagagagtaggttaacagcctaaaaggagcctgccaggtaaggaaggatggggaagacggagggattccaggtggaaggtatgtggtaaattaaaaaaaaaaaaaagcctggatg

SEQ ID NO: 96117 - DNA, 601 bp, Human
catttaatcttcacaagctctttgggatgtgcatattagtctcattttatagtttttaaaactgaggttaaccagagtttaggcttctcagctgctaataagtggaattggatttcaatgcaggttcccaagttgcaattcttaaagttcctctcagattgcctatgcttaacagaagggtcatctatcaggagtccatgactatagctgacgagggacagaggagtgaagcctctactctaggtttctactttctcggtgggtcaaagggatatatacttggaaagatctattccccaamcttgtttgagggccattcttgaaaaaataattttaaggtacggtggtattttgtagctttgaaaataagctacaaggacaaagaaggagtcagttaaatgaccaaacttttaaaatatgagtgtccataaatatacatcaattgtttctaaatactaagatagatcgatatcttcatagaatggtgcctgttgagtctcagctgctttctaccctgtcatatacctcggtgaatagtagtgggtgtataattatagtcttttatagtcttgagttattgaggaacttattatactatata

SEQ ID NO: 96118 - DNA, 601 bp, Human
taagttatggaaactaaaatctcagaagctgagggggaatcttaatataaaattaatcactattttttccatttaactaaaaattctcaaatgatataatataggcaataaaagaaggttgaaattcataggcctttgatattgaacagatacatttttccctaccataataaatgacctgtagttaagtaaataatgagccaaagagaaaatatattcagttttatagaactttgaaagcttctctcaagtctctgtctgagcttattatgaactgcaaaaaaaaaaaaaaaaaaaaaaaagagagagagagaaagaaagaaaacccacaatcatttccaagtacttctttatcccaagtgatttctttaattaaccaataccatccaggccatgaactctcaacattagctatcatatgatcccatataaattgcttgcaaaacattttatcactacttttcattccataaacttctgctgtgtgttttttatccagaaatcaacatgcaacatgggcatgtgtaacttctaaaatctcactgacaactagatattatcaaatgtcagcagacctgccttactgaaagttttccttttt

SEQ ID NO: 96119 - DNA, 601 bp, Human
tggaaaaaaaaaagtattaacaaatctaatatccacaactaaaaagctagatctgtcccctacatgcataattcataataccaagccaagtataaatcatattattatgcaaaaagaaagctattattaagggagatctttaagaagacaccttcgcggattcagttatcttcagagccatttctgaatatattattttccatagatggatatgcaatgttaaatatatctactggacttcattaatggaaaatgtacatgtactcaaattaagcaatttatttttaatatacacactaarttatggaaactaaaatctcagaagctgagggggaatcttaatataaaattaatcactattttttccatttaactaaaaattctcaaatgatataatataggcaataaaagaaggttgaaattcataggcctttgatattgaacagatacatttttccctaccataataaatgacctgtagttaagtaaataatgagccaaagagaaaatatattcagttttatagaactttgaaagcttctctcaagtctctgtctgagcttattatgaactgcaaaaaaaaaaaaaaaaaaaaaagaga

SEQ ID NO: 96120 - DNA, 601 bp, Human
tgatgccggagtgggtctggaagcttgttctgtcggtaagggaggtggaatggctgggctttgtcctacacaatgtagaagtaggaattggaaaaaaaaaagtattaacaaatctaatatccacaactaaaaagctagatctgtcccctacatgcataattcataataccaagccaagtataaatcatattattatgcaaaaagaaagctattattaagggagatctttaagaagacaccttcgcggattcagttatcttcagagccatttctgaatatattattttccatagatggataygcaatgttaaatatatctactggacttcattaatggaaaatgtacatgtactcaaattaagcaatttatttttaatatacacactaagttatggaaactaaaatctcagaagctgagggggaatcttaatataaaattaatcactattttttccatttaactaaaaattctcaaatgatataatataggcaataaaagaaggttgaaattcataggcctttgatattgaacagatacatttttccctaccataataaatgacctgtagttaagtaaataatgagccaaagagaaaatata

SEQ ID NO: 96121 - DNA, 601 bp, Human
gtttctttgtgactatttttgttgttgctgttcctctacattctattttatctacaatagagatctttaagaaaaaaaaaagtacttgccttcaagggcaggtgatgccggagtgggtctggaagcttgttctgtcggtaagggaggtggaatggctgggctttgtcctacacaatgtagaagtaggaattggaaaaaaaaaagtattaacaaatctaatatccacaactaaaaagctagatctgtcccctacatgcataattcataataccaagccaagtataaatcatattattatgcaaaaagaaagctattattaagggagatctttaagaagacaccttcgcggattcagttatcttcagagccatttctgaatatattattttccatagatggatatgcaatgttaaatatatctactggacttcattaatggaaaatgtacatgtactcaaattaagcaatttatttttaatatacacactaagttatggaaactaaaatctcagaagctgagggggaatcttaatataaaattaatcactattttttccatttaactaaaaattctcaaatgatataatataggcaataaaag

SEQ ID NO: 96122 - DNA, 601 bp, Human
atgtgaactattatagtccaaatgccaaaataaatgtaattctgatttttttggtctattttctttctgtttttttttttttggactggttgtttgtaaatcacttgtttactctctaggtaagtgatatacaatagtaacctcttcctggatgaatcctcatgagtgtcatcacttagtctcaagggatggccaaagccaatgggcagttgttgagctgagtgggaagatcttgaacaagcaggctggagtgtccacattgcacacagaagatcttttccaatttgggactgagctaggkgtttctacccctttctagggtggctgtgatctgaggaagacctccatttgtactgttgtaaaaaattaatgatttagctttaattactggtgttttatataggcaaattgagtcttgacagagaaggaactgttttctattcatctctgaatccccagtattttggacaatatctgaaatgatcccatgtttgggatttaataaaagtttaagaaatgaatgaagacttaaagaaatgactttaacgttccagcaaaatttattacaaagctgatcttgagacatcatattttcaagaat

SEQ ID NO: 96123 - DNA, 601 bp, Human
ttttatgagcctctgctaggagataacttggcatcaaacacttgaataatctgactatcaaagtctccctcaagttgggaaatctgaattcgttgctttatgtccatctggaaacaacaacagaattagaatcccatgaaaaattaaggcaacgctattatttataggggttgtcttgtccaatgaacattttggcgagtgagatagttttgtgtcaaattctcttaagtcatgtgaactattatagtccaaatgccaaaataaatgtaattctgatttttttggtctattttctttctgtttttttttttttggactggttgtttgtaaatcacttgtttactctctaggtaagtgatatacaatagtaacctcttcctggatgaatcctcatgagtgtcatcacttagtctcaagggatggccaaagccaatgggcagttgttgagctgagtgggaagatcttgaacaagcaggctggagtgtccacattgcacacagaagatcttttccaatttgggactgagctaggtgtttctacccctttctagggtggctgtgatctgaggaagacctccatttgtactgttgtaaaaaattaa

SEQ ID NO: 96124 - DNA, 601 bp, Human
aagtgacagattgctaagcaaaatatttgctacttggtgttttatgagcctctgctaggagataacttggcatcaaacacttgaataatctgactatcaaagtctccctcaagttgggaaatctgaattcgttgctttatgtccatctggaaacaacaacagaattagaatcccatgaaaaattaaggcaacgctattatttataggggttgtcttgtccaatgaacattttggcgagtgagatagttttgtgtcaaattctcttaagtcatgtgaactattatagtccaaatgccaaaakaaatgtaattctgatttttttggtctattttctttctgtttttttttttttggactggttgtttgtaaatcacttgtttactctctaggtaagtgatatacaatagtaacctcttcctggatgaatcctcatgagtgtcatcacttagtctcaagggatggccaaagccaatgggcagttgttgagctgagtgggaagatcttgaacaagcaggctggagtgtccacattgcacacagaagatcttttccaatttgggactgagctaggtgtttctacccctttctagggtggctgtgat

SEQ ID NO: 96125 - DNA, 601 bp, Human
acaggagctcatgcctgtaatcccagcactttgggaggccaaggagggtggatcacgaggtcaggagattgagaccatcctggctaacacggtgaaaccccgtctctactaaaaatacaaaaaattagccaggcatggtggcgggcgcctgtagtcccagctactcgggaggctgaggcaggagaatggcgtgaacccgggaggcggagcttgcagtgagccgagatggtgccactgcacttccagcctgggcagcagagcaagactccgtctcaagaaaaaaaaaaaataaataataaataaataaataaataaataaataaatacaataacagaacctaagcgtcctacttaacaaatgacacatccttttccaagtgacagattgctaagcaaaatatttgctacttggtgttttatgagcctctgctaggagataacttggcatcaaacacttgaataatctgactatcaaagtctccctcaagttgggaaatctgaattcgttgctttatgtccatctggaaacaacaacagaattagaatcccatgaaaaattaaggcaacgctattatttataggggttgtcttgtccaatgaa

SEQ ID NO: 96126 - DNA, 601 bp, Human
taaaataacaggagctcatgcctgtaatcccagcactttgggaggccaaggagggtggatcacgaggtcaggagattgagaccatcctggctaacacggtgaaaccccgtctctactaaaaatacaaaaaattagccaggcatggtggcgggcgcctgtagtcccagctactcgggaggctgaggcaggagaatggcgtgaacccgggaggcggagcttgcagtgagccgagatggtgccactgcacttccagcctgggcagcagagcaagactccgtctcaagaaaaaaaaaaaataaawaataaataaataaataaataaataaataaatacaataacagaacctaagcgtcctacttaacaaatgacacatccttttccaagtgacagattgctaagcaaaatatttgctacttggtgttttatgagcctctgctaggagataacttggcatcaaacacttgaataatctgactatcaaagtctccctcaagttgggaaatctgaattcgttgctttatgtccatctggaaacaacaacagaattagaatcccatgaaaaattaaggcaacgctattatttataggggttgtcttgtc

SEQ ID NO: 96127 - DNA, 601 bp, Human
ttcaaggcactaaataagtggactgagacaagaagtacacagatacttcccagaacaaagtaagtactgtgcaagttttgtttcttaaatgctatgaaagcacaaagaaggcttttatgggctttaaagacgtgtagtattggctttacagatttgtagtattcttttacccatacagagccacattttttttagatttctactaatgaagttttatttgtttctagtctcctgtgaacaaatttaataatctagtctctatatgagctctacttttaaaaaacattaaaattgaaatatrtacattctcctacattttgacctgatataattgtattcctcaaatataacagcatactttagtgccacatgaaagttcctcctttttacataaagcctttttttttttttctttttgcagcttggttctaaggaagttccagactaaaatagtgcatcaagaggactggcataatcagcctcactaaaaacagcctgattaatactaaatatgtcctagctcctaatcaattatgttaacgaagtcataggcagcacatctgcaagccctgacaaagcccatgatctcagcattgcctga

SEQ ID NO: 96128 - DNA, 601 bp, Human
gatcttttcaaaacctattgtagccaatttttcctggccaaacaaattctaaaacataaaataagagtcaaaggaaataaatgatttaatatataattagtccctttgtatcaaaaaattcaaagtaataaaagcttcattatggcagacaaagcacgcaatgtggggacaacacagaaatccaagaaaggcaagaccaatttcaaggcactaaataagtggactgagacaagaagtacacagatacttcccagaacaaagtaagtactgtgcaagttttgtttcttaaatgctatgaaarcacaaagaaggcttttatgggctttaaagacgtgtagtattggctttacagatttgtagtattcttttacccatacagagccacattttttttagatttctactaatgaagttttatttgtttctagtctcctgtgaacaaatttaataatctagtctctatatgagctctacttttaaaaaacattaaaattgaaatatgtacattctcctacattttgacctgatataattgtattcctcaaatataacagcatactttagtgccacatgaaagttcctcctttttacataaagcctt

SEQ ID NO: 96129 - DNA, 601 bp, Human
cctagtaagagctcccaatagacacgggaattcaaaattgcttaaaagatgagaattaatattatatttacattaggttcattttaaattagtttcagttatatccataattaaatacaaatttacaacaatgaccacaatgatgatgtgaagtggttattgtacaagatcttttcaaaacctattgtagccaatttttcctggccaaacaaattctaaaacataaaataagagtcaaaggaaataaatgatttaatatataattagtccctttgtatcaaaaaattcaaagtaataaaarcttcattatggcagacaaagcacgcaatgtggggacaacacagaaatccaagaaaggcaagaccaatttcaaggcactaaataagtggactgagacaagaagtacacagatacttcccagaacaaagtaagtactgtgcaagttttgtttcttaaatgctatgaaagcacaaagaaggcttttatgggctttaaagacgtgtagtattggctttacagatttgtagtattcttttacccatacagagccacattttttttagatttctactaatgaagttttatttgtttctagtctcct

SEQ ID NO: 96130 - DNA, 601 bp, Human
aattatcctataataaattttatataatgttcttttctcctctgtatctatacaaattcaactaacttactctttatggctcaatgaaagacttgaggtttcacttgataaccttgcctcatttatatctcatcttcctccttttacagcctttatgatttatgtaacttatttttgtgtttcagtaaataatgcttcatagtattatccattgtcccaacaactttaacatctctatcatatctacagttgctatttaaccactgggcaaagctatgtagggttcactctgttcttctgscagtttattaccaatctaccagcctgaaaaatacaggtgtgaaatctttgggtataaaagcatagagggactttagagactatttaagtttggttcataggtgaagaaattgaggccctaagaagtcaattgatttgtcaaagaccatgcaactcattagtatcaaagctgagattgggcaggactctggtcttctctctagagttctcttgttcacatacaagtgttagcatttataatattatttataattgcaagactaagtactagttatatatttattcaacaagatatagggta

SEQ ID NO: 96131 - DNA, 601 bp, Human
tatttctccacaaaacaaagaaaaatattatattgacctgaagttcaataaaatctattgtgtcatggagttaatgaaataaaaattgaggccaaatttctattttattattttattttatttttttacttctcaggatatatctcactgaggagctaaggtaataaagttcttggtttaatagaattgtaaataaaaccttactagctcctgtagaatattgtcttcagatgcatcctatggtaaaaaattatcctataataaattttatataatgttcttttctcctctgtatctatamaaattcaactaacttactctttatggctcaatgaaagacttgaggtttcacttgataaccttgcctcatttatatctcatcttcctccttttacagcctttatgatttatgtaacttatttttgtgtttcagtaaataatgcttcatagtattatccattgtcccaacaactttaacatctctatcatatctacagttgctatttaaccactgggcaaagctatgtagggttcactctgttcttctggcagtttattaccaatctaccagcctgaaaaatacaggtgtgaaatctttggg

SEQ ID NO: 96132 - DNA, 601 bp, Human
catactactctctgctcaattgcttaagcagtaccacacagtctatcaggacatgtaaaagctttagctgtgtatacaaaacattccaagatatggttccagtcctgtattgaaaaattatattagagttttatgtatactgaccaatgtcatgaaagcaatcaccttactagcttctgtggataccaataaagagctaccataaaattaatggtttttatatgtataagaaatttcctgatgtaaaaaatattaacagcaaccaatggttgagtatctaactgtgctagaaaatgtgctrtattgttattagcaactctttaagttaaataggtggtaaaagtagtttggtttatatattttatcataatttgtaactaaagggcaatcctattaaaaatcaccaaaagatatgactttatttctccacaaaacaaagaaaaatattatattgacctgaagttcaataaaatctattgtgtcatggagttaatgaaataaaaattgaggccaaatttctattttattattttattttatttttttacttctcaggatatatctcactgaggagctaaggtaataaagttcttggtttaat

SEQ ID NO: 96133 - DNA, 601 bp, Human
accactcaccaattcatcctttctatagttgacacataatcttgaaaacaaagttaatcatactactctctgctcaattgcttaagcagtaccacacagtctatcaggacatgtaaaagctttagctgtgtatacaaaacattccaagatatggttccagtcctgtattgaaaaattatattagagttttatgtatactgaccaatgtcatgaaagcaatcaccttactagcttctgtggataccaataaagagctaccataaaattaatggtttttatatgtataagaaatttcctgatrtaaaaaatattaacagcaaccaatggttgagtatctaactgtgctagaaaatgtgctatattgttattagcaactctttaagttaaataggtggtaaaagtagtttggtttatatattttatcataatttgtaactaaagggcaatcctattaaaaatcaccaaaagatatgactttatttctccacaaaacaaagaaaaatattatattgacctgaagttcaataaaatctattgtgtcatggagttaatgaaataaaaattgaggccaaatttctattttattattttattttatttt

SEQ ID NO: 96134 - DNA, 601 bp, Human
tgtctcctactggttttgtttctctggagaatgctgactaaatcaatgtgttctacatttcctttcttgggtctatgctgtgttctaaacagcctcagattcatggctgacctgctctttagttatgtttgaagctaacctttgtatgacagtgtttttgagatcatttgctctttaggaaattgatgagtattatcagaaatagaaatatttctgtgattaaaaaaaaaggggaacactggtttaaaaaagttaaacagatttccttaacatacagaatttttggatcctttgatatatgtgtgtgtgcattgtaaatgcaaaagaaaaaatataatatattaagctgcccaaaagtgttttgtcatgaaaactgtttttaacaaataatatcatagaactagagtttctcataacatattccaagaaatgctgtgccagggctaacttatgacttcaatatctatatctccctcatttgtaaactcctgactcatatattcagttgtccactgcagattaccacttatgtggatcaagctcagcatcctgcctgacatgtggtctccatgttctctccaggtccctctccaccccgacc

SEQ ID NO: 96135 - DNA, 601 bp, Human
acttactagcccctgcagctgcatcagccaatcctttaacataaataatattttctcaataaatagatagagagatagatgtctcctactggttttgtttctctggagaatgctgactaaatcaatgtgttctacatttcctttcttgggtctatgctgtgttctaaacagcctcagattcatggctgacctgctctttagttatgtttgaagctaacctttgtatgacagtgtttttgagatcatttgctctttaggaaattgatgagtattatcagaaatagaaatatttctgtgattaaaaaaaaaggggaacactggtttaaaaaagttaaacagatttccttaacatacagaatttttggatcctttgatatatgtgtgtgtgcattgtaaatgcaaaagaaaaaatataatatattaagctgcccaaaagtgttttgtcatgaaaactgtttttaacaaataatatcatagaactagagtttctcataacatattccaagaaatgctgtgccagggctaacttatgacttcaatatctatatctccctcatttgtaaactcctgactcatatattcagttgtccactgcagatta

SEQ ID NO: 96136 - DNA, 601 bp, Human
gaagcaggaaactggccctgatctcaacagaaggcccttttcctgtttcccgcatcatgggggaacattcctggtcttcagagtaaatacctcttgatactgaacagtcaagacagacagatgcccctatctatcttggcagctgtagagggtaagaaaaacaaaactgcttcctcttatggataggacagtgagaaaaagttaattgttttcacaaaaggtctttttaataatcaataacaggaaatcaaaaccaatataacaaaagaagaaagttgtaagtttagagatacaagtttcytgtctattaaaatatatttatagctcataattcatggggaactctcatttctttcccttttcattttcctttttttttcttttgatgctttgtcacctatttgtttttgtgtttttaagaaaatttactcaacagttattaatacttacctacttttccatgacactaagctgaattatacttgttttaacatattaactgaaagatacctatgttacctcaggccaagccctagtacagtgtttcagttaaaaaaataaaaaacaagagtctaaaattctaagaaaaaattgaaaatat

SEQ ID NO: 96137 - DNA, 601 bp, Human
ggaggaaacattcttttttataaaatgttttatgagaaaatttgctgacacaaggaagtttcacttagaattccataacaagaaagagattagatcaaattcgctcaaattcacaaactgtgtcatccttcttctttggtcttttacaagtcaaaatgcaagtaaaaaaccatttcttttatactagcattaacagttaggaaagggctgtgaagcaggaaactggccctgatctcaacagaaggcccttttcctgtttcccgcatcatgggggaacattcctggtcttcagagtaaatayctcttgatactgaacagtcaagacagacagatgcccctatctatcttggcagctgtagagggtaagaaaaacaaaactgcttcctcttatggataggacagtgagaaaaagttaattgttttcacaaaaggtctttttaataatcaataacaggaaatcaaaaccaatataacaaaagaagaaagttgtaagtttagagatacaagtttcttgtctattaaaatatatttatagctcataattcatggggaactctcatttctttcccttttcattttcctttttttttcttttgatgct

SEQ ID NO: 96138 - DNA, 601 bp, Human
ggaaaaattggtacttgtaagcaagagcattggaggaaacattcttttttataaaatgttttatgagaaaatttgctgacacaaggaagtttcacttagaattccataacaagaaagagattagatcaaattcgctcaaattcacaaactgtgtcatccttcttctttggtcttttacaagtcaaaatgcaagtaaaaaaccatttcttttatactagcattaacagttaggaaagggctgtgaagcaggaaactggccctgatctcaacagaaggcccttttcctgtttcccgcatcatgggggaacattcctggtcttcagagtaaatacctcttgatactgaacagtcaagacagacagatgcccctatctatcttggcagctgtagagggtaagaaaaacaaaactgcttcctcttatggataggacagtgagaaaaagttaattgttttcacaaaaggtctttttaataatcaataacaggaaatcaaaaccaatataacaaaagaagaaagttgtaagtttagagatacaagtttcttgtctattaaaatatatttatagctcataattcatggggaactctcatttctttccct

SEQ ID NO: 96139 - DNA, 601 bp, Human
agagggaaaggatgacgccatttggaattgtaacaagctggtataataggaagaaatatttatgtcaaacagaccagatcgcaaacaaatgttttataaggaaaaattggtacttgtaagcaagagcattggaggaaacattcttttttataaaatgttttatgagaaaatttgctgacacaaggaagtttcacttagaattccataacaagaaagagattagatcaaattcgctcaaattcacaaactgtgtcatccttcttctttggtcttttacaagtcaaaatgcaagtaaaaaacyatttcttttatactagcattaacagttaggaaagggctgtgaagcaggaaactggccctgatctcaacagaaggcccttttcctgtttcccgcatcatgggggaacattcctggtcttcagagtaaatacctcttgatactgaacagtcaagacagacagatgcccctatctatcttggcagctgtagagggtaagaaaaacaaaactgcttcctcttatggataggacagtgagaaaaagttaattgttttcacaaaaggtctttttaataatcaataacaggaaatcaaaaccaatat

SEQ ID NO: 96140 - DNA, 601 bp, Human
aaggcaaatgctcaaagtttactgacttggactcagaggagaagctcaattcacatgcacttatctctttagataactccataaattacaaatgcttttgtttgtttgtttggtgttgctgacttttggaaattcctaaaaaactcttttaaatttttatgcagaatcattgcttactcaagatgttttattgtaagctttcctaaagtgtcttgtagaaatagtaaagaaaacataaatataagtttcttttctaacaacttttcatttacaatatcatgttacttacataaaattactktttccatattttatctatatgtttttctacatttttctgtaattggaaatggattgcaagaatatttcattacatttaaaatgtcaaggatgcctagaaacgttagaaaattgagctttttcttttcatgactaaattatcagtacaagaaaaagttggttgcaactcaaaaccaaaacatacattaccttaaagtactatttcaaagatactgctatttttataacagttttggacttgatttattaaataaattaataagacccaatagctattttaaaatatgatttgactttaaaa

SEQ ID NO: 96141 - DNA, 601 bp, Human
gttagagaaacaaagagagaagaaaagaggagcgagacgggagaaggaaaaggagatgctatattttatttttccactcagtgcttttgcatttcagaaggcaaatgctcaaagtttactgacttggactcagaggagaagctcaattcacatgcacttatctctttagataactccataaattacaaatgcttttgtttgtttgtttggtgttgctgacttttggaaattcctaaaaaactcttttaaatttttatgcagaatcattgcttactcaagatgttttattgtaagctttccyaaagtgtcttgtagaaatagtaaagaaaacataaatataagtttcttttctaacaacttttcatttacaatatcatgttacttacataaaattactgtttccatattttatctatatgtttttctacatttttctgtaattggaaatggattgcaagaatatttcattacatttaaaatgtcaaggatgcctagaaacgttagaaaattgagctttttcttttcatgactaaattatcagtacaagaaaaagttggttgcaactcaaaaccaaaacatacattaccttaaagtactattt

SEQ ID NO: 96142 - DNA, 601 bp, Human
tgttctttctcactttctatatagagtgaaacaaaaaaggcaaccactgtgtgtgtgtgtgtgtgtgtgtgtgtgtgtgtctgtgtgtgttagagaaacaaagagagaagaaaagaggagcgagacgggagaaggaaaaggagatgctatattttatttttccactcagtgcttttgcatttcagaaggcaaatgctcaaagtttactgacttggactcagaggagaagctcaattcacatgcacttatctctttagataactccataaattacaaatgcttttgtttgtttgtttggtgytgctgacttttggaaattcctaaaaaactcttttaaatttttatgcagaatcattgcttactcaagatgttttattgtaagctttcctaaagtgtcttgtagaaatagtaaagaaaacataaatataagtttcttttctaacaacttttcatttacaatatcatgttacttacataaaattactgtttccatattttatctatatgtttttctacatttttctgtaattggaaatggattgcaagaatatttcattacatttaaaatgtcaaggatgcctagaaacgttagaaaattgag

SEQ ID NO: 96143 - DNA, 601 bp, Human
ttttcatatttctgaatttagtatgcaaaaggaaaggtaacgagaaagattattcaatacatttcaaattgcaaaaatgtttctatgttaattaaacttagcatttaaaatggataaggtagatttctcccaaaccttttgaaaatgataaagctttttacatgagtgattgcatttatttaaaatgggttgtgtttatatagctgaggggtgccatgtctgttctttctcactttctatatagagtgaaacaaaaaaggcaaccactgtgtgtgtgtgtgtgtgtgtgtgtgtgtgtgtstgtgtgtgttagagaaacaaagagagaagaaaagaggagcgagacgggagaaggaaaaggagatgctatattttatttttccactcagtgcttttgcatttcagaaggcaaatgctcaaagtttactgacttggactcagaggagaagctcaattcacatgcacttatctctttagataactccataaattacaaatgcttttgtttgtttgtttggtgttgctgacttttggaaattcctaaaaaactcttttaaatttttatgcagaatcattgcttactcaagatgttttattgtaa

SEQ ID NO: 96144 - DNA, 601 bp, Human
agaaactgtggtgtgtgtgtgtgtgtgtgtgtgtatgtatatatatacatgatggaatacaactcagccataaaaaggaatgaattaacagcatttgcagtgacctggatgagattggagactattattctaagtgaagtaactcaggaatggaaaaccaaacatcgggtgttctcactaatttgtgggagctaagctataaggacacaaagacataagaatgatacaatgaactttgcggacttgggggaagagtgggagggggacgagggacaaaagactacaaatacggtgcagtgtrtacttctcggatgatgggtgcaccaaaatctcacaaatcaccactaaaaaatttactcatgtaaccaaataccacctgtactcaataactgacggaaaaatgttaaaaaatgatatcatactacctttttccctttgagcctccgaaaggtgtgatgaaaggattttaataatcactttattttacatggtcaaacaaggtaaaaaaatatgttttagtttgggttggaaccacagtaatttcaagacaataagaaattatactattagaataaagcacatgagcttgtatgcactagaa

SEQ ID NO: 96145 - DNA, 601 bp, Human
ctactgagtatctacccaaaggaaaagaagccattatttgaaaaagattgaacacgcatgtttatagcagcacaattcacaattacaaaattgtgaaaccaaaccaaatgcccatcagtcaatgagtggataaagaaactgtggtgtgtgtgtgtgtgtgtgtgtgtatgtatatatatacatgatggaatacaactcagccataaaaaggaatgaattaacagcatttgcagtgacctggatgagattggagactattattctaagtgaagtaactcaggaatggaaaaccaaacatcgkgtgttctcactaatttgtgggagctaagctataaggacacaaagacataagaatgatacaatgaactttgcggacttgggggaagagtgggagggggacgagggacaaaagactacaaatacggtgcagtgtatacttctcggatgatgggtgcaccaaaatctcacaaatcaccactaaaaaatttactcatgtaaccaaataccacctgtactcaataactgacggaaaaatgttaaaaaatgatatcatactacctttttccctttgagcctccgaaaggtgtgatgaaaggatttt

SEQ ID NO: 96146 - DNA, 601 bp, Human
actactgagtatctacccaaaggaaaagaagccattatttgaaaaagattgaacacgcatgtttatagcagcacaattcacaattacaaaattgtgaaaccaaaccaaatgcccatcagtcaatgagtggataaagaaactgtggtgtgtgtgtgtgtgtgtgtgtgtatgtatatatatacatgatggaatacaactcagccataaaaaggaatgaattaacagcatttgcagtgacctggatgagattggagactattattctaagtgaagtaactcaggaatggaaaaccaaacatcrggtgttctcactaatttgtgggagctaagctataaggacacaaagacataagaatgatacaatgaactttgcggacttgggggaagagtgggagggggacgagggacaaaagactacaaatacggtgcagtgtatacttctcggatgatgggtgcaccaaaatctcacaaatcaccactaaaaaatttactcatgtaaccaaataccacctgtactcaataactgacggaaaaatgttaaaaaatgatatcatactacctttttccctttgagcctccgaaaggtgtgatgaaaggattt

SEQ ID NO: 96147 - DNA, 601 bp, Human
ggagattctttgaagaactaaaagtagaactaccatttgatccagcaatcccactactgagtatctacccaaaggaaaagaagccattatttgaaaaagattgaacacgcatgtttatagcagcacaattcacaattacaaaattgtgaaaccaaaccaaatgcccatcagtcaatgagtggataaagaaactgtggtgtgtgtgtgtgtgtgtgtgtgtatgtatatatatacatgatggaatacaactcagccataaaaaggaatgaattaacagcatttgcagtgacctggatgagaytggagactattattctaagtgaagtaactcaggaatggaaaaccaaacatcgggtgttctcactaatttgtgggagctaagctataaggacacaaagacataagaatgatacaatgaactttgcggacttgggggaagagtgggagggggacgagggacaaaagactacaaatacggtgcagtgtatacttctcggatgatgggtgcaccaaaatctcacaaatcaccactaaaaaatttactcatgtaaccaaataccacctgtactcaataactgacggaaaaatgttaaaaaatgat

SEQ ID NO: 96148 - DNA, 601 bp, Human
catccctcctagtttaaatcaggaagaattagataccctaagcagaccaataacaagcagcaagactgaaatcataatttaaaaattaccaacaaaaaaaagtccaggaccagttggattcacagaattctaccagacattccaagaagaattggtgccaatacttttgacactattccacaagatagagaaataaggaattctccccaattcattttatgaagtcagtattacctgaataccaaaatcaggaaaggacataatgaaaaatgaaaactacagaccaatatccttgatgaayataaatgttaaaatccttaacaaaatactagctaacggaatccaataacatatcaaaaagataatccaccatgatcaagtgggtttcataccagggatgaagggatggtttaacatatgcaagtcaataaattcaatacaccacataaacagaattaaaaacgaaaatcatatgatcatctcaattgatgcagaaaaagcatgagacaaaatccagcatcactttgtgattaaaactctcagcaaaatcagcattcaagggacataccttaatgtaataaaagctttccatgaaaaaccc

SEQ ID NO: 96149 - DNA, 601 bp, Human
taaattcctagaaaaatacatccctcctagtttaaatcaggaagaattagataccctaagcagaccaataacaagcagcaagactgaaatcataatttaaaaattaccaacaaaaaaaagtccaggaccagttggattcacagaattctaccagacattccaagaagaattggtgccaatacttttgacactattccacaagatagagaaataaggaattctccccaattcattttatgaagtcagtattacctgaataccaaaatcaggaaaggacataatgaaaaatgaaaactacagrccaatatccttgatgaacataaatgttaaaatccttaacaaaatactagctaacggaatccaataacatatcaaaaagataatccaccatgatcaagtgggtttcataccagggatgaagggatggtttaacatatgcaagtcaataaattcaatacaccacataaacagaattaaaaacgaaaatcatatgatcatctcaattgatgcagaaaaagcatgagacaaaatccagcatcactttgtgattaaaactctcagcaaaatcagcattcaagggacataccttaatgtaataaaa

SEQ ID NO: 96150 - DNA, 601 bp, Human
ttacccacataaactaaaaacctagaagagatggataaattcctagaaaaatacatccctcctagtttaaatcaggaagaattagataccctaagcagaccaataacaagcagcaagactgaaatcataatttaaaaattaccaacaaaaaaaagtccaggaccagttggattcacagaattctaccagacattccaagaagaattggtgccaatacttttgacactattccacaagatagagaaataaggaattctccccaattcattttatgaagtcagtattacctgaataccaaaaycaggaaaggacataatgaaaaatgaaaactacagaccaatatccttgatgaacataaatgttaaaatccttaacaaaatactagctaacggaatccaataacatatcaaaaagataatccaccatgatcaagtgggtttcataccagggatgaagggatggtttaacatatgcaagtcaataaattcaatacaccacataaacagaattaaaaacgaaaatcatatgatcatctcaattgatgcagaaaaagcatgagacaaaatccagcatcactttgtgattaaaactctcagcaaaa

SEQ ID NO: 96151 - DNA, 601 bp, Human
ttgaaaagataaataaaattgatagaccattagcaagattaaccaagaagagaagagagaaaatacaaataacttcactaagaaatgaaacaggagacattacaattgacaccactgaaataaaaaagatcactcaaggctattatgaacacctttacccacataaactaaaaacctagaagagatggataaattcctagaaaaatacatccctcctagtttaaatcaggaagaattagataccctaagcagaccaataacaagcagcaagactgaaatcataatttaaaaattaccaacmaaaaaaagtccaggaccagttggattcacagaattctaccagacattccaagaagaattggtgccaatacttttgacactattccacaagatagagaaataaggaattctccccaattcattttatgaagtcagtattacctgaataccaaaatcaggaaaggacataatgaaaaatgaaaactacagaccaatatccttgatgaacataaatgttaaaatccttaacaaaatactagctaacggaatccaataacatatcaaaaagataatccaccatgatcaagtgggtttcatacca

SEQ ID NO: 96152 - DNA, 601 bp, Human
tgaaataaaaagctggttctttgaaaagataaataaaattgatagaccattagcaagattaaccaagaagagaagagagaaaatacaaataacttcactaagaaatgaaacaggagacattacaattgacaccactgaaataaaaaagatcactcaaggctattatgaacacctttacccacataaactaaaaacctagaagagatggataaattcctagaaaaatacatccctcctagtttaaatcaggaagaattagataccctaagcagaccaataacaagcagcaagactgaaatcrtaatttaaaaattaccaacaaaaaaaagtccaggaccagttggattcacagaattctaccagacattccaagaagaattggtgccaatacttttgacactattccacaagatagagaaataaggaattctccccaattcattttatgaagtcagtattacctgaataccaaaatcaggaaaggacataatgaaaaatgaaaactacagaccaatatccttgatgaacataaatgttaaaatccttaacaaaatactagctaacggaatccaataacatatcaaaaagataatccaccatg

SEQ ID NO: 96153 - DNA, 601 bp, Human
aataaccaagatcagagcagaaataaataaaattgaaacaacaacaaaaaaatacaaaagataaatgaaataaaaagctggttctttgaaaagataaataaaattgatagaccattagcaagattaaccaagaagagaagagagaaaatacaaataacttcactaagaaatgaaacaggagacattacaattgacaccactgaaataaaaaagatcactcaaggctattatgaacacctttacccacataaactaaaaacctagaagagatggataaattcctagaaaaatacatccctcstagtttaaatcaggaagaattagataccctaagcagaccaataacaagcagcaagactgaaatcataatttaaaaattaccaacaaaaaaaagtccaggaccagttggattcacagaattctaccagacattccaagaagaattggtgccaatacttttgacactattccacaagatagagaaataaggaattctccccaattcattttatgaagtcagtattacctgaataccaaaatcaggaaaggacataatgaaaaatgaaaactacagaccaatatccttgatgaacataaatgt

SEQ ID NO: 96154 - DNA, 601 bp, Human
taggccataaaatgagcctcaataaatttaagaaaactgaaattatatcaagcactctctcagaccacagtggaataaaactggaaatcaactgcaaaaggaatcttcaaaaccatgcaaatacatggaaattaaataacctgctcccaaatgagcactggctcaaaaacaaaatcaagaaggaaatttaaaaattatttgaactgaatgacaataataaccaacctaccaaaacctctgggattcagcaaaggcagtgctgagaggaaagttcatggccctaaatgcctacatcaaaaakactaaaaaagcaaaaattgacttctaaggtcacacctcatagaactagagaaacaagagcaaaccaaacccaaacccagcagaagaaagaaataaccaagatcagagcagaaataaataaaattgaaacaacaacaaaaaaatacaaaagataaatgaaataaaaagctggttctttgaaaagataaataaaattgatagaccattagcaagattaaccaagaagagaagagagaaaatacaaataacttcactaagaaatgaaacaggagacattacaattgacaccactgaaataaaa

SEQ ID NO: 96155 - DNA, 601 bp, Human
caaatagacaccaaaagcaagcagaggtagctattcttatatcagacaagaaaaacagacaagaaaaaccttaaaccaacagcagtaaaaagagacaaagagggacattatataatggtaaaaggtcttgtccaacaggaaaatattgcaatcctaaatatatatgcacctaacactggagctcccaaagttataaaacaattactaacagacctaagaaattagatagatagcaacacaaaaatagtgggggactttaatactccactgacagcactaaactgatcatcaagacagaaartcaacaaagaaacaatggatttaaactatatcttggaacaactggacttaacagatatatacagaacatttcatccaacaaccacagaatacacattctattcaatagtgcacggaactttctccaagatagatcatatggtaggccataaaatgagcctcaataaatttaagaaaactgaaattatatcaagcactctctcagaccacagtggaataaaactggaaatcaactgcaaaaggaatcttcaaaaccatgcaaatacatggaaattaaataacctgctcccaaatgagcact

SEQ ID NO: 96156 - DNA, 601 bp, Human
taggagactcacctaagacttaaggacacacataaacttaaaggaaaggggtagaaaaaggcatttcatgcaaatagacaccaaaagcaagcagaggtagctattcttatatcagacaagaaaaacagacaagaaaaaccttaaaccaacagcagtaaaaagagacaaagagggacattatataatggtaaaaggtcttgtccaacaggaaaatattgcaatcctaaatatatatgcacctaacactggagctcccaaagttataaaacaattactaacagacctaagaaattagatagayagcaacacaaaaatagtgggggactttaatactccactgacagcactaaactgatcatcaagacagaaaatcaacaaagaaacaatggatttaaactatatcttggaacaactggacttaacagatatatacagaacatttcatccaacaaccacagaatacacattctattcaatagtgcacggaactttctccaagatagatcatatggtaggccataaaatgagcctcaataaatttaagaaaactgaaattatatcaagcactctctcagaccacagtggaataaaactggaaatc

SEQ ID NO: 96157 - DNA, 601 bp, Human
gctaaaaggagctctaaatcttgaaacaaatcctggaaacacatcaaaacagaacctctttaaagcataaatcacataggccctataagacaaaaatagaagttaaaaagcaaaaacaaaataaccaaagtacacaggcaacaaagagcacaatgaatgcaatggtgcctcccatttcaatactaacattgaatgtaaacggcctaaatgctccacttaaaagatacagaaccacagaatggctaagaaatcaccaaccaactatctgctgcctttaggagactcacctaagacttaaggrcacacataaacttaaaggaaaggggtagaaaaaggcatttcatgcaaatagacaccaaaagcaagcagaggtagctattcttatatcagacaagaaaaacagacaagaaaaaccttaaaccaacagcagtaaaaagagacaaagagggacattatataatggtaaaaggtcttgtccaacaggaaaatattgcaatcctaaatatatatgcacctaacactggagctcccaaagttataaaacaattactaacagacctaagaaattagatagatagcaacacaaaaatagtgggggact

SEQ ID NO: 96158 - DNA, 601 bp, Human
acaaatactgagagaattcgccattaccaagccaccagtacaagaactgctaaaaggagctctaaatcttgaaacaaatcctggaaacacatcaaaacagaacctctttaaagcataaatcacataggccctataagacaaaaatagaagttaaaaagcaaaaacaaaataaccaaagtacacaggcaacaaagagcacaatgaatgcaatggtgcctcccatttcaatactaacattgaatgtaaacggcctaaatgctccacttaaaagatacagaaccacagaatggctaagaaatcrccaaccaactatctgctgcctttaggagactcacctaagacttaaggacacacataaacttaaaggaaaggggtagaaaaaggcatttcatgcaaatagacaccaaaagcaagcagaggtagctattcttatatcagacaagaaaaacagacaagaaaaaccttaaaccaacagcagtaaaaagagacaaagagggacattatataatggtaaaaggtcttgtccaacaggaaaatattgcaatcctaaatatatatgcacctaacactggagctcccaaagttataaaacaattactaa

SEQ ID NO: 96159 - DNA, 601 bp, Human
ttgtcatcaggttatccaaagttaagatgaaggaaacaatcttaagagctgtgagagaagcaccaggtaacctctaaaggaaaaacctatcagattaacaacagatttctgagcagaaaccttacaagccagaagggattggggccctatcttcagcctcctcaaacagaacaatcatcagccaagaattttgtatccagtgaaactaagcatcatatatgaaggaaagatgaagtctttttcagacaaacaaatactgagagaattcgccattaccaagccaccagtacaagaactgctraaaggagctctaaatcttgaaacaaatcctggaaacacatcaaaacagaacctctttaaagcataaatcacataggccctataagacaaaaatagaagttaaaaagcaaaaacaaaataaccaaagtacacaggcaacaaagagcacaatgaatgcaatggtgcctcccatttcaatactaacattgaatgtaaacggcctaaatgctccacttaaaagatacagaaccacagaatggctaagaaatcaccaaccaactatctgctgcctttaggagactcacctaagacttaaggacac

SEQ ID NO: 96160 - DNA, 601 bp, Human
catccaaatacaagaagcacaaagaacacctgggaaattcattgcaaaaagatcatcacctaggcacattgtcatcaggttatccaaagttaagatgaaggaaacaatcttaagagctgtgagagaagcaccaggtaacctctaaaggaaaaacctatcagattaacaacagatttctgagcagaaaccttacaagccagaagggattggggccctatcttcagcctcctcaaacagaacaatcatcagccaagaattttgtatccagtgaaactaagcatcatatatgaaggaaagatgmagtctttttcagacaaacaaatactgagagaattcgccattaccaagccaccagtacaagaactgctaaaaggagctctaaatcttgaaacaaatcctggaaacacatcaaaacagaacctctttaaagcataaatcacataggccctataagacaaaaatagaagttaaaaagcaaaaacaaaataaccaaagtacacaggcaacaaagagcacaatgaatgcaatggtgcctcccatttcaatactaacattgaatgtaaacggcctaaatgctccacttaaaagatacagaaccaca

SEQ ID NO: 96161 - DNA, 601 bp, Human
caaggaaaactactccagccttgctagagacttagacatccaaatacaagaagcacaaagaacacctgggaaattcattgcaaaaagatcatcacctaggcacattgtcatcaggttatccaaagttaagatgaaggaaacaatcttaagagctgtgagagaagcaccaggtaacctctaaaggaaaaacctatcagattaacaacagatttctgagcagaaaccttacaagccagaagggattggggccctatcttcagcctcctcaaacagaacaatcatcagccaagaattttgtatmcagtgaaactaagcatcatatatgaaggaaagatgaagtctttttcagacaaacaaatactgagagaattcgccattaccaagccaccagtacaagaactgctaaaaggagctctaaatcttgaaacaaatcctggaaacacatcaaaacagaacctctttaaagcataaatcacataggccctataagacaaaaatagaagttaaaaagcaaaaacaaaataaccaaagtacacaggcaacaaagagcacaatgaatgcaatggtgcctcccatttcaatactaacattgaatgtaaac

SEQ ID NO: 96162 - DNA, 601 bp, Human
atagaatcgaacaattaaaagaaagaaattcagagctctaagacaaggtctttgaattaacccaatccaataaagacaaagaacagtgaataagaaaatatgaacaaagcttccaagaagtctgggattatgttaaatgaccaaatctaagaataatcggttttcctgaggaataagagaattctgaaatcttgtaaaacatatttgggggaataatcaaggaaaactactccagccttgctagagacttagacatccaaatacaagaagcacaaagaacacctgggaaattcattgcaaraagatcatcacctaggcacattgtcatcaggttatccaaagttaagatgaaggaaacaatcttaagagctgtgagagaagcaccaggtaacctctaaaggaaaaacctatcagattaacaacagatttctgagcagaaaccttacaagccagaagggattggggccctatcttcagcctcctcaaacagaacaatcatcagccaagaattttgtatccagtgaaactaagcatcatatatgaaggaaagatgaagtctttttcagacaaacaaatactgagagaattcgccattaccaag

SEQ ID NO: 96163 - DNA, 601 bp, Human
ctttggacacacttttagaaatgtgaaatgctctggaaaatctcagcaatagaatcgaacaattaaaagaaagaaattcagagctctaagacaaggtctttgaattaacccaatccaataaagacaaagaacagtgaataagaaaatatgaacaaagcttccaagaagtctgggattatgttaaatgaccaaatctaagaataatcggttttcctgaggaataagagaattctgaaatcttgtaaaacatatttgggggaataatcaaggaaaactactccagccttgctagagacttagrcatccaaatacaagaagcacaaagaacacctgggaaattcattgcaaaaagatcatcacctaggcacattgtcatcaggttatccaaagttaagatgaaggaaacaatcttaagagctgtgagagaagcaccaggtaacctctaaaggaaaaacctatcagattaacaacagatttctgagcagaaaccttacaagccagaagggattggggccctatcttcagcctcctcaaacagaacaatcatcagccaagaattttgtatccagtgaaactaagcatcatatatgaaggaaagatg

SEQ ID NO: 96164 - DNA, 601 bp, Human
tacaagaagtgaagggagaaatattcaaggaaacagatcgattaaaaaaaatcaacaattcaggaaactttggacacacttttagaaatgtgaaatgctctggaaaatctcagcaatagaatcgaacaattaaaagaaagaaattcagagctctaagacaaggtctttgaattaacccaatccaataaagacaaagaacagtgaataagaaaatatgaacaaagcttccaagaagtctgggattatgttaaatgaccaaatctaagaataatcggttttcctgaggaataagagaattctraaatcttgtaaaacatatttgggggaataatcaaggaaaactactccagccttgctagagacttagacatccaaatacaagaagcacaaagaacacctgggaaattcattgcaaaaagatcatcacctaggcacattgtcatcaggttatccaaagttaagatgaaggaaacaatcttaagagctgtgagagaagcaccaggtaacctctaaaggaaaaacctatcagattaacaacagatttctgagcagaaaccttacaagccagaagggattggggccctatcttcagcctcctcaa

SEQ ID NO: 96165 - DNA, 601 bp, Human
agaatctgaacaacagccttcagccctagaccttcactctgacagagcctacccaaatgagaaggaaccagaaaaccaacgctggtaatatgacaaaacaaggcttctcagcacaccccaaaaatcatactagttcaccagcaaaggattcaaaccaagaagaaatctctgatttacctgaaaaagaattcaggagttaggttattaagctaatcagggaggcaccagagaaaggtgaagcccagtgcaaggaaatccaaaaaacaatacaagaagtgaagggagaaatattcaaggaaayagatcgattaaaaaaaatcaacaattcaggaaactttggacacacttttagaaatgtgaaatgctctggaaaatctcagcaatagaatcgaacaattaaaagaaagaaattcagagctctaagacaaggtctttgaattaacccaatccaataaagacaaagaacagtgaataagaaaatatgaacaaagcttccaagaagtctgggattatgttaaatgaccaaatctaagaataatcggttttcctgaggaataagagaattctgaaatcttgtaaaacatatttgggggaataatca

SEQ ID NO: 96166 - DNA, 601 bp, Human
cctcctgcactttggtgcaggaggccaaccagcacaataatagagcattaaaccacaaaagctaagaaccctcacagagtccattgcactcccctgccacctccaccagaataggcactggtattcgtggctgagagacccacagatggttcacataacaggactctgtgcagacaaccccagtaccagcccagagccgggtagacgcgctgggtggctagacccagaagagagacaacaatcactgcagtttggctcacaggaagccacatccataggaaaagggggagagtactacatyaagagaacaccctaggggacaaaagaatctgaacaacagccttcagccctagaccttcactctgacagagcctacccaaatgagaaggaaccagaaaaccaacgctggtaatatgacaaaacaaggcttctcagcacaccccaaaaatcatactagttcaccagcaaaggattcaaaccaagaagaaatctctgatttacctgaaaaagaattcaggagttaggttattaagctaatcagggaggcaccagagaaaggtgaagcccagtgcaaggaaatccaaaaaacaatacaagaagt

SEQ ID NO: 96167 - DNA, 601 bp, Human
ccccacagcagctacagcaagacccacccaaggagagtctgagcccagacattcctagccctgcccccgtttgatggtccttccctacccacccaggtagcagaagacaaaaggccacgcccactactggtccctctccatactactgcagctgatgctctctggaaagcaccacctcctgcactttggtgcaggaggccaaccagcacaataatagagcattaaaccacaaaagctaagaaccctcacagagtccattgcactcccctgccacctccaccagaataggcactggtattcrtggctgagagacccacagatggttcacataacaggactctgtgcagacaaccccagtaccagcccagagccgggtagacgcgctgggtggctagacccagaagagagacaacaatcactgcagtttggctcacaggaagccacatccataggaaaagggggagagtactacatcaagagaacaccctaggggacaaaagaatctgaacaacagccttcagccctagaccttcactctgacagagcctacccaaatgagaaggaaccagaaaaccaacgctggtaatatgacaaaacaagg

SEQ ID NO: 96168 - DNA, 601 bp, Human
ttgtaacaatttgaatggggtgagaagcctcctggccagaactccggggagggtgcaaatctggtgtgcagactccacaggcaggggaagaaccaagcccttttcttttgcagctggaaggtgggtagcctcgggcaagttttcaagcccatctcgccctccacctggaaacagacttgggctgttggcgggggacatggtgggagtgagactggccctttggttagcttgggagctgggtgaggcctgtgactgctggctttccccgacttccctgtcaacctgcatgactcagcagagrcagccataatcctcctacttacacaactccagtgacctgggaatctcacccccatcccccacagcagctacagcaagacccacccaaggagagtctgagcccagacattcctagccctgcccccgtttgatggtccttccctacccacccaggtagcagaagacaaaaggccacgcccactactggtccctctccatactactgcagctgatgctctctggaaagcaccacctcctgcactttggtgcaggaggccaaccagcacaataatagagcattaaaccacaaaagctaagaacc

SEQ ID NO: 96169 - DNA, 601 bp, Human
ttggagagttgagcaaaatgcaggggcagaggaagcagcagaaagacactgagagctcgctgggtcccctagcaggccattcctgcctggcaccacagggattcatcaggagggtggtcagaagagcagggggtaaaaccacagggagaagaaaatctctagctgaactttgtaacaatttgaatggggtgagaagcctcctggccagaactccggggagggtgcaaatctggtgtgcagactccacaggcaggggaagaaccaagcccttttcttttgcagctggaaggtgggtagcctygggcaagttttcaagcccatctcgccctccacctggaaacagacttgggctgttggcgggggacatggtgggagtgagactggccctttggttagcttgggagctgggtgaggcctgtgactgctggctttccccgacttccctgtcaacctgcatgactcagcagagacagccataatcctcctacttacacaactccagtgacctgggaatctcacccccatcccccacagcagctacagcaagacccacccaaggagagtctgagcccagacattcctagccctgcccccgtttgat

SEQ ID NO: 96170 - DNA, 601 bp, Human
actacaggcagtgacccaagattgtggccactgcactctagtctgggccacagagtgagatcagtttcaaaaaaaaaaaaaaaaggtcgttgtgaatgttagctccagatcaactgcaagaacaaatcagcaatcccaagaggacccacagaccctctgaaggaagcagactgcttctgcaggacctgggagtcacctcaaataccgagagtgccccaactgtggaagtgggaaagggagaccctcttctcccgaatacacacccccactgtagaaaatgatgggctgtttgcaggagaartttccaactttatcaggagctgagtcaatttggagagttgagcaaaatgcaggggcagaggaagcagcagaaagacactgagagctcgctgggtcccctagcaggccattcctgcctggcaccacagggattcatcaggagggtggtcagaagagcagggggtaaaaccacagggagaagaaaatctctagctgaactttgtaacaatttgaatggggtgagaagcctcctggccagaactccggggagggtgcaaatctggtgtgcagactccacaggcaggggaagaaccaagccctt

SEQ ID NO: 96171 - DNA, 601 bp, Human
cttgcagatgcagttgagaactcagtgaagctatatcattcatgaaataaatgttgtaaaggactctaggtcttatctgtttaaattcaaacttcttcaagataccatactacaggcagtgacccaagattgtggccactgcactctagtctgggccacagagtgagatcagtttcaaaaaaaaaaaaaaaaggtcgttgtgaatgttagctccagatcaactgcaagaacaaatcagcaatcccaagaggacccacagaccctctgaaggaagcagactgcttctgcaggacctgggagwcacctcaaataccgagagtgccccaactgtggaagtgggaaagggagaccctcttctcccgaatacacacccccactgtagaaaatgatgggctgtttgcaggagaaatttccaactttatcaggagctgagtcaatttggagagttgagcaaaatgcaggggcagaggaagcagcagaaagacactgagagctcgctgggtcccctagcaggccattcctgcctggcaccacagggattcatcaggagggtggtcagaagagcagggggtaaaaccacagggagaagaaaatctctagc

SEQ ID NO: 96172 - DNA, 601 bp, Human
taagcagagaagttatacaattctgagtgatggtttaagaaaaactttggctgttgctaggtggtcaagtgtctcattggattttgtgatcaaattgaaagggagaagacttagggaaaaaaataattcagaacaaatattcttcttctatttttttttccaaaaatttcctcggaattttatttgggactctggaaggcacgcaactttatagcaacatggtaagagtacctcccttcacattgtaattaggttgctatgacagaaaagctttttaaattaaggacttcacttgagttaygtggcataactaagctggcctttcaggctctgaatccatttttttttttgccttgacttttctttagtgatagctgaattattctcagaagtctgctcttctcattatcaactgttaacaacaaacaactaacaagcagcaattctacagcactttccagtgactacccgagacctttagtcatacaatttattcacataaatcaacaaatgcttatctagtcttatgccaaaaccctttgcctgtgtttggagttttaaaaacctccttccagtaatactaggtgtgacagcagtaagt

SEQ ID NO: 96173 - DNA, 601 bp, Human
gtgttgagtgctgcagccaagatgtagtagggcagatctcctagaatctttttactggtatgaattttccatttccctgtgagtaacataggaagccagtgagaggtttaagcagagaagttatacaattctgagtgatggtttaagaaaaactttggctgttgctaggtggtcaagtgtctcattggattttgtgatcaaattgaaagggagaagacttagggaaaaaaataattcagaacaaatattcttcttctatttttttttccaaaaatttcctcggaattttatttgggactcyggaaggcacgcaactttatagcaacatggtaagagtacctcccttcacattgtaattaggttgctatgacagaaaagctttttaaattaaggacttcacttgagttatgtggcataactaagctggcctttcaggctctgaatccatttttttttttgccttgacttttctttagtgatagctgaattattctcagaagtctgctcttctcattatcaactgttaacaacaaacaactaacaagcagcaattctacagcactttccagtgactacccgagacctttagtcatacaattta

SEQ ID NO: 96174 - DNA, 601 bp, Human
tagaggactcaggaggggagtgttgagtgctgcagccaagatgtagtagggcagatctcctagaatctttttactggtatgaattttccatttccctgtgagtaacataggaagccagtgagaggtttaagcagagaagttatacaattctgagtgatggtttaagaaaaactttggctgttgctaggtggtcaagtgtctcattggattttgtgatcaaattgaaagggagaagacttagggaaaaaaataattcagaacaaatattcttcttctatttttttttccaaaaatttcctcrgaattttatttgggactctggaaggcacgcaactttatagcaacatggtaagagtacctcccttcacattgtaattaggttgctatgacagaaaagctttttaaattaaggacttcacttgagttatgtggcataactaagctggcctttcaggctctgaatccatttttttttttgccttgacttttctttagtgatagctgaattattctcagaagtctgctcttctcattatcaactgttaacaacaaacaactaacaagcagcaattctacagcactttccagtgactacccgaga

SEQ ID NO: 96175 - DNA, 601 bp, Human
gctaggcctagtgaggccagagtagaggactcaggaggggagtgttgagtgctgcagccaagatgtagtagggcagatctcctagaatctttttactggtatgaattttccatttccctgtgagtaacataggaagccagtgagaggtttaagcagagaagttatacaattctgagtgatggtttaagaaaaactttggctgttgctaggtggtcaagtgtctcattggattttgtgatcaaattgaaagggagaagacttagggaaaaaaataattcagaacaaatattcttcttctatwtttttttccaaaaatttcctcggaattttatttgggactctggaaggcacgcaactttatagcaacatggtaagagtacctcccttcacattgtaattaggttgctatgacagaaaagctttttaaattaaggacttcacttgagttatgtggcataactaagctggcctttcaggctctgaatccatttttttttttgccttgacttttctttagtgatagctgaattattctcagaagtctgctcttctcattatcaactgttaacaacaaacaactaacaagcagcaattctacagc

SEQ ID NO: 96176 - DNA, 601 bp, Human
atctcaaaaaaaaaaaaaaaaaaaaaaaaagaagagctaggcctagtgaggccagagtagaggactcaggaggggagtgttgagtgctgcagccaagatgtagtagggcagatctcctagaatctttttactggtatgaattttccatttccctgtgagtaacataggaagccagtgagaggtttaagcagagaagttatacaattctgagtgatggtttaagaaaaactttggctgttgctaggtggtcaagtgtctcattggattttgtgatcaaattgaaagggagaagacttagggaaaaaaataattcagaacaaatattcttcttctatttttttttccaaaaatttcctcggaattttatttgggactctggaaggcacgcaactttatagcaacatggtaagagtacctcccttcacattgtaattaggttgctatgacagaaaagctttttaaattaaggacttcacttgagttatgtggcataactaagctggcctttcaggctctgaatccatttttttttttgccttgacttttctttagtgatagctgaattattctcagaagtctgctcttctcattatcaactgtt

SEQ ID NO: 96177 - DNA, 601 bp, Human
tgagattgtgccactgcactccagtctgggcaacagagccagattccatctcaaaaaaaaaaaaaaaaaaaaaaaaagaagagctaggcctagtgaggccagagtagaggactcaggaggggagtgttgagtgctgcagccaagatgtagtagggcagatctcctagaatctttttactggtatgaattttccatttccctgtgagtaacataggaagccagtgagaggtttaagcagagaagttatacaattctgagtgatggtttaagaaaaactttggctgttgctaggtggtcaagwgtctcattggattttgtgatcaaattgaaagggagaagacttagggaaaaaaataattcagaacaaatattcttcttctatttttttttccaaaaatttcctcggaattttatttgggactctggaaggcacgcaactttatagcaacatggtaagagtacctcccttcacattgtaattaggttgctatgacagaaaagctttttaaattaaggacttcacttgagttatgtggcataactaagctggcctttcaggctctgaatccatttttttttttgccttgacttttctttagtg

SEQ ID NO: 96178 - DNA, 601 bp, Human
aatgacaagctattactatattttacaaataataaaaatctgaccacatataatctttttaggtaattttttaggtgtgacatttactgatctctttgagtaaatgcaactttattcttatttttctatatccagggagggtatgtctagaatattttgtattaagaaactaaagggaaaaaaatacccataagcaagacagaaacatgttatgaagggtactgtactgcaatgaagtggattcaagtctcaattttgctataattagtagtcattaccttatgcaactatagatgaatgytgtatcttctgtcttcaaccataaaaggcagagaaatgagtagaatgtgtttgagtcccctttcacctgtttattccttatttaccaagtgaaatatgcatcatcttgcatttattttctaattttcctgggaatgggtaacctaaaaagagttgcaaatatcgatggcatgttgtctggttttgatatggcttaaaattgtttaaagcaagagaaaagtccattttagaggcttaaaatgaatatgtatgtatataatatatatatacatatacatattatatatatttttttggacaa

SEQ ID NO: 96179 - DNA, 601 bp, Human
ccttgcccctgactttttcttcctcaacagccaagagtactcttccctttctgtctacctgactttgaacacacataaaaaatttcctcttccatctctttctcattggtttgccattttgtttgtaacagctagagaagaattagagcatttaagcccattgatgttcagaagattaaaaattaaatgtatctacaggatgtgaaagtatcagaatattacctttccctgacaaaagtataataagccctgaaatgatggctgtattctggcagggatcacagaagagtgtggttgggaragaaatcttccctacaatgagcagctctgagccacaaatatgttattagcttctgcataaattaacatcagatgaaagaaaaattaaacgacttacttcttactttctaagccctcacaatgggcttttctcttgcttttaaatgttttttatgccatctcaaagccagacaatacacaatatttaattacaattgcaaagctttctaagatgctgtttccacgaggaaacaaatgcaaaatgttttatttttgtcttatgttttgttcctcccctctttgcccttctagtgtagagatt

SEQ ID NO: 96180 - DNA, 601 bp, Human
aggaattaactcattcccataggtatagagcttttttacctacaagatcaaagacaacactttctttcaatgttagacatataatttataaagaacccctttcatgatttctagagataatctaatgtctcagggaaaaatgtattcacactttgtctaaaagtgtctacagcatactattacagctcatccaatcagaagtagaaagtcaagaagtcaaattttgatagtttcagagatagaaataaaccaattgatttccacttcttcttttctaaaggtttatgcatattaaacatgyagatcatatttaaaattctgaatgaagatactttcaagtatcactactttcagcttctctgggagaaattttatgtagtagtgaattttacatcttctctaaataaatgtatatgccagacaattgaatagccatttgctaagcatcacctctgatgtcatgtatcagcaaaggggttaattaaaatacaaatgacttgtaaatatttctaagctcaagctaaacactaatgccatactaaccataagatcagaactcagtatccaagtctccaagtttcataaggttgatgaataaata

SEQ ID NO: 96181 - DNA, 601 bp, Human
cgtggaagagccctgtttcataaatctgagacagccttggtctgagggagcaaagacagagaattcacgtgctgcccaggcatagccacatagcaggtggacatccctggacacttttctggtaagcataatcattttagataacaaagtcctgtactaatacatagttgttgaaattgaatgttcagtggttttagatttgggacaataatagctacggttaatgttgtaaatgtactgatttttatcttcaattagcagtgctatttaccttatatttgaaattcctttctctttgtcmgttgtctctcatctcaggtacaggtacattcaaagacttccgttacccagaactattataagatcattattatgctaaagaaattcaatatgtagttctagaatgaatccttaagttgtctactaatgactgcatcttattaaatagaggaattaactcattcccataggtatagagcttttttacctacaagatcaaagacaacactttctttcaatgttagacatataatttataaagaacccctttcatgatttctagagataatctaatgtctcagggaaaaatgtattcacactt

SEQ ID NO: 96182 - DNA, 601 bp, Human
ttagggaaatttagtatgaaagcaaaaccaaggttgaaatgaaggatttttgttaagtcagttctgcctccagctagctttgtgactgagcaagtaatttaatcccactaagtcttattttcctcatttatcaaataataatacctccctcaaagttaatgtttacaaaacactgtgtaaagtgcctggctcacagtaaatgtgtaacgttgtagactgctaatactgtttacaaataatgaatgtgatagtttgaactttctgaaccaaacaattgtttatctagtgcctaaaagtattratatataaaattaaaatatatttcttggaaaatatactgcagataaactagaagaattaatatttgttttcttttatacatttaatttcattagaaataatatattagaccattaaaaaggtatcttttgatgtagctgtttttcatatctggctcttgccaacaggcatttaagcctgatgacaagtgtctggcagtgtgttggaaacataacttccacggtcctttctgagtggttgtatcaacaaggctgttcaatctttgcacccagaggttgcagtaagtctggatgccacatca
